United States Patent 7,420,044 (NUCLEIC ACID AND PROTEIN HOMOLOGS AND USES THEREOF) - sequence listing, part 6

SEQ ID NO: 17623 - DNA, 737 bp, Homo sapiens
tgctattattatcagccatcaatgttccaaataatttgaaaacatagagaagacacagttttctcacagtgggagtcaagccaagtagaataaataccaggtgaaaattctagagaattttaggagaggtaatttgtacattctttcatttctttttggtttctttttcaactcgggaaattatctagactagccttttgtatctgcttttataataattctcaaataaggcccctagcttagtatcctcatagaaacagcagcttctattaaccatctgttgttcctttaattatggtttctgtgataattgtgaaagaatagagatgaaaatttgataaattggggagcattagaccagaagcattcatgtttattagtctgaaaaagcacttctattagacaactttctattccacattcaaaaattcatcagaaattatataaaagaaaaattgatctgcctttgacactgggtcttaatgtatgattgtgatcaatatttcttagaattggactatgtttgaaggacctcccacaagcagaatatgatacgaccattaaagagacaagctaaaatggagtgctcacaggtgggttctaataaaaatggcctcccttctcatagaggatgtctggcccccgacccatgcaagattaatatacctgtggggaaccccgaaagacaccttctacatctcagagagagattcgcacaaacacttgttgaccctcgg

SEQ ID NO: 17624 - DNA, 1853 bp, Homo sapiens
  misc_feature (1)...(1853): n = A,T,C or G
ctcctccccataggctgcctnggtcgtgggnnncnnccaggagccntctgttgcanttatggttcttttcatcccgccttcccctagtatactccttcnctttggtttgtgtatggtttattgtgtcgtagttgagcttgtgttgtgtgctgttcgggggtgtgtgttgttttcgcagatggtgccttcctggtatgcatgtggcgcagtgaggtgtgacgttcgcgcgcggaccgctacacactacttcagaaacgaggattacgaaattagtttacactatataaggacgccgcatcgtcattcatcactaatttgtacgggtcttgtagagatatgttatgtgtgtcnatggtantatggagaatcaggtaatcagagctagggtgtgagatcaggctgcgtgcactagtatgcgcatattcgtctgcgtgatcgattccggaccatatattatttgatcttttatacttgtttgtaattgtcccttgttcttgttcactttatgtatattatgtgtgcgcgtgcgtgtggccttcttcgattcgattttctgcttatgttgtatgttaggaggttggaggcggaggatggggaaggcgtggttgatagtgaggttacggaanttcgatacgaggagccgaggcgaagcgcgtagaacatgaaacaagttaataggacaaatatagtacgggacgtgcggtgtctctagtggatgcggattgttataggtgaatcgtagtttacgcgcgaatgtagccgtaacgcccacagaccacacgctatcgtgtaatcgtcgttatctcgtcatcgcgtgtcacactgtagttatatatgttataaccgatcttctggatcgtttacatgtattgatttattcttcacttacatatgattcgttgatgtcacgtgcgttggacggtatatncaggtacgatccgcggagacggttacgagctgggttggcgcggcagagganggttggagtgtggaggtgatgcactcatgcgatgcgtagtnaggttgnggtgtgacggagttgcggcgtgcgcatctgggaccgagtagcagctccgccgagtatcaggtcattntttgtcgcttactgtgtgcacgatagagtgatcaagtagctcagggttgcagacggatacgacagacgctcctccntcagtcttgattcctactccagatgcgacatcangcgatcaaactactactcgtcatcgcacttacgtcatgttcaggggtactgtgttnatgatgttgtgtnattgctctatccacgncagctagcacagtggacatgtatggtgtgcaggngctgtgtatcttatctgtctgtagcagcgtgagatcactaatgnggcgcggatgantctcagcagatattcgagttntcatanagggagactgagtatggtgcacaggactcacgcgtgtagaccantgtttatgcatggactgtagtttatagacgggtacactagctnanagggactntgtagtagtcgtaacttatatatgtagtatggctgcgtccgncaagagtatgtgagtgtcatacatcctacaccgacggtattagtacggaggaggncagcgtgntggtgcgtgtgttgttgcgatatgtatatcgtgtgcgtccgcgtcattgtatacagtcgacggtgtcgcgtcgtgntntacgcgagtgcgtgtagcgacgttgtgtgctgaggaatacgctgactatattaccanaatatacgtgcgccgtgtccacaggtgagagaancggttcgcgacagagtatancgcgacccagagacgagtgccagtagatgtatatgganttgctatatgtgtagtac

SEQ ID NO: 17625 - DNA, 915 bp, Homo sapiens
  misc_feature (1)...(915): n = A,T,C or G
cttggccaanagaaccanatttgcccttcctcctctcagcctactcaacgtgatataatgaggatgaagacctttgtaatgaccttttcccacataatgaatagccattgggagacacacttctgaacaccanccactggaaaatcacacatgctgaaatgggagagttccctgacccccttgcaggatatgtgacaggagtgtggctcatctgttcagctggagtgcatactcaaaccccttatgagacaaggagtatgcagacagaaggtgcaggaactgggaagcaaaatataaactagttaatttgatctccaagagttaagcggttttaatattactgacagtaatatcagcagtggtgttggaaccccatgatctcatgaatcatagatagtaactgcttactggacattgaagctttatggccagctgccaaaaaaataaatgcaccttaatttttaaattgaattatgaaggcgaaaatctcctgttgctctatagctcttattttggagaacgcatgggactatatgattcacttagcttgacacaatgtaactgtaaaggaaactctactgtggacggtggcgacggtcggtacgtagtggcgacggtagccgtgccctgggtgccgggtattactacgtgtgcgggcgccgcacctccgccacagccacggcccccttccagatacgaccccccaccccacgcgccgcccacccgtcccgtcatccctcccctcccctcccctccccctgtaccaattaccagtatcgatcagcccccagaccccccccctgtatccccagccacaccgcggtatcctcactccgcgtgctgctctatcccgccccccctcatccgccgtcgacccccccgctgagtttcgccccgaccgcctcagcacagcaa

SEQ ID NO: 17626 - DNA, 566 bp, Homo sapiens
  misc_feature (1)...(566): n = A,T,C or G
ttggcgcangacaggncatctcactgctggtcttgactcctggnatgcagtaatcttcccaacttggcctcccaagtgctgggattatagccatgagccaccgcacctggccagaaatatctttaaagcaggaagaaggaaatgatgcattacctataagaagaaatgattacctatagaagaaaatgattcaaatgcaactgatttctcattgtctgcacataagaaaccagcaaaatgtatttcaagtgctgaatataaagaaatgccaagctagaattccatcatcaataaaatttgtacttcataaatatatacaattatcatttgtcaatattcaattaaaaacagaatgaagaggacatggaggcattttcagatgaagagaaactaacaggatttttcagcagacttactctaaatgaatggctacaggaaatactataaaaataaaggaaatgataaaagaagaaactttgttacatcaagaaagaaggaagaaccaccagtaaacanaaatatgggtaaataaaataaaattttttttaacgtcaaaaaaaaaaaaa

SEQ ID NO: 17627 - DNA, 583 bp, Homo sapiens
ttgcccgaggctggcgatgcagtggcaccatctccgctcactgcaagctgcgcctcatgggttcacgccattctcctgcctcagcctgccgagtagctgggactacaggcacgcgccactacgcctggctaatttttttgtatttttagtagagacagggtttcaccgtgttagccaggatggtctccatgtcctgacctcgtgatccgcccgcctcggcctcccaaagtgctggaattacaggcgtgagccaccgtgcctggcgaaatcaagttttataatgatgttttccatttgtataataaatatttccgagtattaacattttatctttcatactttttcaaatgtagttcttttaattctccaattaagattttcttattacctgaggaaagaagtgattattagcatggcaaaaaacaaggaatagagtatgttttgaaaactgtcatgttgaagatttatttctatgtgcgttattcttctgtaaacatgtaaacagatagtgattaaaagtaatataactataataataataattttactttaataaaaatgccatacaagaaaaaaaaaaaaa

SEQ ID NO: 17628 - DNA, 390 bp, Homo sapiens
ccttagccgaggcttgtctagttagaagtgagccttcaggaggaacagcagcaagcagatcattagctgtggaagttccaactgccaaaagggagaactttactctgagaaaacctgagaccaccaagctatgcaaaaagcctagtgaagactactaaaggataagaagccacatagaggaagaccaagatactctaaccagcagtcaccatcaattgccagacatgggaatgaggccactgggaccctccagttccaactgagctgtcagatgactgcaactacgtgaatgacctcaggctagaccagaagaaccactcacatggccaactcaaaaaactgagagaaataataaatcatggatgttttaagacacgaaaaaaaaaaaaa

SEQ ID NO: 17629 - DNA, 1522 bp, Homo sapiens
  misc_feature (1)...(1522): n = A,T,C or G
tgcttcgcttctcttgtgccagcatctcacactattgaattaattatgacattnagggagagtctattttttctgctgctcttactattgggacagactttagatagttattttatcgttgagcgccgacaagatgtaagaaataataaacacaaaaagaaaaacccagtggccaaccgacaacaaagattaagaatgatggacatattatgctacctaatagcgaacagcggaagcttagatttgaggtagatacacgctaatgccgcgccgccctgcgacccatcatatgaaatcctcacatacttcctacccacgacatcatctctcatcttagtacttctatcaatttattttatcgtccccgttttgtcgctggacaacgttggcaaccttgctacagtatatatgataggggagcgctcaacgatcttaagagtctagttagttagactatataatttaagaagtatagtataaagacataatatttgtacaagaatacggatttgtatttatatcactcaaacacaacacacgatcatctcagaccaagttatgtgttagtgtctacgtcgttcgatttctgacacgtcccgccgtattgcatctaggattcaggctctgacgatgcacatgcacaccacacacagatgtgtcgcgccccaggccgtatattcgtgacgttgtgccggtatacattggcgccgtttcccttgtgtgcccactagtgttgttctttagaggtgagcagtaccaccctgtccgatcctatcagaaatatttataacacattaattttacagctaccacactaatctacgacgtatacactagtcctaccctcacatgtttattaattatcatataaagacgttgataacacgcctgttctcatgtcagtatttatctttacgctcttccgtgctatcactgacaaacaatactctcaccaaactgttacatcccttatgtttatttatattcacacgcatattatacgcgctaagacagacatattttgtaatgagagagagcttcaactagagatattaaactattgttctaagtaaagcttaagttagaattatgcataactttatgccgtacattaggntctccagcaagtatctataataccacaatcatctagtgtatattcaggaccacactatagcatattatatcaccaaattcagttgtgttgctcccaccagagaataacatcgataaagtcnacgcttcgttgcntnttcgccagcttgtcgcagtcgcgcaccgactttntcgagtcatacgcacaccacattgtactcgntgaacgcnattacgcgacatacactctaatctatctggtacaacgntctcgagcacgcacactacaagtatattaactcacaaaccgatnaccgaatacacacacnacacagaacaccgcacagattatgccatgatgtgccaacgtacnagcgnaatactcaggcgactacntcctctntatgtatatattatatatattatg

SEQ ID NO: 17630 - DNA, 1129 bp, Homo sapiens
  misc_feature (1)...(1129): n = A,T,C or G
tgcgtgctgtgcggcgggggatttaacgaggagttatggtcaagtagtcaacggccaccaggtagatggcttgctgcgtgaatggaancatggcacagagtaagggaggaacacatgcatttgtgcacaatgcacagcgtaccctgatgctggacagctgtagcatcaaccggcggtatctttctggacaagagctgctagtatgtgttattgagcggagtacacagaacagtggtgaagggcgggaggtagggactgtacctgaggaaaggttgcttttgtacagcacgcatgtttcgatggtcgaacacgtgcgctggaatgggccagaagcataaggtgggcaggctattctgcgccctggaggatgagtgctaactagcaagccgatggcgtgtgcggtcacgtagatgttgcgtgatagccgccgctccgcacataagaacgttgtgcgcgatcgtcagcagatcggcgtctattgtgtcgtcgacggctcgtcgcttcctttgcggcaacaggaagcagtcgccgtgtcccggtgacactacccccccgcccgcgcttaatactcttcgtcctcgtttccacggccgttctcgtccacgccggtatctctccgctcgccgtattttccatctcgctctgcccctgctaccatacagcgccccctggcccccaccgctccccgcctgccggtcacgctcattgtgctctctacacttcacttcgttccctagacccccacacctcaccgagctcacttctattccaaccccgtccccccgcccgcctcagtgtgccacaggcttcactctgtctcctctcctcgacctacatcttgatgaaccccattccgttctctttttcccccgcgcctgctgcggcggtcactttgcccgtcttcgccgcgcaccgcttacgcgcatttttttcccccccgccggtgccccggattcttacctctttatcattcccccgccctgtacactcctcgtcttgccccatttctctggcggcgcgcggaagtcttctccatgcgtaccactacgtactaatcatctacatgaagtcgtcctgtgttatctttcgttcgccccacaccgttgccctaacgcgtttctacttctcc

SEQ ID NO: 17631 - DNA, 347 bp, Homo sapiens
  misc_feature (1)...(347): n = A,T,C or G
cttggccgtnagaacagggcattcacctgttagccagaaggtctcgatctcctgacctcgtgatccacccgcctcggcctcccaagtgctgggattacaggcgtgagccaccacacccagctaatgtgtgtcacttctaagctggagcacttaatgcccctgtgagactctccagaactcctcatcttccctttggaatggcgatcaacgatattcaagatggctgcttctctctgagcctggatccctcagtaactaacataagaaggtccctcctgctaatccacactgtgtatataacacgagcaagaaataaacctttgtgttcgaagccaaaaaaaaaaaaa

SEQ ID NO: 17632 - DNA, 907 bp, Homo sapiens
  misc_feature (1)...(907): n = A,T,C or G
ggttcgctgaggtaccagnctgtatggaaaggcctctaagacacaggcagagggcaggtgtcctgctgtggtaggcacctgtcttccagcttgcccaactctgggactagtcctgcagcctgtcctggcacagatgtagcccaaagcctgacattctgcctccagagctgcccaaagaccagcaccaagcccttaactggtaacacaacctgatggtaccatgtctcagtgatgggtggggggacttatttcatctggctcatccaggcacagagttgtttatttcaactttctttgggtgccagtccacttgaccagaaacacaaatgaaaccccgacttctgaaacccaccacaccccccactggccctccccgcccccccccgcggtcctctcccccttctctccctccccccgggcgttttgttcccccccgcctcctgttccctcccccctcgtcgccggttgttcttatagcccccccatcctttccgtggtccttacctctcctcccgcccccgcccttttcccccatttcccctctccccctccccccccccccccctgttttctttcccctctcccgcccccccccgaccttccttgcctcgcccgcccttctcgccacccaggcgtggcgcgccgcgcccccccgcccgttctcctatttccgccccccggagcccgcccgatttctgccttgcatccttcctcccgcttccccccccccccctctacctctccatttttctatcctgtcccccccgccccgagtttcgacctcttcaaccccgcttttcccttcgccagttaccctctccgctgttttctactttccccccccaccctattaatgagccgagttacgccttgccccacgcagtccctcaccccccgctatgaatca

SEQ ID NO: 17633 - DNA, 306 bp, Homo sapiens
  misc_feature (1)...(306): n = A,T,C or G
cctgggccgangancaaantactttctctgtcgctccagctgnaatgcaatggcgtgatcatagttcactgcagccttgaactcctgggctcaaacgatcctcccacctcagcctcctgagtagctgggactgcaggtgcatgccaccactcccagcctgtgatttttgtgtgtgtgaaacataattactatgaaacatattactatgatttgttgcctatattcatacctaaaggaagtgctgtatttcaactagaggtcagtgaaaataaaattatatcgttttgttctagaaaaaaaaaaaaa

SEQ ID NO: 17634 - DNA, 401 bp, Homo sapiens
  misc_feature (1)...(401): n = A,T,C or G
cgccgaggggcccgttggggggagaatgttaagttttggnnngcatggggcgaggttgcaatattttggcctgttgctgcagtttttctgagaaaacttctttcctgtcttcctgtgatcttatgcatgcattggcatacacgggactgcattcctttgccacaggtaattgagcacttaggagaaatacaagggatatgtgaaatggcgcaaatcaagtcacttgtattgactgctggccaatctgaatatagcatacaaccatttccaccagtcagcctgtgacaagagtcagccatatttgtctgaacacaggtaggtacaacattctgtaattgtgtaatttaatcaatatttaaatattaaataattaaatctgagtgccncgaaaaaaaaaaaaa

SEQ ID NO: 17635 - DNA, 533 bp, Homo sapiens
  misc_feature (1)...(533): n = A,T,C or G
acctaaagcgaggtcnttccctgnagtacctactctcaatccacttgaagcctcccaccagaagagcccaactctcccctgacttcctacagcatgttctgtcctcagagaacgtacatctcctgctgtctcttaagaagtctctttgggtacaagaccgagagctcattgagggcaggaattatttcttttcatcttgtgtagcacttcacaaatatctctatgccagtgaatgacaaatattaggagctcaataaatatttgttgaattaaaactaaacacaataatttgcgtaaggctcttggcataattttggcacatagcagttactcctaaatgggagcaattattattttcatatataaatgagattcatgtatctgcttttttgccctatcctatgaacttctaaggtctctctttaaaaaaatgtggatgtagttctgacagtcaacattcatgtcaatgttctctagaaaatctcattaaataactaagagatttttactttccaatttcaaaaaaaaaaaaa

SEQ ID NO: 17636 - DNA, 301 bp, Homo sapiens
  misc_feature (1)...(301): n = A,T,C or G
ccttgcgaggttcttcagcaattcacattanaaaagtatctgcgactggtatatttgngaaaatgttatacatgataacaatgaagaaagaatacagcagactagatatttagtgatcatgtaatcaaatgtaaactgctactttgtttctttctaaagctttctttaggttctaattccaaattacattttaaaaactgccgaactaatgacactatttttatcattctcgaactctcaaatatctaattaccctcatccccgacccctcttccttaacacccgttgtccaccgtcccga

SEQ ID NO: 17637 - DNA, 1123 bp, Homo sapiens
  misc_feature (1)...(1123): n = A,T,C or G
tccctccgtgcanannnaatatttgggggnnacactaagnncnctgncanaaggngncactnactcttgggncacttcttnacnnctgnnctggnaggncnatttggncataanatatnncactngnaatnctcttcgnatnncacncgnaggggaattggacncatagncnctgccngagagatattcaacaacttgacagttgctggtgcatttatatctgacccggtggcaatgataccagaaacgcaaggaaggatagaatagcagaattctgcatgatttagacttgcaaggaatgctgtggcagcctggtaagattacacttgagaaagatcatcttacatctagaaaaggtgctggtatgaaacacagaagatgcactttgctgaagaatgttgaaaaaacataggagctcttcataggatagtgcactagaatggtcagttactacctatccaccaacaggatggtacgcagtagattactagggagcacttgtgattgtacgaaacgcgtctggcttgaccactgagatttccacggctacatttgtttgattgccaacccttcgcgtgggggtcgagagtcacatgaagacctgccggtgaaaactgacggactgcctccacccgcagtgatctccgagacctccatacacacccagtcggagttcccgcgtaataccgtcaccgccctcgagccaccccaccgcccatatttactatcccccttcccatccccgcccccgccgcatccgtggccctcctctttcctatctacgacaacattcgtcaaaccgctcctatgtacccccccgcgcggatatccccccaatcaccccccaccgctcccccccctcgtttccgtccccgtcgttccgcgtccacgcccgccacttcacccccccgcgcttgctccactgcccaccaccacgttatcccatccgccccgccctcccctctctcttcgtttcttcacattctctcgccccgcaatcccacattacacacgcgttcccacgcgtccaccacaatgtcctaattgccccgcccgccacttgttatatggccccgactgccacccgtccccagactcagcgctaacacggcgctacttgccc

SEQ ID NO: 17638 - DNA, 975 bp, Homo sapiens
  misc_feature (1)...(975): n = A,T,C or G
ggcagaggggccgttaggggaagaaagtataagttttagaaaaaggtttcngtagggaaaccgggtttccgacgacggagnacacggtgcttcacagcaacaacagtggtcaaagcatcagtccagttcagaactgctgttgtgggatctggcttccaagcgagatctttgtttcttcattaccttaccaagtgccagtgaatgattcatggacctgtgtaaccttctggggaatcctggaaagtatttggaaggaaaactgggaaaattagaaactctgctagtgcggcgagaagaattttcaaatttactgtgaactggtgtgagtgtaaatgggacctaacctgcccatgccctttggccctgcgatgcctgtggtgatgcgcgccctggctgggcgggggtgccggggccttccccccgtgctgccgcccgctgttctccccccccccgcttgtttcccgcgccctccccccccgtcccggcgtcccccggcccccccccgcccctgccccccccccccccccccgccctccccccctccgggggggcgcccgccccgcgtccccggtccctcctcccccccgcccccctcccccccccgctgccgtgtcccccggtcctgccccccccccccctccccgcgccctccgtcctccggtggcgcgccgcgcccgcggtgccccccgggtacccctccccccgcttttctttttttcccccccccctgtgtcccccccgttttttcgccttcctccccttgctcggcgcgttcgcccccccccgcttcggccgggccgatggcgcgttgtcggtcccccccccgccccgtgtttcgttgcttcgttctcctccccgtgctcccccttgcccccggtcccccctcccccccgctctgcttttagccccgcccccctttctttttcgcggtttgtcccggacctccctgttctcgcatgaaccaaaaaaaaaaac

SEQ ID NO: 17639 - DNA, 521 bp, Homo sapiens
  misc_feature (1)...(521): n = A,T,C or G
gccagggggctcgctagggccatgaaaattaaagtctttgaaancgcctcggcaggaaaaccactttggcccagacgnaagcaaggcacagggcacgacccagtagcctccaggcgcctaccacttcaaacaatccctactggcacgggctagaacactgcatgcatccatccaggcacagcaacttaaaatgatccaacaggaaaaaaaaaaacaggtgcttgcaaagaggggctaggtcaacactggccttgcccaagtaccatgctcgagaactggacctcaggaactgcgacacacacgccctgtgcagaaattggtaatttcatcattgcttgaccaaatgactcccaccacagaaaggcacaaattttccattgggatggattctgccctcccccttggggggcatactccttctctgtcgtgcttttgaaaccccactcactatgtgaagcacaggcccttcaaactgatgctaaaggcaactctgatgccacacgcccggaaaaaaaaaaaaa

SEQ ID NO: 17640 - DNA, 617 bp, Homo sapiens
  misc_feature (1)...(617): n = A,T,C or G
cactgggtagggnnaaacagnaaataaggaaaagnaaaacagaataaaaaaatagaacaggagctggagagcagggagaaataggaaaagaaaaaggagaagaaaggaagaagggaggtagaaaagaagggggaatctctacctctgactttgacaaacgctatgaaaatctttactgttgaccaggcgatggcgcaatataacctatcctggatgatactactactactaacaacaataacaactcgacttagtctttcatagttataaccgtatttttcacaacacattgtgctgtattttatttaaataattgtatacaatacaaaattgctaattttggaagatataaattataatatgtattntgtcttgccaattcatatctctgaagccaattttatcatttatttaaaatggcatttaagaaggaatttatctctaggttaaaaagtaagttttccatcaataagattatatttttacagaaataatagtataaaagtggtgcttttacacttttacagtgaaaaaattgtacattctttagttttgttgaaagacactaaaaaaagtagtatgtcttaaaaagtagtccttctcgaaaaaaaaaaaaa

SEQ ID NO: 17641 - DNA, 344 bp, Homo sapiens
  misc_feature (1)...(344): n = A,T,C or G
gaactcgcgtgntntacaacctttcctaagcttcccatggtttgcagaagccccagccaaaacatggtgccagcaagaattagccttctactggaggactggaaggaggaccagtgtgactggagtggaggaagcataggcaaagtggtctgacacaaggagggaagatgtctggcccaaaccaaggaaatgccatgtgagaacatagcaaacagaaggccagctacaaaccaggaagaggtccctcaccagaatccagatctgctgccaccttgataatggacttgttgccttcagaactgtactgaaatacacgtctgttgtttatgccaaaaaaaaaaaaa

SEQ ID NO: 17642 - DNA, 301 bp, Homo sapiens
cctggccagtattcctcagtcctgcatactgagtaactactgactaagctggtctgaaggaccccactgatgctagctgatctgaaggtatccactaatgccagctgatctgaagcaccaactgatgccagctggtctgaaggaccccactgatgccagatgatctgaaaaaccctacaaggggctgactcaccaaagaatgcaatttccatgtcctgatgattttatcccccttaacccaactaatcaacaattccaattttctaggccctcacccactacaatccccttaaaattccca

SEQ ID NO: 17643 - DNA, 251 bp, Homo sapiens
  misc_feature (1)...(251): n = A,T,C or G
cctggcaaggtcataacaacacccaaaacatgtctctgaatacattgccaaanaaagagcttcaaatagagtcactgtgcctaactcccatctctgggcattttactcttcatcgaggggagtggtaccaatgttttgctgttgttgtaatggctgctgctgtttctttagttcttattcttctcagtttatttactgtctatagtttttacaaaaaacaaactcaaaataaatctgcaggaaggcttatt

SEQ ID NO: 17644 - DNA, 320 bp, Homo sapiens
ccctgccgagggtcttcctctgttattcagtgatgtgatcatagctcactgcagcctggaactactggcctcaagcgctcctcccacatcaggtctcccaaaggctgggatgacaggcatgaaccaccacaccccacttaaaatattttcaagactttctctaactgtttattgatgaaagggatcccgaactagaccccaagaggggattcttggatctctcgcaagaaaaaattcaaggcaaatccagagtaaggtgaaaagcaagtttattagagaagtgaagaaataaaagaatggctacccgaaaaaaaaaaaaa

SEQ ID NO: 17645 - DNA, 414 bp, Homo sapiens
gctggccgctaccactccatattttacagccatcttcgacatgaacacggatgtaatcatactctcacaattcatgtactacaggttaaagaatcagaagaaaaaatgatattccaacctcagttattcaaagactccatcaccagagagaaagtcagattgtcactttggggagtcctctgccctattagaacttttcagacaagtggcacctgcaagtgtcttcgagcaaggcctcaacctccagcacagctcttgccacctgcaaacaccagggaagagcaagattgagttacatggcttgaaagaagagtgaaacacctcgcaaggcccagagaaaactccacatccatttgcagctaattttaaagcccaaataaaagcacaatctttggaatcacaaaaaaaaaaaaa

SEQ ID NO: 17646 - DNA, 688 bp, Homo sapiens
  misc_feature (1)...(688): n = A,T,C or G
cctcgcgngntaggngatttcacttctttgttgcccagnctggnatgcagtggtgtgatcttggctcactgcaacctccgcctcctggattcaggcgattctcctgcctcagcctcccgagcggctgggattgtaggcatgtgctaccacgcctggctaatttttttgtatttttagtagagatgaggtttctccatgttggtcaggctggtctcgaactcctgacctcaggtgaaccgcctgccttggcttcccaaagtggtgggattataggcataagccactgcgcccagcccgtgataaagtttttttattttcagtgtttctcttgtatgcaacatattgctgaaccttaaggaagaaactcaacccaggaacgtttgtcttttaagaagtgtgtttactttacccatctttattacaattactataatattaggacttattctgccatttaattttatatttttcatgtactgtgccttctttgttgtttctttccccacctttgttactttccattacatagagccaacattcttctcatgttttgaaaactatacattctattttcttgttaatgtagttgctttaatttgactttatgctacttcattgaataatttttaattatttatattcttcctaataataaagttcctttcacaccctccgaaaaaaaaaaaaa

SEQ ID NO: 17647 - DNA, 282 bp, Homo sapiens
  misc_feature (1)...(282): n = A,T,C or G
gccggggggcgcaggggagagaagttagtcttaggaaaagcctcngtttagaaacncagtttgtggccctnggctntncacaagcgnngatntcaacatgactatctgcccttcctagaagaaattctaaggagaaaagctttccatcatgattgtgaggcctccccagccacgtgaaattcctacgcaatgtgaagacaagagcaagacctttatgaggatccacttctacttattaaataacaaataaattatctctttcttatgatcttcttagggggg

SEQ ID NO: 17648 - DNA, 1312 bp, Homo sapiens
  misc_feature (1)...(1312): n = A,T,C or G
cggttaggagcgaaagaaaagatataaagtctttttggaaaggggcgcctgccgctctccancaccccccaaattttctggaaggggcggagggnnnccggccaacggaagaggcggcgccgcgcgngggcgagggggcgccccgcccccgncccccccgcggagcgggcggagcggcgggcgcggggcgggcgccgcgcggagcgcgccccggcgccaggggcggggcgcggcccccgcacccccccacccggcccagacaccccgcggccccgcccggccccccgcccncccgcgcggacgcccaaccaccgcggcacccccgccccggccgcgggggccgggggcggcggcgggggcgccggaccccgggcccggagacccaagccccgcgacgcccccgcccccggcaccggaccgcccagaaacgaacccccccgcccaccgagggccccacccccgagccccccccccccccggctcgctgtcccagcgcccgcggcgccacacccacgcgcgcccgccaaccgagccccgggcggaacccgcagccccaacccgaaccgccaccgggccccccccgcggcaaancggcaggccgcacgcacccgccggggcccgacgccgccccagggaacagccccagacccccccacccgcgcgcaccagagagaacgcgaccacaatcccgcacctaacacccacgaaaacccacgccaccccatcgcgccccgccacgcgccagcagaggccgcccgcgcgcgaccccccgcgccgctaggcggcagacacccaacacccgcgcgcncccagcccgtcggagtagacaggaatccggatagagacgccccgacgggaggagcccgcgcgcccccgtcgcggccggacgggaatactaatacagcagcggcctacgaagggagcgccacacacggcagagcaccacagcaaaagataagaaagcgcgcccgcgaagggcgcgcgacggggcagcgccggacacgcgcccctcgccgcgcctgaggggcaacagcgacgccatcgccgaccaacacgagtaccggcaaacagccacgcacaatgaccagaggntaatgacagacaaacggacgatcgcgacccaaggcggcgcacacccccagagatagcgcgccacaggcaccgcgcgccacagccacgagagtcgaacgcccccgaggcgcacggagcaggacagaccacgactcgcgcgataggagcgactcgggctcgcgcgcgaancagaagcggcctacacaccaccangccaagacaacaatgcagcacagcacgg

SEQ ID NO: 17649 - DNA, 356 bp, Homo sapiens
  misc_feature (1)...(356): n = A,T,C or G
ttggccaggaacttccatactgtgttngaanagnatggtgagnatgggcatcattgtcttgttccagtttgcagacggaatgctttcaacttttccccactcagtgttatgttggccatgggtttgtcacaataaaataatgcttttagtacattgaggtatgtcccttaaatgccaattttgctgaaagttttaatcctaaagggatgctggattttgtcaaatgccttttctgcatctattgagatgatcatgtgatttttgtttttaattctgtttatgtagtgtatcatatttattgacttgtgtatattaaaccatccctgcaagtgatatgaaacccaaaaaaaaaaaaa

SEQ ID NO: 17650 - DNA, 947 bp, Homo sapiens
  misc_feature (1)...(947): n = A,T,C or G
gccctgcgcgntaggaacctagtntctnanganagagccctnanagnatggtggnaccagnatgtgcaaggagcctgggtctctgagccaccatgtggaggagaaccacttatcaaccaggtgcagacaagaggaatggtcacctgccctatcaccaagattcaagttgaacacacgacctggtcttctgtctaccaccaggagcctgcagctcctgctcaagttggctttaggattcaaataagaaagtctacctttgccagaaagcagggacgatgcatccttcttcaaggccagccccaagcagactctttagacctgaggtcaaactgtaaaatgaacaattatctttcctgctagacaggctccccctgaagtcctgccctaccctaatctctgagcatctcacctgccctggacacactgctttggtagaaggagtacctcattgttatcaacacccaccagacagcactgcaatctagttttccattcatttcagcctactctccatatctgtcccattgaggtagacttatttctgttctaatgaaattgattcagaaatgaatttttaaaatcctggggggattaataacttatttctcttgaacaaagttctaatctcagtttttatttatctgtgtgaaacaataattggcatacagatctgttgaactgcttaaaacaaaaatanccctcccccccattttactcgttcccgaaataacgaacccccgcattgatgtcttatagtaaaaatattgtacgttttcacataatggaagaaatataaagaatgcttttgtgcgctctagggggggcttgggccccgttcttttgtgggggtgaattttagactctctttataatcatgcncccagttctcttgtcggggcgggttttctttctccagggtgaatggtttcctaaaaataaggaaacga

SEQ ID NO: 17651 - DNA, 275 bp, Homo sapiens
  misc_feature (1)...(275): n = A,T,C or G
gtaacttggttnnnaaaacnncgcactcgtgtgaanangagccaccatgacatctttatgacattaagttttaaccattaaaataacatttttctcttttgatttagattttctgcattataatttaataatgttttataattatctccacacaggatttgaacacattttgctactgacttctccttcccttagatactcctgtagtaaatgttatcctttattgtggtattttctaacttaaataaatgtattgaaattcaaaaaaaaaaaaa

SEQ ID NO: 17652 - DNA, 586 bp, Homo sapiens
acttagcgagggtgcttcgctgcttgttcgcgcaggctgatgcagcggtgccatcttgtctcattgcaacctctggctcctaggatcaaaagatcctcttatctcagccccccagtagcggggactacaggcacatgccaccacaccccactaatttgtgtgtattttctagagatggggtttagccatgttgcccaaactggtctggaactcctgagctcaagcaatccaccctccttggactcccgaagtgcgggattaaacgcatgagccacaaagcctggccctgtagtaattttattcatcctctcattttgctctgcatttcacacaaagccacgcccacaaaacacaaacagacagttccacatccctctcccaaccccacatgtaaattaagataacaaagctttgttgttgaaaatcactgtctagaattacacagaaatgattctgcttctgtctggatccctgagcagtctgtcactggaaaatccatacagtttatatcattagcaaaaatgaattagttcacattcagttttgaaattctaataaatctatgcaataatcaaaaaaaaaaaaa

SEQ ID NO: 17653 - DNA, 1542 bp, Homo sapiens
  misc_feature (1)...(1542): n = A,T,C or G
ggatggaggggctcgtttgggcgcngancngctagagtctttaggnnnnggnggttttgtattgatgncnctggaaaattcagcaaccancancacatttgggaatttacatgccataatagaaacacacctaacttgaatgggnatagtgaaagcaagttggctctcacaaatcaaatgcctgtagttggaaaggctacttggnaattcacatttttgnaaatggcaatgtgaaaactaaatgttgcaattcttataggcgacctggtctttagcacggctccctgtgcnnttgcacttgtgtctcacagcgattgcacccccacgactacaagctcgatagtaaccaccctagcacatgcagcgtactcncactgccctcggtcactgatcacgctgtntccacagctcgcgttgtacgatttgtcgtctgggagtgtcccctcccccgcgttgtgtacgttatgcgggtgaaatctagcgntgtcgctgcctctgtctctcccgtgtttcgcctcattccgtgatgcgcgcccctctcccttgtcatcctgttcctccgcgccntctgacctcgggtgctctcgcatttccccgctttctgtttcccccatgtatcgtctcccctccccttatccttgtctccacctgtgcccacatggtggcggtgttctcgctgtcgcccgcgcctcgcgctgtgctctctatcgccccctcgttcgtctccgcttattcacccgccgcacgcggtttgctctctgtcttcacctttctgccgcgctcatatacttcttgtccacacgttttgccgcacgcgtcgctctgncatccgcacttaccggcgcgacgcgtgtctccgtcgcgcctaccttctctccactgcgctctcacttctcttctccgcgtcctctccgctgctccgtccccccacttcgtatttgccntacgcggtactatgctgcccgaccgctccgtntgatcccgtctcgccaccacgctaccctatcatgatgcgcggcgctcttgtncgctgctctgccgtctacctntcctgtcagccccatcgcccgcttgatccactctctctttgtttcagtctcacttctcacgctcgccgctcgcaatactggctctcatatgncnctcgcacacgatatcatngccgaaccacgcgacctcacgcngngacgctcgannccnatactcgtgttcgncncacctctacacacctctctcacttgcgttganctgtctgcagncttgtctcactatctctctgtctcactgactncttcgtgtctctgtgaganntcgacgcgatgacgccgcaagtcgacacgcgcgctnatcatcgccgatgcagaagcnaatatcgtggtcaatctggatgcgcatcgcgtcgtcacgcaccatagtgcgtcgtcgtacgaatcncntccccgccgcacgcgnttgcgtgttcattgattgtcncgtatgtattcagtanctttgtgtggtcacctacgcgcactctatgagagagagatactacacacatat

SEQ ID NO: 17654 - DNA, 287 bp, Homo sapiens
  misc_feature (1)...(287): n = A,T,C or G
actaaggggctgcatctgattttaaaacaaaacatatggcatgagagaanagggacaagagtcaaatagctgaaaatataaaatgctaaaagtgtaacaaaactgatttcaaccaagcacttgatctcaaccaaacaaaaatgtatgcacaaaagaaatatgtcaaaataatacaatttatgctctaatattgagattatggatctttttgatttgttgtacttgtatgcattttctaaattttctacaattaataagcattacctttaacaacaaaaaaaaaaaaa

SEQ ID NO: 17655 - DNA, 394 bp, Homo sapiens
  misc_feature (1)...(394): n = A,T,C or G
tttggcccaggtcggtncattgtgcagacctctgtagcccaagctaaaccatcatatcaccctgggtaccatgcacctacactccacaggccggttcctgccttaactgatgacattccaccacaaaagaagtgataacggcctgttcctgccttaactgatggcatcaccttgagaaatgccctctactggctcatactgaataaaaagctcccctactgatcaccttgagacccccactgccgcccgaaaaagaacaacccccctttttcctttgcctacccaaatactataaaatggccccacccctatatgccttaaatgactccttttaggactcagcccgcctgctcccaagtgaaataaacaactttattgctgaaaaaaaaaaaaa

SEQ ID NO: 17656 - DNA, 328 bp, Homo sapiens
  misc_feature (1)...(328): n = A,T,C or G
ttttgcggaancaactgncagnagtacggnaaacaagnccaancatcattcctcatgcctggnaanagaatctcagttgtatggaaataatcagccaatatgaccacccacttctggaagagcatctctaagacagagggggtactgtgtctcttcactttccatacatagttctcaatgtgtatttttttaattgattactttttccccttgaaggatttcctaaaatctatttaattttacctgacctatgtcccagaaattgtcttttttcctactgtaattgccatttaaagtaataaaaaatacttggggaaaaaaaaaaaaa

SEQ ID NO: 17657 - DNA, 946 bp, Homo sapiens
  misc_feature (1)...(946): n = A,T,C or G
cacttgggaggacanacgatggtttgcatacagcatgtctgcttttacctataattgtgcgtagactgtacaggtatgtagtctgcacactcctacaagagtaatggatgctggggatatgcacgctgcctaaaactgaatgtgctattagagaggaaccatatttatgactcaatactgatgcctcagatggaacaactaggagagaacactggagtacaacatacaagctatgggaaatacctgacacacagaaggcgatatgggttggctctgcggtcccacccaaacctgatttcgaactataaactcacacgtcgggggaggggcccagtgagaggtgactggatcacggacgtggacatcctaccttgcacttattgagattgtgaattctcgcagaatgaagagagaggaaactggcccttttaggtctctatctgcggagctctgatgagaatatcctcttgcgtgggcttatctttgctccatgattattagactcctgaggtctcccagtcatgctgccgtgagagcctgaggaacatgtgagagtagtaaaccggttatcctcatgactgagggataacgcaagatggaccttgtggcctcatgggcggagctgggcaggcacctccctagagggagggtgatggcatgatcctatatgcctgaccccctgaactaggatcgttaggatgcggcctgcagtatcaggtgactcaaacgcgggcgaccgggtagacaccagatgattggcgctcggcagcgtaataaatgggtctactaggccggccctggccatgaacggtaccaggccgcttgcttgctttgtaaactaggctccttcccctgactaccctccagaaatgcagctacgtggagggtggcgatcccgccgggcttgtagatacagcgcgtccccctgagcttctcctacctgaaa

SEQ ID NO: 17658 - DNA, 551 bp, Homo sapiens
  misc_feature (1)...(551): n = A,T,C or G
agcttgcggagtgaaaactttatttgaaaactacatgnanaacagncttattggaagaaagccttttttttattacatcctcttaacaaccaagctagtaatctaactcaagttggcaatatggcccgctaaaagtccttgggggacatgcactaatgggcagatgagagtgacttgttgacaccttcattgttttcatcctacactggacatcagtcgtttggcccatttttcagagacccacttgaactgtctgaacctatgaacttcccgaaagtctggccaccaaactgcattaggagagtcatggctgcacaaccgaagggcattcattttattccctgccttggtgcaagagtctccccaaaccaagatggacacatgtacttcctttcaagaggccacaaacaagaacatttcattccattctgagataatgatcctaattggttaaaatcacttcagaatttgcttgtcttcttattagtacagagaccagagtggagctttattaagaaaaatgtgattttgataccccaaaaaaaaaaaaa

SEQ ID NO: 17659 - DNA, 1368 bp, Homo sapiens
  misc_feature (1)...(1368): n = A,T,C or G
aggcgcacgacangctttgaggtattaggaaaaagttccccnctgcnntagtgattgcccgncctgngnacggcaggctgctgaccgatncctgttttgtgctaaccttgtgggtggcactgtatagtcagaacgcagttgcgaggcccgaatttggacctgcttcttgagctgtgaagtaaatgcttaacttgtctaaaagtgaaagaattggtttgaagaagagttgaaactctggtgagtgggggcatttccaatgcgggcagcgtgttttgctttgtcctccgtgtacactcgtttctccgtcttggggcaccatgttccatccgcttttgtactcttctgtcgtccctccgtctgcttgtgccgctggttcctcgctcgcccancccgctgtgcttctcctgctgcccgtcctgctttgcgcgctcccttgtccgtccctttgtgtcgttgccgtcgcgtgccgtcgtgcgcgccctcttgtggctgcctcggtttgcgcgtccctgtgctcccgcctccctgcctttttgtccctgcctcccccntcgccccccgtggtgtgcgccgcgcccgggccgctgtgttctgtgtcctggtgtccctcnttttcngccgcttcgnctcgtgcgcgntttgccggcgcgctctttcgcgcccgcttttgccgttcttttcgtgtccccgctcctcttttcccggtggtgcggccgctctccgcctccgcgtcccctttcctgcccgcctgttctgccgccgagtgcgcgcgcgtcgctccccgttgcgtgtgccgcgtccgctctgcgcctcgtngcgctngtgcgtgcgcgcgcctgcgtcctcgtccttgtcgtctctctcccttcnccgtgtctcttccgcttctctcgctacgctgcccccctcttgtttcgtcgcgtcgcttcgtgttccgcgtcgcccgttcccccgctntgtncgccctttgtcgccgtgccctgcgcgccgctgcgccttgcggactnnccgctcctcccttctctctcgcctctntctcgcccgntctccccattgcgtccccntttctcgctgttgctctctctctcttnttgtttcgcgtctgtgcgtcctcgcgctcttctctngtcgcgccgccngtccctgcgcctcggcgcgtgnctgcgtctccggcgcccgcgtctcccggccgcgcctcgctcgcgtgtgtctctgcgcgtctgcgttgcgtctgggtgtccnctcctctgtgtntcccgctngcgctggtgctgcttcgctctttcgctctctgttgcgccngccgcgatctctgtctcccatancgtagacnacacnacacacatatatatagtcgaacacacacac

SEQ ID NO: 17660 - DNA, 201 bp, Homo sapiens
  misc_feature (1)...(201): n = A,T,C or G
actcctacgannagatatactgtctgttncacacggnaaagatagcccactacactgccattggtcaacttttcatggggacatttgttaatccaatggtgcttctgctggagacatggagatgaacccactaggcactgaggagaatgcagtgtctcttccctgcacaggactttaacttaatatgtatgctgggactgg

SEQ ID NO: 17661 - DNA, 447 bp, Homo sapiens
ctttcgaaaacaagtcccccagttgcccagctggtctcgaactcctgagctcagtgatcctgctgccttggcctcccaaatgttaggattacaagcatgagccaccacacctggcctgatttttcttaactgtacatcttgcagttgtggtctttaaatgctccaagcgcacttttttctactttgtaatgaagtaagagtgcttacagttggtctatggagcattttggtctcagatccctctttacaaccttaaaaactgaggacttcaaggagctgttatttatgtgggttgcatctatcaatgtttatttgaaatataaagtgcaaagctttaaaattattaattggtttcacaataacccattattatgtgttaacaaactgcaactttataagctatattttccaaaataaaaatttctgagaacagcaaaaaaaaaaaaa

SEQ ID NO: 17662 - DNA, 156 bp, Homo sapiens
agacctacgattagaagcatgggtccctttggctggctgctctatgaagctgtccttcgtgcataagaactagtctaagctcccaaagactggatgctaatccctgtcctgatactaactcaccctgggacattaaacaggtcaaaaaaaaaaaaa

SEQ ID NO: 17663 - DNA, 395 bp, Homo sapiens
  misc_feature (1)...(395): n = A,T,C or G
ttttgngcaggaagncatnncanacaagactaagtgatggagacacaacacaagcagtcagaacgattatagaaagcaataatagtaaggcccacggncactgagatcgncttacactctcgctgccaattcctcagctactggcgtgtggagagcgcgatgctggagctgacatgcgactctgagccccataagtctgcaagaccagcattgggcacacctggggtaaccccatgaatacaatatataatacttagcctgtggtcccgctacttgagaggtcgagcaagtagattgctatgacttggaaggatgttgctgattggatccaagatggatccatctcactttattctgggcgacagagcatgaccctgtgtctaaaaaaaaaaaaa

SEQ ID NO: 17664 - DNA, 339 bp, Homo sapiens
  misc_feature (1)...(339): n = A,T,C or G
cctgggccngctnnccccaacangaggnattaccacagnattgccagtcatcatcacgtttcatcaacacgtttgaagaacagttaacattcaagatttaacacatgactattttccagagtgtgaccatggggatttaccaggaatggagcttggaaggctggaagttgctctggatgagacagtgagtgagtgagatctgtggaactttgaacttgagagagacgatttatggtatctggtcgaataattttctaaacagcaaagatttcaagaggtgacagaacataagagcttgaaaaatttgcagccagatgatatgatagaaaaaaaaaaaaa

SEQ ID NO: 17665 - DNA, 311 bp, Homo sapiens
  misc_feature (1)...(311): n = A,T,C or G
ctttggcgaacttagctaggtagcctgctgttgnataaaacacttgnaactcctgctgtttaaattgctacattctgttctgaggagtgaaataatgttctgccatttgctcccaggggcccctcaaagtgagtggctgggtctcagtaagatgtgagtattcctggataccctgttgtgtcttgaccagacttcttaggataacagtgttccctcattaaaacctcagtgtgtctccctctggaaaactatgtgtaattatgttagattgatgagttataaataaaatcacaacaacaaaaaaaaaaaaa

SEQ ID NO: 17666 - DNA, 394 bp, Homo sapiens
  misc_feature (1)...(394): n = A,T,C or G
ctttccgagttatctgtcatgctgacaatcatttattggnanaactgcaagtattgaccgtgaagagctgcaaatttggagccccttatgctgaaataggatcacattcccatgagcagccaacgctgtctgtgaatacacctggatccgcatcactttgaatggattattatccacactgcagagaagaaacaacagtgtgggactgatcaaatctttgttttctctctaattggatatagaagctgtactcgttctcactcctttgaaatataatggcctagatttcctggaaacttgtgtgaaacaatggaaatcaagaaggttaaaggcctgtgacaagaaggacttgagtgtgtgaacaattatttatggaaaaataaaaaaaaaaaaa

SEQ ID NO: 17667 - DNA, 383 bp, Homo sapiens
  misc_feature (1)...(383): n = A,T,C or G
ttttgggtaagctagaaccccacantcggcgcaacgnatttaaaactnctttttgcgcagtaggcaatgactccatgaagnatttctcatgcatggtagcccagnactaggatggacccaaatctccagcactcccagctcttctgtaaaccccatcctgattctctgagtctctgaatcttttatcctcattttcttcccaactgtccataatgtagaatttaaataaaagattaaatgtaatctttataacattattatattattgaacagtttcaggtttcttgttcttatttacaaaaaactaataagtagaaattttatacttctctgagcataaaactatacaaaataaaaattatataaaattaaaaaaaaaaaaa

SEQ ID NO: 17668 - DNA, 881 bp, Homo sapiens
  misc_feature (1)...(881): n = A,T,C or G
ggtccgacgcgtgcccacctttctttcagtctctggccaatgcaatgtgagcagaagtgaagaggcaactttcagctgtagagaagatgctgctccagtttgatccaatacagtatttggaatgcatggaaaagatcactgatgcctttacctgatgccttacctctgaaggatatttctccacataatcggccctcggttttgtgctgaatgcagctgttgaaggaagcagctctctgtattacttgctgattatcctgccaacaggaatttgagtgtgcggaaatggcatcaaattctttccactgggaaagtgctagcaacaaacaagaggttaaatagctttttgaaagcacagcaatttgggtgtgaatatccattctgaggtgggatgaattagttcctgataagtattggctgcttatttgaactggttgaggaaaagaaacatggctttaaaaagctcttcaatacaaaatatcctcaattntaaaaaaaananaaanaaaaaanaaaacaaaacaaaaaacaccacaaacacaaaaaacaacacaaccaaaacancaaaaacccanacccacccnnnncccncatcncccnaacacccnacccacccccncacgcataaaacccaacccccccccccccncccccccacccccannnncccctccgnaccccccgaaccccncccgcatcnncnccntcccccatttcccccccccacgccgcttcacacgncggccgggaccaaaccagcgacaaaaaaacgcagaaaatccgtaggctagacctcactcccggaggcccgcccgccccctacgaccgcccccgaccaacccccnttcgccccccttatccccatcctataccaaacacca

SEQ ID NO: 17669 - DNA, 504 bp, Homo sapiens
  misc_feature (1)...(504): n = A,T,C or G
ggttggaggtaggnaaaaagctttttcccagnagaacacaataataacttattcgaccagaaaggtaagactggccactctgaatcaacgagcaaagaaaggagttgctgtgctgactggggtgattgtccctgactactaaaggaaaaattggacagctatgatggctactctacaatggaggatgaaaatgttgataaagtaccctttgtgcttgcctgggaacacaaatatcttcttgtcccttgatcctaagaaatggatgaagaaactccagggtgaatgcatagaaactatttattcatgtcaacttcaaagatgatgactcctgaagaattatgattctgtctatagatgcaatggtatactcacttgttggctgtaacctctgaaagctggtatttatatccagagaatcactgaggttgattnttggcaagactacatcataggaggtattatatatttccatcataaaatatanaatgccttgttatttccttt

SEQ ID NO: 17670 - DNA, 524 bp, Homo sapiens
  misc_feature (1)...(524): n = A,T,C or G
actccgggacagtgtcctagtagtcaggtactactcagtttcatatctgctgtcaggaggtcggcatgagcagctcnctccttgagcaagaactacaggcaagcctggtgggcacacagctgtggtcctagctacttggaaggctgaggccagaggatcatgaagttacagtgaactgtgatcgcaccactgcactccaacctgggcaaaagggtaagaccctgtctctaaanaagaagagagagagaaatagagatagaaaaaaaaggaaggaaagaagaaaggaaggttggatgctcagcaggggcctactttattttctcttttattaatttttaattaatttttgaatagatatatatttaatgaatctacattttttaaaaatagaaaaaagaaatgcagataagtntctttttcttgcctggttcctaactatcccctttccttcccctaagcaaaaaaaggttaatttcttgggctccctgccaaaaaggttttcttcccaaccaaaaaaaaaaaaa

SEQ ID NO: 17671 - DNA, 473 bp, Homo sapiens
  misc_feature (1)...(473): n = A,T,C or G
acatctggtggaactgcccgttgggccacttcgcaccaaagtatgaagaagcagcctgggatcatcattgaaaagtactatacctgctgggcaactacttccacatgagcaaaggcatgtgcgaggaagttgccattattcccaacaagaagctccacaacaagatggcaggctatgtcacacatctgatgaaagagatttagagaggtccagtgagggttatctccatcgagttgcaggaggagggcagagaaaggagagataattatgtttccgaattatcacaactctggatcaggagatcattgaagagggtctggacactgaggaaatgctgagggttttggactttggcagtctgccgaaactgcaagtcaatcagcctacagttaggatgaattttaaaataccacgtggagctgtttgaatctttttgctatggtgcaatatttttaataaacctgggacancng

SEQ ID NO: 17672 - DNA, 291 bp, Homo sapiens
  misc_feature (1)...(291): n = A,T,C or G
gctccgagtgctaccctgcctgcttgaccctgttngactaacagtagctccaaacctagcaccanacagttgcagtggacccacagccttctgcagacgtctccatcagctcctcctctgcagcccctttacaacctcttgagtgtgcttggctgctaggattgacttcttcagtgactccatcgatccctgcctccctccaagttcctagtggcacttccccagctgcacccacaactctattagtttgaattcctataataaattccttatgcattaaaaaaaaaaaaa

SEQ ID NO: 17673 - DNA, 364 bp, Homo sapiens
  misc_feature (1)...(364): n = A,T,C or G
cgctgcnggnnnacaagaaccccaatttgcgtggnanaacccaataacatgnaaccaaactgaagcaagtaagttaatcaactgatccaggnagacctgtggtttaagcccaaggaccaactcaagacagaaccaagaagtctattacgatctcagccatcaattactaggctgctgaagaaataccgggagactggaccagatgcccaagtcactgtgcagcagccttagggaatacttgtaagacttctagacataattacagagtaatgataggtgcctaaattaatcaagatctctcgtggtcctcagaactttgaattgcttctgttgatacgaataaatatataaataacaaagaaac

SEQ ID NO: 17674 - DNA, 924 bp, Homo sapiens
  misc_feature (1)...(924): n = A,T,C or G
ggcgcgcccccccgggcacgccccgatttgttttggccggcagttcgataanaaggcgcatgtatgcaagcanaaacaggggtgaggtttctgggaaattagcgaaggggctggcttcatgttcatcacacccttgttgcctttgcccgcttcctgtacttcctgcttggaactggaggtccagcacccatcttggatcacaacgtctaaggctgacagctaagggcaccgccccatcttggtaaggctggcatgatgcctccagggtttcctgtgcatgggctatggatcatttattcctcgtttaagcaaagaggcgcgccctcagctctcctaatcacacacctgaaccaccctcagcaacatccttcccctacccgaagagcaacaaactaacccctcttgtcggaattacccacacggacccttgcccacctttacctttactcagggcacacaacgaacaacataaccatcttaatagccgccttcgggcgctttccctgcgcccatcgccatctatcccttcaaagtcgccactcccttcctcgtcatacttctttgatacattctctacccctcttcgcaccgtacagacaacattccgacgcccgatcctcgcttcccgatcacctcctttatgcacaacgccatacatcaagatccccttccaacccccacatagattttgcaccaccaatcctactgccaccgcacgatccaacaatccccttttcagcctacgcaggccgtatgccccgacgagtacataccaccccaacgnccctcccctttcatttctacgcgcaatcccaacctacacatgcgttcaccctcgcctcatccaatcccctcccctgcgccatacccattacgccgactatccgctcaaccctcgttgcaagtnaccgtcccccacccacc

SEQ ID NO: 17675 - DNA, 905 bp, Homo sapiens
  misc_feature (1)...(905): n = A,T,C or G
gcgcgaggggcgcccgccctgggccccgacccgcttcgtcttttganggnngttttcggtgcctaccacccactgtgatgcaaccaagacagcatggaccacatgtatacaggtttggcaccaaattcatcctggaagcccaacaacaacctgtctgtattctgcctcaggctcacgaccgctcaaaacacatccaccttaaccgccactactaactactagccagctgggccacagagcccgggacataccaccacggatgcaccagaacagtctatgccttcctggagacggttcaatcatgggcagactgaagccccctgttcacaccctatagaccggatgcaaactccaacctaggcccgaagaaggccttccttcctggccagcgatctcctcagtacctcattgggctgacccatggaatgtgttcagtgcagccctcaccacacaccctgaggagcagatcatacctcaggctcccggatcagactgggccctggatctgaccaccggaagcacagcaggggaccctcaggcaaacccaggacccagggcccgaccaggaagctcttcaggggtcggggagtaaccatgaccaggtacttgatagctgttccaaacaggggtcaggcagcgtgggagagcaggagccagaaccagttcacatccaactttaagaatctaacgctgttgtacctggaacaaggaactcaccctctatgggacttagttcccttcgccaaactgggataatagaccgtttacctgcctcagtactggggaggattaaaaaagtgacaaccccaagaagaaaaaataaaaagacctcattcggcctcaagcgggggagctattccgcccgggttccctttagagagggggtaatttctgcaccctccatc

SEQ ID NO: 17676 - DNA, 1206 bp, Homo sapiens
  misc_feature (1)...(1206): n = A,T,C or G
agcccagcgcggccgcccccccccccgtggcccccgaccacggtttcggttctttttggccagggntggtgnntgttggannncaggcggattttttggggggnnnnnaaaaaaaaccgnnaaacnnnncnccngnnnccncngncncgggggagaaccnaaaggaccacgggggggacagnggggaggcgggnggggagaanagaaaagggggggnaggcaccangggaggaggggggaggagggagaggggcgccccgaagcaagaccccacagggaaagaagggaaggagagagggggaggaggcggagaaaggcaagcgaccgccgggagaggagggaggcagaaggganaagggggggggaagagaaaggcgacacgagggaggggagcaacagggggggacaaggaaggggcgaggcggaagggagaaacggacgacccggcaacggaagagcacaggaacggacgccgggangggagcgcgaacaaggcggagggcgccgacgagccgcgggggaggggagcaaggagcggacggnaaaagcaggaagccccagaacacgcggaaacgacccccncaggcgcccgcaccgcgccccggaggaccaagaagagaaagagcagcagcaagacaacgcaaaggcgagccgaggagcagggcccgacagcgccccaagcgccagggagcccggggcgccggngccggcgagcggagggaggagaccagagccagagaggagggaggcgcgagaggggacgccccaaagcagangcagagagagaagcagaagcgaaagagaaagcgagagcggagaaaaccccacgaggagaagacanccaaacgccaggaacaaccgagagaacaccgnagccgcgcccacccgcgagagaccgctgacccgaggcctatccagaccagtccaccacccgacatccggtccgaatccaccataatccagcacaatcgaacaggcctaaagtacgccgccacgcaaagcgttaccacgcggccatatcgaaccctgacccatatccaaccaaccacaccccgagtataaccaggacgaagcacagtcagtgccacccaatacaccagacgcgagatcccgtttactcctaggcccggagtggccactactacgcaaccattaaccgccatccccgtacgcataccatacgcatcgtaaccaacaacacaccag

SEQ ID NO: 17677 - DNA, 315 bp, Homo sapiens
  misc_feature (1)...(315): n = A,T,C or G
ggttctggtnttctattaccgggtggnaacaccactattacagccacccaccccactgttaagtgggttgatgcagctgggcttcgatgagggcatgtactggaatcagacacccagcatcatcattcaccaggggaatgttcctcagtgaaggaagtatattttgggaacctcacattcctcatttagaaacttatacacataagagaatgtctgtgaacctcagattcctaatctgtagaatgggaatgataacacctgttttgcagggctggtgttgggattaaagagataactacgtgaaaaaaaaaaaaa

SEQ ID NO: 17678 - DNA, 539 bp, Homo sapiens
  misc_feature (1)...(539): n = A,T,C or G
ttttcgaggagnanaactcagtaaactccanagagctgcttccanatttattggagaagcgggtctgtgaggactagagatggactgtggaagccataggaatgcagcactcaggtcttgcttcaagaaagaacctgctggaaggattgcagttagcagacggcctccagattcggtatctttgagatcgaccgcagtgttcatgctagggcagcattctccctaagctgttcccagccaatgatagtttggcagaagtactagagccaagccgtttctggccagcatggacaactttgtgggcaagctttgtgctgggaccccagttgggcttgacaagatgttctcagaaccgctctacagcctgaagctcttcctacccagccctcctttcttctccctctcctttcagagacatcaaagctacaatgcagtctgaaggctcttgctgaccactgctgctccctttcccccttatctttcaaggccaggaaatccaataaatctctggtggttttaatgccaaaaaaaaaagaaaa

SEQ ID NO: 17679 - DNA, 212 bp, Homo sapiens
  misc_feature (1)...(212): n = A,T,C or G
ttttgcangncnnctggtcgcctgttgccatcctctgnatgtccagtgactgcactccaggaatccggatattagaaaagagctgattggactgatttccactaaaatgtgactgtcattttgtttactctcccaggagtatctgtcttttaagagcaaatggaaaaaagagaaactgttgttaatgtttggtaaaaagaaaaaaaaaaaaa

SEQ ID NO: 17680 - DNA, 376 bp, Homo sapiens
ggtcggagggcaatcaccagtgtagaacactatacatgagtgtgatttcacaactgactcaggctgagtgtcctaagctacagtagcccctttgtggcatgaataaaccaacgtcagaaaatgtttgatcttgcatgccagcacaaaccaatggcggtggatggatgaatcactgggttaccaaagaaagatatgctgagcttaagtagcattgtctgctctgcagcatggcacgagaaattattgtcacctctgccaaatctttgatagctatttcttatatagaatacatacatatcctactatcactaaaagcatgaacaaattaatgaattactttctgacttgtatcacttgacaataaagtacactctgc

SEQ ID NO: 17681 - DNA, 539 bp, Homo sapiens
  misc_feature (1)...(539): n = A,T,C or G
ttttccgagcctgccacttgggtaaaggnacctccttggnagctgcgttgttttctctggcccggctcctgctaggggcctgatgtgcaccctggatggtggccatgggtggggcatcctgtgctggtgagaacacgctgctgtggagcccggaggccccagaggagggctcggctgggctggctgccccagttaaagagacgtggcccctgggtcccatcctctgaggcggaagtacggctgcttctacttacaggccttatggggagaccttttgtatctggacccaaacagtaagaaagggccacaacacaggtgatttctgcatgctgggggttgagaaatgttttctcagtggcatctgaaaggcgccgctgtatcttctgaatcgtcaaagtcacactctgctttgaaaagcaaccctggccacttgggggttaattatatttgaccacattcaacataatagaataataaatttaccacatccaatatttgtattaaaatgtatgattcactcaaaaccaaaaaaaaaaaaa

SEQ ID NO: 17682 - DNA, 210 bp, Homo sapiens
  misc_feature (1)...(210): n = A,T,C or G
tgtctggtancacttttcgcaggtaaaccananaaaanacatcgananaaaggcacctgnaaaataagacagagattctaacaatgtgnacaagnaaaccaagnaagccaaggaatgccaacagccatcagaagctataggagtcagggaagaatccttccctaaatgtccttcaaaaaatgagaaaataaatttttgttttaaaccaaa

SEQ ID NO: 17683 - DNA, 253 bp, Homo sapiens
  misc_feature (1)...(253): n = A,T,C or G
gtttcgaggtnncttgnactntgctnctccagctatgcaatgctctgacttcaaacaactacaagtacactatataacagagaagaaattggatgagaaatactcaagaagaaccttcattcaaaggctgctccagctttgactctagaactgtgctgcccagcatattaaacagtagctatttaaatttaaatttcttaaaattaaataaaattaaaattccagttctgcagtggcatcaaaaaaaaaaaaa

SEQ ID NO: 17684 - DNA, 438 bp, Homo sapiens
  misc_feature (1)...(438): n = A,T,C or G
cccgggagagcccgcccgggccagaaccgcttccgtcttttgcccgaanngtcgagggatacaaagcgatatttctgcggaacagaaccatccgctacatgtatgagccaccgtaactgcggggcaccgatacataaagcacaccggatgaatataactgggcactgaagcagctggacctcacacaactaacagcaaggagaaaaagcagaaccggatatggaggccattccttttcacacaacgaaagctctttatataaggaattggatcctagcggtgtgacctttacaaatcagccacaactgacctaaagagagggaaaatgaatgaacggtacacactgacattgtgtattctgctgctttgccgtaggaaccgggtcaggccacgaaaaggctgctgtactattcatcacaggattaaggggcaccgcgc

SEQ ID NO: 17685 - DNA, 177 bp, Homo sapiens
  misc_feature (1)...(177): n = A,T,C or G
ccctggcgannatgnaataaaggtaaagttcagcctcagtgtagaacaggagacatttcccaccacggaggaagatgaaaagcaggagaggagaggctggcggctcccaggagcagatcacctgcccccactgcaaggcccccgtgtactcaataaactgacccttgcgcagagaaa

SEQ ID NO: 17686 - DNA, 1481 bp, Homo sapiens
  misc_feature (1)...(1481): n = A,T,C or G
cggccggatgagcggccgttatgagcgccgccccagattataagtttttagagaannggngccttggtctgatgtgcacnaccanncctgtttgagcagcgaaaacttgccaccanatngcattgcgcagggaacagcgacctcaatcaggctccatgcatggctgcgcaaagcaatacagcaactagcaagcagtggcctaagggcaggcaaatggcaggccaccaacaaacacacagtgccagaaagcaagcagtcctcgttcgcgtgaatagatactctgtttcagtatagcgcgtgcctgtgatcgccaaccaaggcagcaagcatcgcacctcgcgggcattgttcacaaagagcaagacgcgctggacaagaacgctccacctcaccaccgccatcgtgacttcctcgctcaacagacgaccagtgntgcacacatcctcgccccgcggtcaccacgcccgcacgcgcaccaccagccacgcgaccccgcgcgcgaccatgcgcctctccttcgcgtcccgccncaccctcgcctcacacccgacgcgttctaccctcccgcctccccaccgcgttcgcacgaacgtcctcccccccctctcacgcacggtgagatcacccctctctccacccccgctcctcgtcgcgcggcgcctaccgctcgcctccgcgtcatccacagctctgcaccacacgcgcacggccacttcgcctacctccgcccacagcccgccgtccactcgccctctcccgtcgcgcgtgctccgccatcccgcgcgcacgtactgcgctcccgcacaccaccatccacgctcatccaccacctcgccgtcgatactgtcgtaccgtcatcacttgcagctaagtgcccgcccgcctcccgcgccgtgaccatcggcccctcactcgctctccacctgcagtctctccgcgccaatggatgcggtgcgtcatggtagtattgcgtccacgcgcccagccgtcgtatcaacacaacacgatacatatcctcagaccgatatactcgttctgccgtcttcatctccaccgttccccactccaccgcacacgcgcgctcgataaacgcggtcgcgtacaacggcatcatctaccacgtcgacccccctcacgcgcgcctcgagtanttactntcaacgcctcgtacatcacctctgtctctctatcacccctctnctacatccaccactccctcatcctatcactacctacanacgtacgactctcactcattgttccgctgtctatctgccgntgctcatattgccncacgccgtcttcgccgcacattatagcccactcttnctcttcgcgtcaccgacacgtatctctcctgctgcccgccacgcgttacgcacgccggcaccgcgtcacgcgatgctcatcgcangcctatggatccctcttctgcgacgactgtcgcgacgatcatgtccacactacctgcacgtcacgat

SEQ ID NO: 17687 - DNA, 254 bp, Homo sapiens
gctccctacgactgctcctgtaaaatattccttttgttttcaagcattccagcaaatctggacttcttccaaaatgaaaataagagaaagagaactgtgccctctgccaagtttcatggacatgaactggtggtcattgcttcaagggaaaaggtgttcgagtataattttcttatcatcttttctagggaagaaatgactaattacctaaaatagtcaataaatattttcttacaaacataaaaaaaaaaaaa

SEQ ID NO: 17688 - DNA, 917 bp, Homo sapiens
  misc_feature (1)...(917): n = A,T,C or G
cctgggcngangaggnnanccactgttagncacagnananactaaggnatgccccagggtcacacagccagcacacagcagagctggaatcggatggggcaggctggccccagcgggtacccttcctggcctgtggtgctgcttcccagcagacacacttgcgtgtctgttgattcatcccctccccgtctccatgatgctaatgccagctgcatggatggaggacctgctaggagccccgcgccccgcagcactttgcaagcatcacacgtcatctggtggaactcccatttgcaggtggagacaactttgatctcaaaggaattcatctcaaacagtgaaaccagaatcccaagaaggatgtgggagggactttccgagaaaacctccccacgttccgaagacagagacctgtcacacagggccaaggaaaaatcatggagctgggagcaggaggcctgggtatgagtaataacagtctaaccaagtatccccatttttctaagaaaaatataatgagttattattttttattatctttctcttttctctgattccccttattccctacttcctacttatccctttagaaatgcaattataaccttttgcctcccctgcacctgaggctcgctacaggccaagtccatctagctatgtgcatagacactccagagtggaactctcacccaccaggaggttgcctcgggagataacagtccatcgacgatccaaaggatgtncgtgacgaaactctctccacctggagaagtttcagctgctttacaacctagtcctgcccatgaaggtgccagcagttaccangtttagcaccgnctggtagataaagcaccaagttagcgcacagaccccccaacctgctcgcttctncctgngtgccgttcatgttaggcccc

SEQ ID NO: 17689 - DNA, 382 bp, Homo sapiens
ctacgacagctgcctctcaaaatttccacccagaattcacaatttcactgccaacttggagttcccagctcatgtttaatttctactaccacagtcaagtctgcaaggaacagtaaagacctggggggagcaatatgtcagtttcctatttacatactttttttcatgccaacttctacattctaacctcaaatgtagtttatatgtataatataactacaacaatcagtgaaaagcaactccatggttaggtaaatgatggtcttcacaaatacctctttacatatcagaataagtctatagtttggaacttcacacaatattgaaaacttattgctatattaaaaaaaaactgatttgttctttttgaaaaaaaaaaaaa

SEQ ID NO: 17690 - DNA, 212 bp, Homo sapiens
  misc_feature (1)...(212): n = A,T,C or G
atcatttgatggnaanncatccctcgcggccanncgcttaagcatgaatgcagtgtcatggctcattcgtagcctcacctcctggggctcaagcgatccacccaccttggcctcccatgggctgggattacaggcgtgagccaccgcacctggcctgtntattggaattttctataaacgtgacaaattgcagtccaatgaaagcttgcgca

SEQ ID NO: 17691 - DNA, 977 bp, Homo sapiens
  misc_feature (1)...(977): n = A,T,C or G
cgccaggaggggccccttaggggccgaacagcttgagctttggaaaggccctggcggtcacacacccaattgtcagctggngaccatgcccatatgcctcttcaaaccacactacccacgttcatagtctccggnacctggggcatcgcatctaggaggaaaggactgaatatcaactgcaagagcctaaattttgggctgatgcagtcagtgattaagagtttagagtcagtgatggggcgaatatgtttcgtgtgtggaaagataaataaaagggatgatgcatgaccagaaaggaggactgtggcagaaacagtctagatgctcaccaatcttatttctactgtttgggcagatggaaactgctatagttcaaagcctctcttggagttagattgcaatcatatgactgagaaatagaatgtgagcgaaactcactggtgtcacttgcaaacttggctgtttaaatgttcttgacaatcattcatgaactcactctactgtcttatgactattgggcatattggtgcgcataatgatggtggcatacatgtgatgcgggataatgaaatcaggggcagaggaatatctatcaagtgaaacgaggatcattacactgggaggggaatgcggaataagtgactagtaagtgtgtggaaactgtgagtggtggagggactggtggggtggctgcggggggagcgaaattgtaggagagtgactgctgtgtgagtggagtgggtgtggcgggacgaaagagtgactgagactggaaaagagtagcagcaaaagggagctgagctgagagcgcttgggaaagatgaggatacaaactagggagcgccttggaccggagttgggtgaggaacaagcgcccgtgtgtgctgctcatccgaacaccgatgacgtgaaaggacggcagtcgggccggggaagggggcggaggggtagggagcgagcaaggagttagcagcggg

SEQ ID NO: 17692 - DNA, 923 bp, Homo sapiens
  misc_feature (1)...(923): n = A,T,C or G
acctaggagnatacacaatgtgtcagnaaaaagcactaagcaaatcaaaagatttcttatttgagtgcaaatgggtcataaagcagcagagacaacctgcaacatcaacaatgcatttggcccaggaactgctaacgaacatacagtgcggtggtgtttcaagaagtttgcaaaggagatgagagccttcaagatgagaagagtagtggctggccatctgaagttgacaacgaccaactaagaccaatcatggaagctgatcctcttacaactacacaagaagttgccgaagaactcaatgtcgaccattctacagttgtttgggatttgaagcaaattggaaaggtgaaaaaactcaattaagtggatgcctcatgagcagagtgaaaattttaaaaatcgcaagttttgaagtgtcatcttctcttattctacacaacaataaagaaccatttcttgatcggattgtgacatgtgacgaaaagtggattttatacagcaactggtgacgaccagctcagtggctggaccaagaagaagttccaaagcacttcccaaagccaaacttgcaccaaaaaaaggtcatggtcactgtttggtggtctgctgccggtctgaaccactacagctttctgaatcccggtgaaacccttacatctgaagagtctggttagccaatgtatgcgatgcantgcctacagccagcactggtcaccaggaagggcccaattctttttacactgtcttgactggcattggccacccatgtttcaaagttgacaactgggctacaattttgcctcttcgccttttcacttgactctggccactgactcccctctttaacgctttgcacacttttgggcggaaatgcttcccacccggcggatgaaaaagctttccatagtttgaaatacaaacaa

SEQ ID NO: 17693 - DNA, 201 bp, Homo sapiens
  misc_feature (1)...(201): n = A,T,C or G
gctgggcgactataacagccccttcagtatgtnctatgtagnactgtatacagtgcgggcttctaccaggctccatctgctaacacaacagtgtgctaagaatgaagagaagttgcctagggaagacaaataagcccttgctctgggaaggaaagtctgagttgtatccacacgaagcaccgagcctcccacaacactgac

SEQ ID NO: 17694 - DNA, 232 bp, Homo sapiens
  misc_feature (1)...(232): n = A,T,C or G
cttgccaacccctgacttttgcaggccgactgagcaggctagaacanaaagtgcaaagtgccctttccccaaacagttagaatgtgtaatgaagatggaaatttccgagacctgaatccccagacccagactgatctctcttctcttcttgaatataaaagtaagctggcaagatttaaaaaactgaacccaaataaatattcatcatttttttcttccaaaaaaaaaaaaa

SEQ ID NO: 17695 - DNA, 309 bp, Homo sapiens
  misc_feature (1)...(309): n = A,T,C or G
ttctcggagtgtacctcgggtaagttgtcgctacgtttactatgggnaaaaactcagnaggcaacaggtcttatccgagatgaccagctctgaagccaacttctgtataccttcacccatttcatgcaaaataaaattaaaagggaaatcaccactgaccaccacgctccccaaacaaacccccccccctccactcccatgacccatcccaccccacccaccctcccccccccttttcccccccccctccacccaacctacccctctcgctcattcgcatctcggctcgcgcgcagccacagaacagca

SEQ ID NO: 17696 - DNA, 949 bp, Homo sapiens
  misc_feature (1)...(949): n = A,T,C or G
gcttgccganaacacactnttatttgntcttatctgttcatgcctatgcaatgcttggcataaaaaaggggagaataaataagaagaaagagtacagagaaggaatcagaaagaaaaggaaagaaggaaatcaaaatagaaaagagaaaggtgggaaagagagacaaaagagaaacattagagagaagaaaagacagtcaaaaaagaaacagcccgaatttttaggagatgcagatgaaatccgttccagacctccaaggaaaattagcctttctctgacacactcctcaaaatccttccagacttgacccactattcaccacggcagcacatcacctccagagtgaagaaaagtttcaaacatcaggaaaaaaaaacagcgcattgcaaaacatattagactgaacctatcgatgacaaaatacaactgtgaaatgttgagactgttcatcaaagctggacataagcaggatccattccattttcaaagaggtagagtgactgtctgaaaaaaacaaaagtaactagaaaattgataaaactgaccgagtcatctatgcagaaagttgcttatatagacccataatataatacatnttgtggtcataaagcacaattttgattttggaattgcaatcatagttcaaggcgagtaacaattttaacctctgtaattattttaaaagctaatgcacatcctttaacaattcagtttgctgaaatggtcacttatgcttttgtatttatacacctcaacatcatctaagtgcaatagattttacatccccagtgatttacctagactgcaacatggttatcanatgacaaccttctagtttcctgaattcatggccattttccttggttgagctgcataaaactatatactgggcagcacttatatcttgatgaatagatgtaaagaggtttgaatacttttctgatattt

SEQ ID NO: 17697 - DNA, 1256 bp, Homo sapiens
  misc_feature (1)...(1256): n = A,T,C or G
ccctcgcgganngatttcacnagtcatccacagcntgggaagnctgtggtcctgcagaaactgcaggaacgctttcggcaagtaacctgcagtcaggtgtgtcccaggctgcatgcagaagaaaatgcagaactgtaagaggcagggtgtgttggactgtgaacatggaggagggaaggaaggaaatggcatggagtgtggacgctgtaggactgtggagtgactgtgcccgtccggcagggatggccgcagcatgcctgtggcgagccggtgggtgggcgcggggcgcctatgagctgctggtggcgcttgcggtgcgggccgtgccccgcccgccgcgtcnctnttgccgtccccgcgcccactgcccttctcccgcctccgtcgagcccatacgttgcccggtgcgcgtggtgcgtgcgcatgcaacccacttctgttgtcctccgcgaccctcctccgcgcctcgtgtcgcgcgcgatccccgcgcgcggccgcgcgcccggtgacgaggcgcggcctgcgcgtcgctggaccctcgcgcccccccccgtctacccgcgctcgcgccgcggcgaccgcctcgcggcgtggcgcacccgccgcggtcagtggccgcgccgcgcgagacggaggcaccccccagtggcgcgcctgacgcttgccgcccctcgccaggccccgccggagccccacttccaccatcccggcaccggatcccggcgccgctccggccgttgtgctcgctcgcgtgctcgggcgtgcccgtcagagcctgctcgcggctggggcacgctgccgcgtcacangccgcccnatatgttcgcgcccgtcgcacggtcgcgggcgacggccgcgcgtcacgattagtgtgtgtatgtggcacgcgctggcggcggcgccggcgggcggagccgcaccggcgatgtgtcaccgcctcgcgctgccgagcgccgtgtgcacctccgccggcgtccgcagacgccgcgcactggtccgtgcctccgcgtgcggcggccgccgcgggcactcgcaccgcgtccacgagttcaccagcccgggccccgcaccgtatggcgcacccacgtagcagacgggcctctgcgcgccatncaccaccccccaccaccctcgccgcacgcgcacctcgacacgccacgctgaagtgctcgcgccgcgcggttcgactgtgcgcnccgcggccnccgntcatgntcggcgagagcgcagcgcacagcgggaggcgcagagagaac

SEQ ID NO: 17698 - DNA, 870 bp, Homo sapiens
  misc_feature (1)...(870): n = A,T,C or G
gcctggccannttttcacctccgttagactccacgtccttcttatccaanagagcctcactgtcacctcctgccaccaacagctggaattctgtgatgaagtacgctaatgaaaaagccattaacatttgtaccaagtgctcctggtctcctctgcctatgcacttaggttaatagtatgctggaaggtctctagaaaggacagactcctggttaaagagctaaatagtcacatccctgataagtatggccatggacaaagatgggctggcccttaagtcagggcccactacttcggggagcagaatcccatgaaagggctgccttttgaaggagaggactaattagacactagtaccgacaggaagaggggctggccctaagaattgcgcccgagagagtgtgtctctaaccgaatctttcgtcacccttccacggcccgcacccttccccacgattaccaccccttctccgtcgctaccccactacagggctgctgacccccattatgccacccaccttccacccacggctcgtacccttccttccttttgtaaagatctccaaaccaaattgaacccacctgccggtggccatgcccctgtgactcaccaacgagacccacagcctctcccacccaagtacgtcccccatcgagcctttctacccccccctcatgccatcgcccctgctccccgctgccccctcttccccacatctgttcccggcgtctccacaatcttccccccttgcgacttcgctcgcgtccacctcacctcccaccccgtctctcctgactccgtactcccttcgcttccccaccctgcggacaccgttattcgagtaatccccagacggaagaaaagaatat

SEQ ID NO: 17699 - DNA, 343 bp, Homo sapiens
  misc_feature (1)...(343): n = A,T,C or G
ccttgcggtngcacgcgnagtttgnaattgtatctaccatcgtaacacagaaacaaaaacaagacatggnaagctaaggctgacggagcagaaagagtggaaagaacatgggtgtgtgttggcctcactgtgcttacccaccagcttggatgctccatcctcggacatcttaatatcactaaaatcagaatgcatcttccaatcaatgagatcttacaatgaattcagggcattcttctttttgttttattcatggaaagggtcctaaataatgacacatcttataatctgcagcttcttaggtttaataaaatatactagctacagacgaaaaaaaaaaaaa

SEQ ID NO: 17700 - DNA, 765 bp, Homo sapiens
  misc_feature (1)...(765): n = A,T,C or G
ccttgcgnaancnctacatttggtagtcagnaattggaactttattttgcatccaagccttgggaaaanaagagaatattaaaatgtacgctaagtatgaaaattacgatgatagaatgagaaaaccactctacattgtcatctgctcaatctaacctctgaaccgattttatttctttttaccttttctccatgactcaagtacatgactcatgctaattcttactgacatattactaggtagaaattactatggtgataaaagctgcaagacactgcatgttattaagaatgcaaagcttgccagcctcttcacagggtacatgcactttgtgttgaggggacaattagagcacaagatagataaacaatggagaagagaagcaacatactcccatactccctctgctccatgcctctntctttctattcctctcatagcatggatgatattaagcagtgaggaccgaacagaaaagattggttacaaactcaatccactggcaaggattgaatggaaccattgtctaagagtcccggaacatggaaaaaaggcccccatcccaaaaaccccttccaccagggggaaaaatccccaggaagaaacctcttaattttaccccaccccaaaacccttctttttcgtggaaaaaagggggaaaacacctcttttccccacccccccggggacccctaaacagaaagaggggtttttcccaaaaaggaaaaacttttcttttcgagggggcacctttttttcgaaac

SEQ ID NO: 17701 - DNA, 875 bp, Homo sapiens
  misc_feature (1)...(875): n = A,T,C or G
ccttgcgcgngacaatacattncatctncancttcaataaaatgtcaagnacatctgatgggaaaatgatagtctctccacaaaggtgttgggaaaactgaacatccacactggaaaaaaaatgaaacttaatcactaccttacaccataacatataattcaactcaagatggatcagagatttaaatagtatgaaaatgatgttagacaaaaagcaaattcaagcaattttcttattcaagttcaaaatgggtcgtaaagcagccaagacaactcggagcatcaataacgcatttgacacaggaactgctaatgaacgtacagtgcagtggcgatttaagaacttttgcaaaggacagaagagccttgaagatgaggagcgtagtggctggtcatcggaagttgacaacaacaaattgagaacaatcatcgaaactgatcctcttacaactacttgagaagttgccaaagaactcagtgtcaaccattctgcggttgttcggcatttggagcaaattggaaaggtgagaaagctcaataagtgggtgtctcatgagctgaacaaaaattttaaaaatcgtcgtttttgaagcgttttcttcttttattctacgcaacaagaaggaactatttctcaattggattgcaatatgtgatgaaaagtggattttatacaacgggtgatgtccagctcagtggttggaccaagaagaagccccaaagcacttcctaaagccaaacttgcacctaaaaaaaggtcatggtgactatntagtggtctgctgccagtctgatccactctgctttctgaatccagagaaaccttacatctgaaaatatgctcacaagctgaagagagccctgaaattgcaccc

SEQ ID NO: 17702 - DNA, 278 bp, Homo sapiens
  misc_feature (1)...(278): n = A,T,C or G
ggagggggccgctgggtgcaagttaagttttggaaggccctgcggtganaaacnagctttctgtaagnanaaacatccccactgtggcttttccaataagatacctgcaggaaaaggatatgtttttcaagaacagcaagcatcccgatggctcccatctgcctggagagctgcttctctgccttcgtctcaagttggacctgcctgtgttcccccagtgtaattgactgcagaaaatctcctttctgaaataaatgccagaactaaaaaaaaaaaaa

SEQ ID NO: 17703 - DNA, 867 bp, Homo sapiens
  misc_feature (1)...(867): n = A,T,C or G
ttgcgacccatatggcaatgtatgtttagnnacaaaaancaaattcaagcaatattcttatttgagttcgaatgggtcataaagacaactcacaacatcaacaatgcatttggtctgagaactgctaatgaatgtacagtgcaatggtggttcaagaagttttgccaaggagatgagagccttgaagatgaggagcgtagtggctggccgttggaaagtgacaacgaccatttgagagtagtcattgaagctgatcctcttacaagtacaagagaagttgcccaagaactcagtgtcaatcattctatagtgttcagcatttgaagcaaattggaaaggtgaaaaagctcaataagtgggtgcctcatgagctgactgaaaatacaaaaatcatctttttgaagtgtcatcttccattgttctatgcaacaacaacaaactatttctcgatcagattgtgatatgcaacgaaaagtggattttatatgacaactggcaatgaccagctcagtggctggcctgagaagaagttccaaagcacttcccaaagccaagcttgcaccaaaaaaaggtcatggccactgtttggtggtctgttgctggtctgatccactacagctttctgaatctcactgcgactgttacatctggagagtatgcttagcaaatcaatgagatgcactgaaaaactgcatgcctgcagttagcactggttaacaaaaaaggcccaattcttttccacaccgcctgactgcccatacacaaccagtgcattacaagttgaatggaatggggcatggaattctcgctcaaaccccccatttatttcgactttggccaccaactacttcttgctcagggatatac

SEQ ID NO: 17704 - DNA, 975 bp, Homo sapiens
  misc_feature (1)...(975): n = A,T,C or G
cctggcgnantagggtctgcgcttccctctcctcgccgcagggcctgcctctgcctggtagctcgaaggagcatgaattgtgtcccttgtgagcctatgactgctggtttggatataatgcagcacctcgtgtgatgatcgattggaaatgaagattatcgcgcttttcctataccctaggagcgcagtaatatcgtataactgtaagaagggcatctggctcactatgaacacgctggtacgtgcccgccgactatgcctcaaacgctcaccactcattacatgccaggaaaggggactatgatgagcttacagcttttctagattagccatctctttttaacatcgctgttggacttgtgatctccatctttgtgtttgctgaacaaactgggacaagatgaccctaagtgctctgtttgcataaacgatacgcttgaagcatcagaatggagatatggggcttcctagctaagcatggtgacaggactgatactctgattgatgacatactgtccaccgagaagaacattggcctagagcagtgctttcctctatggttctgaggggatgcccgcactatgaagaagaatgagtgggcctcgacttctatggaccccgaggctactgggctagcgcgataatatgcgacctgtccttttaagacacctcagtcctctccttcctgtaacgagagatgagcggaagcccgccttgtggtcctcaacgaaaagcaacacgcgccccttcgcccccccgcgggcacccccccgcccggctcccttagcgcgggtcctccctgcccgcgcccctctgtctcgttggcctcccagctcggcggtcttgctcgtgtttcgtggcccccgccggccccccgccacaccccaccccgcgggacacacacaaattctcacgcgttgcctcacccgtgcagcaccaacaggccctgtgctcacacacgacttcctcaccact

SEQ ID NO: 17705 - DNA, 877 bp, Homo sapiens
  misc_feature (1)...(877): n = A,T,C or G
cttcgccggccaacacnaaactatgtttttcgatctgcaaactttgccagcagctcactcaccaagggcagacagtagaatgaaaagcccaaagaaggctgactaatgactcaatgttatgcatagtaggagtgacatgcttggcctacctgctcatctacaacctgactgagtgcataaccagtgagaccacctgcaaataggaggaccctcagccagacaaaccccaccgaccctggtcgaacccgagaaagtgatgacgactgtgtcgttggataacataccgacagcgggggatgacattttctcgccgggatcccacaaataacaagagttcggcctgccctcgcccacacccagcgctcccgccgggcgcaccccaagatcttaatccggacgactcgaaatccccaacaccccttcccccctccgccccctcatcagccatttcgcacccccaccgctcgccccgatttcctcctctccttccgcacacaccccccgacccactcatcaacccataacaggaccttcccctccctctcctcccgcacccccataaaccctactaagttccctcacggcccttttaccccaaaaacccatcccttttacataaattcaactcaccatgttaccccccccctcacagacaaagtanatgtcgcaatccctttaatcccccgcatctattcccgtcccgaagctctctgagctcccctcgcaccgcccccgtccctcgtctcgctcctcacccccccactgatgctactgtaagtacccaccacgccaagacgggcgcaacgccctctcttcatcccgccanaccgccgcgagtcaacccaatgcactccgtagcgcccaggagtcacgatcc

SEQ ID NO: 17706 - DNA, 111 bp, Homo sapiens
cttatgtaaccactctgcacccaatgatttaagcacttttactttaccagcgttctggggagcaaaacaggaagcaaatgcccaaaaagggataagggcacccgtaatttt

SEQ ID NO: 17707 - DNA, 1738 bp, Homo sapiens
  misc_feature (1)...(1738): n = A,T,C or G
tacgactctgctgtagnaatatcactcgataccagagattcgcgtcgtcggatacgacagctacttctactcgatctagaatnacnangatcacgatcattcacaaatgactcgatggcagcaggaatcactcgtcgtttctttgacaagtnacctatactgcnatgactactcacacttnctantatgttgtatacgtcacttgttatanagtgaaataatgtanagtatgatctcacngacntagattgtggtatntgactattgacaacgttgttagtctatctatntgtattancggttagtangcgtgtntacattcacgcagcctgcctgctccggcngtgctngatcgcngttgtacacgtacacattttcaccgagtacaagaacgcacgctattncgttgctcgatgtctgctcgtcacctactctgccgactagacgttctgcttatatcgtgatgagtgccaattcagcatcgaatatatagtataaatactcacactatatcgtctcacgctgacagactgcagtccgctgcgcgcttcacggttaatgagtagtntcntgtatgacggcgctgcncncngcgctcgagtggttcgcatttgttaatagcgctcacacacacgagtctcgcgtcgatcagttctcgctacgtgagtctatattaccgacaactagctgctagctcgctcacccnntcgcgcagtacntccattagcgagagtgggcagtcagatactgtgaggggtgacgntcactgtcgctgngtggctagcgagtgcatgatgatggaagtcgagtcactgcactactaataggcgcgcgcattataccgcgagctgtgtgagtgtagtttagctcgcgtaantaactantanatcgcgtatcgtatcgatagatcacntaggctaatgngtattgagctcatagtanagtacgaccgtgagtcggnagtngtgcacatgctggtgacgaactcgtcactacatgancacatggtatgtctagcggatcgttgtgtgtcacantgagagatcgatacagcgagcgcgagtgatgcacgcgcactacttatcagtggtcgcgcatgtgagcgtagagacacatcanctacatagctccatcntcgntcgagcaagtggcacgacntggngacatgcacacgtagacactcacaatcatcagcgcagaggagcgtacacgactacacgaccggctggcgcagttgctcggacatacgctatcacaactatgtactcactgtctgtgtattgcggaatcgcagtcggagnacancagagcgtatattcacatacngtacaccactgagtgaggaggcnacgacgatgtcgtcgtcacatgaggctacgccaactcagctcgcggtgaacacacaacacaaacatgtagtganttgtcgtcatggtgtaaactgacggtcgcgggagatatgagcacaacagtgtgtggttacacaccaatgggtccataagcgcgacccatcacgattctatatcgcgatgagtgtgtgaggactacaacctgagaggtaagctcagaactggtaaagggagcgatccgcgcgttntgtattctcgtttataaccactgtccaggcgtgggaagacgaccataccaaccgtagacgtccagttgacgagatagtgcctcgaggatgcacctaacctcgantgcctngtgtgacgaaaaggncggtcgaagcgaggaa

SEQ ID NO: 17708 - DNA, 2077 bp, Homo sapiens
  misc_feature (1)...(2077): n = A,T,C or G
aggggggaagcagcanatatctctgttttttttgggggggccnngtngtttganaagaganangantacttatnaganggattcatcttttttgnnngaannnnncncnagancgnnngcgtgnncncnngtntntcntcnnnnnannnnnnanncnnnncnnnannnnatcttttcttttngngngngngngnngncnnnnnnnngnnnncnnnnnnnnnaccnnncnnnnnganagangnncnnngcgngcngcggngngcgcgcngcgcgccccgnnnncgcgcgngcgccgncgcgagcggcggccgcccgggcgncngcggccnngccggcgcggngcgcggngcncgggggcagcggcgnnccncgnnggcgcgggnccggncnccggcgccgcccggcgcggcnngcgcgngggcgggggcgcnngcggggngcgcgcgcgggcnggnggcgnngcgcgcgggnnncngnncgncggnggcccnccggcgcacgcgcgcngcgcnncnccngcgccgcgcnggcgcgccggcgcgcgggncncgggccgcgngcacnngcgcgcgcgcgcagcgcgcngcgcgccggcggcnngcgnggcgcgccccgcggcnncgcncgccgccgcggcgccnnacngcccgncgcnggnncgcatgacgngcncgacaacgacacacgcgcgcgcgccggcgcagcgcgcccgcgcggccgcagnangcgagtggngcngccgacgagcgctttcgcggncgcgcancttgtgngcgtcgacgagagcgcgtcgttcgtttatgttntnatgagcntnctgcantgtgctgtcgctctcttntgttgtcgtgtcgtcntnattntttcgtgtttgcgcgatcgtttntttnctttttctggttttgcntcgtttgtgttctcgctttttcgtccgacatctcgctcgtcgccagtgttttatgcgcttcgtcgatattgtgtattagngtatgtcgggtttcgtcncgcagattctatgctgcgcagtgtcgtatgtgtngttacagtttcatagtcacatctcatcgatacgtgctgtcgcctcgcntcgatcncgcttgtctntctntcgtatctgtatgtcgcgataactatgtgtttatcgttttgcggttttccgctggtcgtcagtctatgataactgtgtatctcggtcgtttattctagcagcctactgcctcttgtactttgctcttgcgtctttctcttacgtcatctatanttctcctaagtgttctngcgcgctcgtcagctttcgcntgtgtattcacgancagagtgtttatttctccgttcctcctgtgtcgtgttagttgtatgttgtgctatacgttcgctcaacatnccgttgntgtctntntactactctcatcgataatgatatttgtgtctctctagtgatgctcgtacacctccttgctcagtctcagntctctagcataagactgccncntctcatgccatcgctctgatcatgattcacntcgcgttgctacgttctctatntagcttttcgcgtctaggatgacatatgtatatatatctctgataagactattgggatctcatgtttacgtgtctcgtattattgacgtagagatctctgatncngctatctgtgtgtgtgttatactctgtctatgctttactattcgcttatacattcgttcataatcgatatctgcacacgaagtcaaggaggatacactctcgatcgcactacactgagtacnantaatgagtagttagcctactcgattacttaactattgttcagttgcaacnacagntcttctctatgtcgagtcgcgctcttgatcattctctngncatnatattanctcgagtngaatgtagttgattatntnacgcgtcgngtgtcgccgatgttacatatatcaacgcaagcggtcagcgactgctcatctgtagtgtgatnttcgtcctatcgtcacgcatcctatagttagtcgcgacctgcgacaccactaagtacancagtacaggcatcnagcatntnactacncgagtgtagcta

SEQ ID NO: 17709 - DNA, 904 bp, Homo sapiens
  misc_feature (1)...(904): n = A,T,C or G
gcgcacagcggcgaccagaagagcggacggacgaacagaggcctcacaggcgcgggaatgnacaccnccaggagagccttcngaacggaccggngncgcacgacagctgaacggagacgagatgttcagcgcgcgcgccgggggccgccccaagacccggacacggcggcgcgggaacccgccgcgcaccgcgccgcagatggcgacgcacgcgcagagcgcgcgggcgagaggcgcgagaaggacgtggcacggagaagcaggcggcagagcccacgagcaagagaaaagggggtacgacgccgacagcagcacagggagcgaccccgaggaaggggtcgagagcgcaagtgacacacgagaacgaagatcgagaagagcggacgcggcccagcgggcaacacagtgagcgcgcgaccgagacgaggccagacgggcaggcggcgcgggacaagccgacgacgcgaggaccgaagacgcagaagccggacgcgacagcgcgtagcaagaaagcgcgagagggccaaacagatggcgagaggacggcgtgaggagtacgacccaaaagcacacacagcgcgcgcagaccgcgagccacgaaagagtagagcaagagaccgcagcgagaggcgagggagagacacacaaagccgagcaagcagcgcgcgcatagagaggctgacgcggccggcacagggtcgggcgacgacgaggaagaacacatacgtcacgcgagcggcggacctcgcacagcaccgagagtccgcccaagcgacactacatcgcacagcggcacacacgagaccgaagaccgccgagcggagaaggcgccaccggtgcgcgcaccacagcgcggaacgcgagcaacgcacacgaccgtacagtatactcggacgtagcaccg

SEQ ID NO: 17710 - DNA, 1006 bp, Homo sapiens
  misc_feature (1)...(1006): n = A,T,C or G
aagaggggagctgtccaaaaaccaacagagccatagagcccacgaagacaaaacaccacgacagcgttggcaggtggacagagacgacacccggttcggcacgccacaacaccccccccccccccccgcccccaccggcccgacgcaccccaaataccacaaccgcacaaaagtgggcgagggcgataggaaaccagaagcacagacgcagaaccggccgccttgagagcgccgtcattgtcatccaagtcgccaatgctgagcaagaaggcgatcggcggggcccgtcgaaaccccggcacacactcccggcaggcaacgacagactgcgccggaacgaggggcccccagagagacaaagagtcaacgttatgggcagactcgaggacctcgcatgcgtgctggaccaacagggcgggcaaaagtgggcgccgggcgggggggctccgttgcgtgagggtacatggttatgtgtagatatggcctcgggatgtggaggggaaatagccccggcaatgtaccagcgcggcagtgacaacaaggggaaaaacaaacgcgggcggggtgcacctgctccacgaaggaggggagcgcgcccagccaccgaagaggggagggggcgaccgggcgggcgatccgtacccccccggtggaatggggagagagagcgcgaggccgggcacacaccatacccctgagtgcgaccgagcacagcgcccacaggcaacactatatcgggcccaccccaagggaatggggacaaaaaagcgcggggagacgtggggaccttgaggaggcatcccgcagggcctatggacggccaccacctgtagcgcgggggcggggggggcaaccaggcggagtggacgcagggaaccgcgcggtaccgggccgagatgataagatccaagagccgagttatngcacgcgggcacgcggacgccaactgagtagtggcgcgcgggtgacacgcggaggcgcgcgcggcctaaggagcgcctggcaa

SEQ ID NO: 17711 - DNA, 1425 bp, Homo sapiens
  misc_feature (1)...(1425): n = A,T,C or G
ggaaaagctttggggggcgggggaaggaagttaaaaaggtactttaaagnnaaaacgacccctgnncgactntgngganaacnccaagatccttctgngggggnnnngnngnnnnggnnncccgcgnngcccccaggggcgcacggcgcccnccccgccgcggcggcgcgccccccccccccnnnngcggcgnnggcggcgcggcggcgcgcgcgcgngcgccgccccgccggggccgcgcgcgccgcggccgcggggcgggcgcggcgcgcgggcggccagggccggggcgcggggggcgcggcgcgccgcggcgcgggcgcgccgcccgccgcgcccccccccccncgcccgcccgggcccccccgcgggcggcgccggggcngcggcggagcgggccccggcggccgcccgcggccgcggacaaaggcaaacaaaaaaaaccgcggcaaaaaacacaaaagaaaaaaaaagnaaagaaaagaaaagagcgagngagcgagacgagccagcccggggggcgcgccgagcgccgcgccgcgggccgccncccgggaagagcagaaaggaacggaaagacgcccgcggcgcgggggggcgcccggcgcgccgcgcaagacgcggcggcaggccgcgcggcgcgggcgagccaccgnccgcccgcccgaacgccgcacccacgacgaagccgcgcggccgccgcggggcgcagngcggcgccgcgcggccggcacggcgccccacgcgggcgagagcgggcggcggggggccgcgaggaggacagagagagcgggccgacgcggccacgccggcacgaaaaagagaccgaggagcaacacccgcgcgccgcgcggcacaagaaacccacaccacgacacggagggaagagcgcaacaagggggaggaggagacggggcacgaagaaggggcgagcggggacgagaccccccagcggccgcggcgagaaggccgccccgagagcgagcaacacggaggcaggggcgcgacgagacgcgacgccagagaaggaggcccaangaggccgccccagccaacggcacgacgccgggcgccgccacgaacgacacaaccaagaacgcaaccccgcgcagacccggggaacgccccgacaaagcaacaaggcccagagccnccgaccccncccacggaacnccccaagacaccacccgggcccggcgagaccagaagaaggncccacagagcanagggggcacaccaacaccnaacgaggagngacaacggcaacacacgcagagcagcgaaaggcgcgaaagaagaagcccgccgngggggcaggtgatcaagggggggaccccgcgcgccgggggaacagggcgaacaggagagcacaaagaagaaactaagaaaacaaggaaaagaccaaagaaaaaaaaaagataccac

SEQ ID NO: 17712 - DNA, 1414 bp, Homo sapiens
  misc_feature (1)...(1414): n = A,T,C or G
gacgatgcgagaggaccagcaaagattagtttatggagcactaagactggaagttcaatataacgcgcctggcagggtgcacgagaacgcgttagaatgcgacgaccggntacggcgagcgcgtagttgtggaagcaacttacggtaccgcttcgtacaccgcacgtgaatatatacacgcaatacaccaccgaaccattgtcctaacgccgatcggaccgcacgctaccgtgaactaacgcgtggcgaccccgtccgcacangcatcagcgactccacatagccgttgttctaatttcgacgtctgtgtatcgtgttgatgcatatggccgagcaacgtgtgcaaatagttgtgaagaacaaaataaacaaacaagaaacgaggggagcgctgacgggtgtttgcctatctctgggagcaccgcaacaagaagagagacaagtggggaccggtcacacagatcatcacagcgagcgtggcaggggcagcgcttcgaattggttgtccctgggacatctgtggtttgtgcactatcgtgtgaactcagttgtggttgactcagatagaacacggaaagattgaccattattgcgcgcgacatgtaccccccatgaatggccatcataattgtcattgtgtctaataatgaccatatcccaccgtatgcacggcatgattcgcaacggtggtcccgtgcgattgtgcgattgcgccgcggtatatggtaatagggtcgtagtgtgtgggtcgcgtatgtgcgtgcactgatcagggcgcagttagtgggttggtataggaggtcataatatattattacccagctgactgtggttagtccttgaccgtacatttagccgccacttcacatctgagccttaaatttcgtctagcgtgcgtgtcgcggcatatgccatgtcgtctcatccgatattaagtacgagcgccaattatatattatatatacataanatagatacatgtgtagttataccttatattctcaatacgataagtgacctgcactcactgtgtcgcggtactcacatatgtgttgagtcagacccattcactatttgcaaacacacacgctgtgagatgaacctcaccgcaccgattaatgtccgatatgctagtagctatatatatggtcggagtcggtatcgtcgtcaccacgtgtagttgtgcattgacacaggcttgtagtgcgtatagctcgagatcgcatgagtggtcgacatcacacgtatgntctcgacatattgctgtggcnacanctgattgtatctagtacatcgcaagtngtggcgcacncacagtagacnctaccatcatatgtatgtgtatgtgtagcntagcacncgtccactatactgtgtgccgtgatgntagatcatcgttacacgacgcatgtgt

SEQ ID NO: 17713 - DNA, 994 bp, Homo sapiens
  misc_feature (1)...(994): n = A,T,C or G
gagtgcagtgttagcatgagtcatgacaggcaccgtgtattgaaaaaaacaagagaaaaggntagcctctctttcgcgtcggagctcctcgtctctcttcactctctgacaacacgagcttctgcgactgcttgctcgccacacgtctcccgctccatgcgcctcacccttttcgagcgggcgggcgcggcggaaatgaccccgcccacgcacggcgctactcagctcacaggagccaccgcaggacatctcaacggcacgacgtccaaatttctcttgacctgaccatccacttacaagcgaagtggtagcatctcgcccgctgcatggcgcttcgtggagagaggagtcatatcgcatgcccctacaagttgctgtgcatatcaacgtcccccagacgtcatacactgctgactcctaataccccacaaccgctgagcgctgcatcattagacnatatcggcatcagagctctacgagcgctaccagaccgccaactccaccatcaacagaggtacccagcgaagtacgagcccacgtatcctcttgntctcagacaaggcgtaccctcgtccgtcctcgcttacncactcatctatcgcgcgcgtaactcatatcctacgagtcaagtattggattctcacagagattcatctccgaagtaattatcctcgactgtncacaaagacacgctctgtccttcgatcacgcgtaccactcttcagcatatctcagcaatactgctctcnacttgcctactacgatccacgtcccacactcgacgtaatcgttatccatgagctacgattggtcgcacgattacgtcacctccacatcccacattacgtgctactacagttcacatagtgactcacttgnaccgtgacctactcaggacataactcaggtatcagtctcgactagtcttcgaccgagagagtaatgtatacaaacatcatcatcacgagagtttgttcgtaatgtatatccagtt

SEQ ID NO: 17714 - DNA, 1672 bp, Homo sapiens
  misc_feature (1)...(1672): n = A,T,C or G
ctacacgacggacgccaagcatggtgatagagaaaagtgttncggagcgcagcacgatcctcgatcactatcgtagtatgagcatgaccttagactggctgtgcacgcganggnagncgagatgtgacgcgcgtggagcgccgtgatatnagagtcatacgcaggcagactccgccgacacgtcgtcgtagacgagnttcgagatacggctcggtcgcagtcgtcgtataatatcagcgatcgtgtctcgttgcagcactgtcgcgtcgcgtgtntctgcttgcctcatgtcagagcgtgtcgcgcactcacacacagcgcgcgcgctggctcgancagcagacaccgcacgtccgctacaccgacaagacgcncgattataccgataatacgcaggcccgngcgagtctcggtggtgcacgcatacgncccacggcattgaatctatacaagtgttctaatacgcgcatacttagtagaacaccagacacaactgcacgtcgcacgcggtagtggacaatgaacaacactagtgcggaggcaattacacactcggcgactacagatcacgcacggcgcatcataataaatgagtagncgcgaagtgtcnatgcgacatcacgcaccaatatcgtgtcgccacacgtagtaccatcgcttgtgtgagcattactgctcagtgccactcccacgccgtgctctagccacctgcccgaccatttcncacgtcagaagtcagcgatatcacggcagcgcgcgtccacccactatgtcgcncacatatatgcaagccacacacagtgactcacttatagtccacntcgccgcctgacgtgtgtgacgcgcgcatgacaccacgcgtccgtgctgcgccctaccgagattgcggagtatcgcccactgacccggtcaantgttacatggagcacgaaaggcctagccgcngacggcaaattatgcagtaggatagcgcaatatcgtcctgcagtagttacacactcgatgaatgtgatatcacgacgcgcagttgctgccacagnagtngatcatgacgagcaccctnatacacacatatatgtgcctctttatactcatcatgagcaatgagatgtacagctagcatatacgcgcagacccatatgcgcatgtcgcgccagcaagctatcatactccgacgtcctccagacagatatatatgacattactattgtcactgtgtagtcattctccatgaactgacgacacgactaagtgacatagctacgtnatgtgcgtcgtactagcgcatggttcgtactctcgcacgacgcatcagttgcccacacacgagcaatctagtatgcagccctctcgcacagacagagtatcantgttcagcatcgcgcgttacactcgagacataggtcgtcagtgaattcacccacatgncgatagcntnccggtgtcctacgcagtgtatacgcnacgcatccagtagcacgagtggtgtgcgcgcacgtagctacaccgcgatatgtgccgcccacacctgtgtgngtttttggtcgataccactatngtgcgcnacttcaactatccnacccactcaccaagtgtgtnatgttatgtcntgacgacctgaccacatctattgacnatgtcattgcgataccacgtatgatggtaccagatt

SEQ ID NO: 17715 - DNA, 912 bp, Homo sapiens
  misc_feature (1)...(912): n = A,T,C or G
cgcggggcggagcaacgccccgagacccgcgacagatacggtctttggaaaaganggtgcgggngtaacaaaacgnattttcaccacaatgggcaaactggcctgggttcaaagcctgtaactaaatatctaacgtgaagcagatcagcaataataagacgaaactacgcgctgcacaaaggaggagctggacatcattgtttccaaacggcttggaactgacaggaaatattgatgaagcagaatgggcagggaggaagcaggatgacgtcgctggaacaatgactgatggaccggaaaaaggaattcaacgattacactagcaagaaagaaagttgagagggactgtaatgaatagaattgcccttgatagaacatagagtcctttagagcagagcgcaaatatgaggagctttaatacgcacctactataaaagtaataatgtaggtgaaacaaaaatgccagaaggataataatgaattcctcacatctttaacttaggatggtacctagcattacagaaacccaaatggctagaacatgtttaattaaatttgacaatataaagtttctacagttagagatgcgcatattaaaacaatggacctggttcaagtgctttcttacctgagtaaatccagaggttttccccccaaaattatcagggctctgtttttagacgcgcgtaatatgataacccctcggtaaaaggtctcttttttagatgaattaactattggcacactgggcactcatagcttacaaaattatgtgctccaaatacaaaagaaatggccgtcgatgcgagaaactgaataggcccggaaaatgaaaacaaaatggcctggctgggctcaccgggggagctttgaggcacgttacctttacaggaggttgaggaggaacctccc

SEQ ID NO: 17716 - DNA, 982 bp, Homo sapiens
  misc_feature (1)...(982): n = A,T,C or G
gagagcaagcgatagccgacgaacaggcccgagccacacgcgcgcgcgctcgcctaggagacacacgcacgtntcacagacatcgcacagnacagcgngaacacctctcgcgatgcatacgcgaacgctcatccatcgctcacgcggagaagaagatcagccagaaaactgagcacggaaatcacgctaccgtagctcgcgcccgatgcaggctcgaggtgcgtccctctcagaaatgcgcacagcgacangcaacgtgcgtctacgccgtagatcaccaacgaacattcgccacctgtcgtactccgacagngnctactctgcttttgtcttcgagagagngtacacacgaccgtagcactgtaccacaatctcatacactgtaacgatgtcacgcagcgacgtcgcggtcacactctcagtagaacctctgctacggctcatcagcccgtctccatactcaaaactacaccagtaaagcgacaaaggacaccctctcgtatacgacaccgccataccagacggccatctacagatactcgtcccgccaagaaggcgacagcaccacccacccctttcatcaccggcaatctgcaacgcccaacaacctaactccaacacaccgacgtgcgttcgaccccatagctaagctaacgacgtcacgctacaacgtcgcacctccagcctcactaaagcctcccgtacaccaccacaacgcataccgcgcaccgaccacaccacccgacgcacaccgccgctccccacntcgctctacccacacaccccagaacagccactcagaccgcccgaccccagcccgacacaaccatcaaataatcgacccacacagcccgatcctcccacagacacgcccaaccacgaaccacacacacactaatgtcaagcaataacctacccactataaccacaccncaccttctatcacgcgactatcccactgactgtacgcacnaccagagag

SEQ ID NO: 17717 - DNA, 1134 bp, Homo sapiens
  misc_feature (1)...(1134): n = A,T,C or G
gcccctcgcgggtcaacgccaacggccggggccggagttactccctcttcgcgtgttgttttcattgtagatatcacttcttcgcggtcactctcgtgcttccggttgtccgacgccaggtcgtatttcccgacaacccccccctcgctcgacccgcccgtcatagtccgccactccccgccccgcgtgcgttgccgtccccctaaccggtacatatagtacgccatgcggttcgattttagtatgtacgaaagagatagtctatccgtcaaggacaagcaggtcaggcgcttgttttaagtttgttacaaataggtgaggtcgcgggactccaggttcatgtgtttgatgtcgttataggttttgccccgcccaccttgttgtacctcattgtgtactccctggctatgcaagcaacatatccatgattgcctgatgccgtttcggtccccactgttcctgtttattgctctctttctcgattcccatgccgcccgtatctcccatgatacagacgaggcaacatcgttgggtatcgcgcccccaacagtaaatcgccgtacatgggccaccgagctccggtttatctcgtgtgatgtatgtggtacgttattcatcgttgtttgcccccggattcattattctcttaccagtcctcatacagcccatatctacactgcctctcagtagttgtctcaggatgcagccgcatcntctctgacgagcgtagacagagacagaatgatcagctcggcagcttccagatttattattacgcatctccatnttacatgagtgtatattacatngtcagtcaccgccancagggccatcatcacctgttgctcttgcaaacatgtttagtccaccccacccaattatccctcatctatgcgattgcctcacctctgtgctatatacgtggcatatgtgctgtattgggcgtatgtcgacgagtcgaanctctgattgtttctgtctgtgactggactggcgccccgaccactctgtttggtcacgagtgtccacctgttggcggcctcgttggacttggacaagggtgggcccggtaccattctccagattttgtatgagccgccaccacttgctgtgtgctactactgttagcccggt

SEQ ID NO: 17718 - DNA, 479 bp, Homo sapiens
  misc_feature (1)...(479): n = A,T,C or G
cgcgggtgggacgccagggactgaaaagaangttttggnnngnngggccagttaagactacctatncttctggacacctactggatggaaaaggtgaccttggaggatggtaagccatcatgccactgagaagtgaagtcacaaacacagaaaaacgcatggggcctggggcctggggcctgacaatcagtctgggctcactcatatggaatggactgcacactcttgagagagaaaaaaacttccactgagtttaaacctctgtttggcttttctgtctcatgtatacatctggattaccaaaagacactcacattttgccttactataaaaagaaaactcaatctatattcgggtttttttcctttagtgatttgagagtgttaatttctatttcagttatattagtatgtttctataaaatgtctaacaaagaataaaaaaactggcctcataggcctaaacggaggaactgtatt

SEQ ID NO: 17719 - DNA, 1800 bp, Homo sapiens
  misc_feature (1)...(1800): n = A,T,C or G
tgacatattagactatctcatctagtcactcagcaggtgcttcgtgatnngcntnagatancgagatnattctnacgatagtgtcccgagtactgagacnangancgtcgaccgtgcnagtccacctatctgactgctctcatgtcactaggatnctgagtatacgtagatgatcantgcataccagatactngctnacngaactgncatgagtctgcanacggctnacgacancactgactacgttgcagtctaggtgcantatnacgctgcgtcatcgatccgcattacgtgatcggcgagtctctctactattgtacntcttgtagtgtgactattctgagtaacgatatctcgctggactcgacgactctgatatgtntgatgacgtcngccttcgtcatcagcagntctgntcgcgtnaccccgacngctagcnaccgagcttctagtgcacatcnttngtagatgatgatcatcgtcacgattacatcagctgtncgnctgactncntcangatagcgtatcnantcagtcatcactacgtgtacnctactgtgtcggtatgatgtacagnacttanctgtatctgcgtagtancgnagcagncagnacagctgtcganatntgcgatgtanttgtnagtcagtagagtgctggcagacactgatagagctgangtactgtcgganagtatgcagcactcttacangcagatatccgctgcactanganantntgcctgtacatnaccagngtcgnacggtangnctacatgctgcgcgtgcagtagtatagtntcgngccgtcaggcatntatntcgctcagtctgacagtggtncancgacagtangngncgacagtcagtactgcgactgcggctagcgnctnacangtattcnnagtgcgannctatgncnnatcgacgatatnncatgcancctttacatagctgtccatgagatcntatcagnacnagtagtcgcntacgactaatgatgatagtacagacggatgngcntgtcngcnacntangtacngtcngtgctacgatannctgacgngcngtnatgctgagactgcgacgctagcactgngagctngngacntgtngcngcatgcgggtnttgtancttancgcnacgantantctatgcgtgacgacactgtngtnctgctgcntcatancnagcgngttgacgaacgtgcntgctagcttantactgggtcacanctgatcgtcgtgggcactgcagtagcgnngactgtcgatntccatccattactgcacagntngtctgacgctgttgnnatcnacgangtagatgcgagcaagactgctaantactgtgatgcagacgtcatacagtagcantccnagcnacnantangacatgnacngtcgctagcgacgnatgatncgacatgntnnctggactgatngangtacgncaanctgcantannnttantnncagctgatacnatgatgagtcgncatgctgcaatgtagcagncatganatgctnatgcngatgntngatgcagtcacngncantgtannttagtntncngaatcagacagacgtcnatacgacatcgatgcgactgccagcantacgaactcagctagtgacgtatcangactgcnnantgtgagctatcgatgatcgttcgncagtagcacnctacgtcatcatccagnannactgaagtcacgtagtcgatcagtanaggtacgatgcnagtcatgttgcatgntgntggtncantcatgacgangttaatcgnganganatt

SEQ ID NO: 17720 - DNA, 724 bp, Homo sapiens
cctgctagattcacttttgttgcccgcctcagactgccaagtcactatcatgtccagcccagcctcctgagctggaggcatgtaccaccactcccgtctaattccatatttctaggatagacctgcctcatccatgttggtgtgggtgatcttgcaccaccgcactcaggggatacacccaccttggagacacaaagcgttgatattacaggggttagcctctgccccccgcccttaagagatccataccccttggcctgccagagcgtggatattacatgcgcgaccaacttgatccggacctataaaacacattgatcaatcggacgggaatgaacatcaggccatacatatcactactgggtctatgggataacaaaaaactcttttattaaggaaaggaaatgaaaacatgcccttttttgccactggggcgtggccatgacacgcgttccgtttattaagggccagaccatgaacctcgctctactgactcccaacgctcggaccaaccctgcacgcaccttaaataaatgataagaaatgagcacatatctgttcgttgtagcgataagagagagggggaccggcaaggtggggacgactggcatccctcgcgcagagcacgactgagttcgctgtcaccatgttttctattaacaccccctcacatcccaagaatatgcgccacatctatttcaattgcgccctagcacccgcaaat

SEQ ID NO: 17721 - DNA, 650 bp, Homo sapiens
  misc_feature (1)...(650): n = A,T,C or G
ccccggggcngcggcncccgcgccccccggccttttcctccccgcggggcagtaggggctccgtttgggggctgtaacaacttaagtttttaaaaannnnncttttgcggcanncggnncaaaggtatagnctnagtncatatncttccgagnnattnnacctgnagacagcatgnnatttgcaccaagatcnacccaannaaaagcatcaacttttcaactttcttntatnctnntggccatccccagttagtcattgtgtaaacctgattattagaattttcggaatgggagtcatccatggcccaattattagggaccctaatttgcctctcaagcagggccttggagaaaatggagttggaaaatggtgccgaaactgttaaaaaacttttaaaaggccaacagaatttttggcccttccccccaatcaaggggggggccctggttttaccagccccttaacaatccttccccctcccccaaaaggcccccttggaccccctttaaaaaggtttttttttccccccccgaaaaaacccccgccccttttaagtaaaaagggggaaatttttgggcccttttataaaagagccccaaataacccccgggtttttaaaaacccgggcccggggggaaaaaaaaaaaaa

SEQ ID NO: 17722 - DNA, 907 bp, Homo sapiens
  misc_feature (1)...(907): n = A,T,C or G
aagaagaacaggcagacaaggcagagcagaaagcccgcagcacggcctcccgtggtggnaaaacaccaacgacaacaagcaccaggacgacaggcgacgcagggagctttttcagaggggagccaaagaagacgagcgcacgaaacacagagagacaggaagcgcggacagaagagagcgggaacggagggccgaggcgaggaggaaccgcgccgcaacggagagggagagagcgagcgagacacagcacagcggcgcccaggagaacggagagaggcagaagcaccttttccaggaggaaaaaaaaaagaaagcgagacgagaccagagaacggcgagagcgcagacaacagaggcaacaggcacgagcaggagcgcgacagagcggcgcaaaaccaaggcaagcacacgcggccgagaccgaaaagcaccgcagagcaggaggccacgcgccgaccgccgcccccgcacccccagcagacgaacagcgaacagacgcgaccgaggacgcaacggaagggagcccgccagccccggcacaacacgcgcacacaccgggcgcgagcagcgagcgaccgccgggcggaccgcgggagcacgggaacgacagaccagagcacggcgaaagacaccacccaggccgcgagggcccgcaccgcagaggagaaaggcgcgaccgacgccgcgaccgagcaagcaggagcccaggcgacaccgcgagggacgcgcagccgaagacaaacacgaaccccgagcaccaaaaagacaagaaaagaaacgaagcaacgcaaccagcaaaacggaccgacgcggccgcgcgcgtcgcggcgcgccgacgcagcgcaaaggaggcaccacacccgcagcacacagcaagggagcaggcacgcagacagagcccgaaccg

SEQ ID NO: 17723 - DNA, 780 bp, Homo sapiens
  misc_feature (1)...(780): n = A,T,C or G
caggctctgcctctccagctctctagtgctgattattcctgcgatgttggtcacaagcaccactgatcccctgactctctacatagactctcacaatgttagccagccgccacatgaaaagatgtgtacatctttcttgctgcccttgaagagtggtgttcattgaatctttcagagaatgatactgatcttaattgatgatgaacaaccatgcaaatctcacccagagcatgcaggaacatgctctaatcactacgctcctagaatgggatctctttcaatattgactgcatccatgcctttcacacacttgcaccaggtggtatgatggagatgtcatctggtcagagggagaagaccagtacctttctgatggccgtccatctcaagaaacctttatctgtgcccctctaccatgaacgctcacaataatacttacacactcaaaaggccaagattaactgattgatcagccttaagatgtttacgccctagtgcatccttcaaccgaggacgttcaacaggcaagaagaggggtgggttggccctttgcttaaacgatgacattagatcgggaaaagccttttgctggctcgcgctgggggaagagagcacgccctaacgggaaactgtgcatgcaagaacgattgcctagactgaaaagagactctgcgctctacttggcggaggccatttagcgtaggccattggcagtcaggactgacatncaaatgatgcgtctctgacgtaggctcgatgacagcgatgttgcaacgcatg

SEQ ID NO: 17724 - DNA, 771 bp, Homo sapiens
  misc_feature (1)...(771): n = A,T,C or G
actcagcctgcctgcacccaggtgaaataaacagccatgttgctcacacaaagcctgtttggtggtctcttcacatggacgtgcatgaaatttggtgccgtgactcagattgggggacctcccttcggaggtcaatcccctgtcctcctgctctttgctccgtgagaaagatccacctacgacctcaggtcttcagaccgaccagcccaagaaacatctcaccaatttcaaatccagactccactggaaatcggactgttcaactcacctggcagccactcccagagcccctggaactctggcccaaggctctctgactgactccttcttggcttagcggctgaagactgatgctgcctgatcgcctcggaagccccgtagaccatcacggatgccgagctttaggtaactctcacagcggaaggtatacgcccagatgggctgaactaactgaagaatcacaaaagaagtgaaaatgccctgccccaccctaactgatgacattccaccacaaaagaaagtgtaatggccggtccttgcgcttagtgatgacattaccttgtgaaagtccttttcctggctcatcctggctcaaaagcacccccactgagcaccttgcgacccncactcctgctcgccagagaacaaacccccgttgactgtaattttccttttacctacccaatnctataaaacgggcttaccctgatctccttcgctgactctcttttcggacttagcccgctgcccccagntgaaataaacgccgat

SEQ ID NO: 17725 - DNA, 601 bp, Homo sapiens
  misc_feature (1)...(601): n = A,T,C or G
cnagccaattttnnaatatcccaggnctcccantnggaaataggnantnttanatntnaatantgaanannnantnccnagangcccctangaattantnnnccaaggntatatntananttaacnncnttttttggttaaangnanttaanntaatntanttngcatggttcncctnnggnangcccacgtaaanccatcnangnatngagggcttttaggntaactnntctnaagngaaaggtatangnccagaatggcttgaatntaantgaaaaatcgcaanagnagtnaaaaatgccttgccccaccntgantnatgacattncacnacaaaaaaagtgtanatggccgggtccttgcnttaagtgtgncattacnttgtgaaagtcctnatcattggnnnancnaggctcaaaaaggaccccctattgagcatccttgngncccccactcntgctggccanagnncaaagccccctttganngtaattttcctttacctacccanatcctataaancggccnttacccttatctcccttcgctggctctcttttnggacttagcccgcctgcacccaggtgaaatttangccgat

SEQ ID NO: 17726 - DNA, 613 bp, Homo sapiens
  misc_feature (1)...(613): n = A,T,C or G
tttccatgacctagctgcgtcaccagnctggnatacagaggcgcgatctcggctcactgcaacctccacctcccgggttcaagcgattctcctccctcagccacctaagtagctgggacaacaggcacgtaccaccacacctggctaattttttgtatttttggtagagacgggtttcacagtgttagccaggattgcctcaatctcctgaccctcgtgatctgcccgcctcggcctcccaaagttctgtgttactggcataagccacagcgcccggccctttttccttgtttctaagtggagatatgaatcaactcttgtccaacaaaattgtaaagataaaatgaaatatacataaagaatataatgcagtgtagaatatattgtagatgctcaataaatagctagtgctgatcttatttttaacagtaaccaataattgtgaagttgaatgtatattctctattaaaacccaacaaccatccaatcaatttatcacttagggagctattctgtgtcttctttaatgaaagctgttttgttttcttctttacaaaaataggagactatgaatagagagattaaacactagaaaaattaaaaaaaaagaaaa

SEQ ID NO: 17727 - DNA, 879 bp, Homo sapiens
  misc_feature (1)...(879): n = A,T,C or G
ccagcctttagcagnaaaccgatgagggaggagagctgaganaggaaaacagctgaccaaagttccctcactcttccactgtagacttccaagcctggagcaaaactcaacggggaatgggaagaagttttaaatgaaatgagattaacatttggtttattacatcgaactggactcaattacaaaaataaaaagactactacttattacctgagagcaacaacaaaattatcattatttatttatttattacagcacactcaactcaattactaaaaaaaagactattcatttactacctgaatgcaacaacataactatacactctccctgacatttgaaaggggtggtgagtggagcaatatcaactgaaaacaacagaaatgcttttgcttgcccgcccccactatttttcctcatccactattgctccgctagcttacttcatccccagcattttctatccttccctccccatcccccctcccctcacccttcccccccacactcgtcccttttcccccgttgtcccacaaaaacataccatcattcattgctatatctcccttttttcttccccactcaggtgcgaggctattccacccccctccactcaccttctcctttgcccccttttcccctttccccccttttatttccccatattccctcttctctattctccccgtctctattttccccctccatcttcccatcctttctccgatttccccccgatcactccaattatccaccgcgccccgtcctctcctattttccccccctcccgcttatccgtttccccccccatttccatcaacccacccgcatgttttcctaatccccccattaccctactccccctttttcccatttctt

SEQ ID NO: 17728 - DNA, 367 bp, Homo sapiens
  misc_feature (1)...(367): n = A,T,C or G
tttccagtagctctgcaactgttttngagctgcatctggcatttataaagagtgttgtcatcaattttcagcttctaccttaggtgtaggagggaactgaggcagcaagcaagtatttgctcactgtctgcatctttccagtatagagaatgcatcagagaaatgcctcaacatatgtggcactgtgtatataatttccaacactgcaaaatggaacaagcacaaaactttgaagggacggtctatgtgatgaaaagttggaatggcttccaagagctgaaatacaatgttgtcagtgtttctccctcaccatgatatttgaaccaaagctgtctgataacaaatgaaaagcttaaaaaaaaaaaaa

SEQ ID NO: 17729 - DNA, 498 bp, Homo sapiens
  misc_feature (1)...(498): n = A,T,C or G
ttcgaggaacacgcagctgtatcctgttggnatgatttgttcttcggactttgtatcttaaatgaaatcttctcccttagaggccacataaactgatgaactgcaggattctccaggctcatcttgtatatttcatggctcaggcgctgaatcaccattttctccatggagcacttgtaccttgtattggagaataacatcagaaatcaagatctagttgtgttctcaatttctttaaagtgttttcagttttaagtcggagcttaaatactgagtacacatggacacaaagaagggaacaacagacacagaggcctgcttgagggtgaagagcgagaggaggatgaggatcgaaaaactacctattgggcactatgcttattactgggtgacaaaataatttgtacaccaaacccccgtgacatggaatttacctatacagcaaaccttcccatgtattcccaaacctaaaataaatgttaaacaaaaaaaaaaaaa

SEQ ID NO: 17730 - DNA, 380 bp, Homo sapiens
  misc_feature (1)...(380): n = A,T,C or G
ggtgccgagntnncnctnagtcanctagtaaancaagaaaaangaaaagncanntcaagttactgnatggnaagtctacactaggaggagttattaatgtttcatcaactgagttatagaagatcttcgaggacatatagtcaacttcctgcacaatgcagcaaacctgtcttaatgtatctgttaacaggtggtcaacctgtgattgaatacttcctatttgcagagaattcactagttcattcctcttccagatagctctaattattcatgttctaatagtgaacctactaatatgtatcaagcacattgtgatttttcttacattgttatcttgtaatctaataaaactatataactacctcctaaaaaaaaaaaaa

SEQ ID NO: 17731 - DNA, 909 bp, Homo sapiens
  misc_feature (1)...(909): n = A,T,C or G
tttccggttggggcaaaaaacatataatgtgcccttgcgctgagncaagaatctgcatgatgttttctttgaccttgagaatgccttttgcttgccctgcagagcaggagaggagctggaactttcccgtttggctctgtcagccaagtgcagctttcaagttctctagggactgctgtattttctcatgagttccgacttcagatctccggctcctctttcactggacggattccaaatactacaactccctgtgtgacagctggagaatcactgcacctttctgggccccattgagtgacagaagatcggaatggatagtcacatgcctgccccagcgtggaaggagaagagcctatacttccatccattctggcctcttccaagttcccctcatttttctctctaagatcaaataaataaacatgttgttattctttttataaaaaaaaacacaaaacacacacaaaatcttccactccacccccattcccccaccccccccccctacccccccacacatgttcccgtcgcccccctttaccaccaataaaaaagattttcccctgcccacgaccctccttttctcttttcctccattctcctcagctacggtttcctcccccgcccctcctctctatgccgctaccccctcaaccccccacccccacccctaccattctcccatattccgcgttttccctctttatcgcggaatcgacctctccccctacatttcttcccttcctcccccgtatccccccccacctctccttatccgctcctccccccatattatctcttattccgcctccctcccctttaccctctctcccaccaatccccttcaccccgccccccttttttgacttcgcccgcctccccaatgccccattcttccgcttttcc

SEQ ID NO: 17732 - DNA, 593 bp, Homo sapiens
  misc_feature (1)...(593): n = A,T,C or G
ttccgattttncctgctgtctggcttactgagaatctcagttggttactcatgttgaaaatattattttgcttaaagttgataaagaaaattcagcttcatgtagtttgaaaagggaagattattttcatagccttttcagataattgtggctattcttctttgatactgccccaaaactagataagccatagtttcttaaagatcaggtgcaatgtgaaattaacccttcatactcagtgacgatgaaatccatttgtctctcttgcacattgaatggttcttttactgatgcctaaactttattattttactaattggccatttggaaaatatttgttcattgagtgatgtatatttctcactggtgacacattgtattctacaatattaaaaatcacatataatatagccaccaatctcatcaaagaaggccaaactcatagtgacagattcaaatgtttaaaaattctaacttttacttaaaatcacaaattttatcatggtcaacaaatactatcattgttttccttgaaatggcaggcttatcacatttcttttcaataaaatgtctgacaagtaaaaaaaaaaaaa

SEQ ID NO: 17733 - DNA, 460 bp, Homo sapiens
  misc_feature (1)...(460): n = A,T,C or G
cctccanaagcataaggnaaatccatggnaaaaaacaactcttttcaacaaaggtgctgagttcgagaccagcctgggcaacatggcgaaacccccatctctacaaaaaatacaacaattagccaggcatggtggtggcggtgcatgcctgtagtcccagctactcaggaggctgaggcgggaggatcacttgagcctggaggtcgatgcttcagtgagccaagatggtgccactgcactccggtttgggccacagagctaaactgtgtctcaaaaaaggaaaaaacaaacaaaacaaacgatgctgggacaattggatattcatcttctaaaaaatgaacttgaatccatgctttgtgccatagaaaaaatttaactcaaacagatcacaggtctaactgtaaaacctagaactacaaaacttctagaataaaaaaacataagaggaaaaaaaaaaaaa

SEQ ID NO: 17734 - DNA, 513 bp, Homo sapiens
  misc_feature (1)...(513): n = A,T,C or G
ttccagctngaagccttggatgaanatataaactatttgggaaagaaagaggcagagagatctgttgagagtagactgatggaagagactgacaaaagaagacaaaatgaatctgctatttacaaactacatccctaaggagataaagagaaatgctggaggaacccaaggaatccagaatctaacactgcaaatatcacgccactctgcacattagtgtgcaccaagtgaactttgcaaagaaggatgactaagccccaagttcctggaaactcactgaacagacagaccaaaagagcctgacatctttccttcaaaacaagccagaaaggcagtgtggccctgctgacttgaagctgtacaccaggagcaatactggttaacagcatggcctctatagccagaaaaacatgagtccaatatccagttctgccacttaacttctctgggcctcagctgtctcacctataactagggataataaaaaaataacctacatcaaaaaaaaaaaaa

SEQ ID NO: 17735 - DNA, 361 bp, Homo sapiens
  misc_feature (1)...(361): n = A,T,C or G
ttttccgaaggtgtncttcanncaagttcccctggnctccaactncacacactcatctgagggtaacttttcgtcactattcagcactgagccccggagtctcctctcagctccttgtttgaactcagatgtcacagatagaattagtgtgtccttatgagctgcacccttcacacgagtatcaaaacagcttatttattttcttacatttgtttgcataaacaactacatgtatttttcaaactccttggtaaaagccatgtgctattcaaaatttaatcttatttaactatttttaattataaaatagtacaaaatgcttgttaaataaatgaaggattgaatgttaaaaaaaaaaaaa

SEQ ID NO: 17736 - DNA, 694 bp, Homo sapiens
  misc_feature (1)...(694): n = A,T,C or G
tttccgagctccanctgtaataaacttggccttgatctcanatgaactttggacttcanactttgggttgatgctggaacaagttgacttttggggactatcaagatggaatgattgtattttgcaatgagagaagagtatgagttttgggagggccaggggtgaaatgctatggtttgaggcttccaaatctcatgttgaaatttgatctccagtgttggaggtggggcctaatagggtgtgtttgggtcatgggggcagatatctctgaatggcttggtgcagtccttgtggtaatgagttgagttcttgctctatcagttcccatgggagcctattgttaaaaagtccatcacttccctctctttctctctcaccatgtgatctctgcacacatgccagctccccttctctttccaccatgagtggaaccagcctgaggtcctcaccagaagctgatgctggtgccatgcttcttgtacagcctgcagaaccgtaggccaaataaacctcttttcttataaattaccagcctcagatattcctttatagcaacacaaatggactaagacaaatatgtatatttgtataacatgagttcataatttacttgtgatttttaatgtttaaaacccatatatgatatcatnttctttaataaattattttagttatttgaacaaaaaaaaaaaaa

SEQ ID NO: 17737 - DNA, 633 bp, Homo sapiens
  misc_feature (1)...(633): n = A,T,C or G
ttccgaaaaaaattaaacattncacttnacaattggncaacanccacatgnaaaaactaaatannaaaaacaacagtggcatggaaatgcaatggaatgtaatcgagtggaaggcattagaatcgactggaatgcaatggaatggaatggaatggaatgcaatggaatgcaatggaatggaatggaatggaactcaatgtaatggaaacaaaccaagtggaatgtaatgaaatggaaaggactggaatgtaatggaatggattggaatcaacccaattccaatgcagcggacaaattggaacgtaggctttgaaagctctgaaaacttttctaaggtcaaaggcaagcactgtttaacttccaaatccagggaagaatttttcttcaagaggcagtaaaatgaattaatatcacttgccatttgtaaagccaaaacatgataaagattgcatatttccagaatgcttaatctatttttagtaaatgtatattacagattacatgaattatatcttagggaagctagcagctagcttctttgattcgattcaatctttaaaaaataacattgcaaattctaattttgctttgatttttctaaataaagtattaatngtgtcaaaaaaaaaaaaa

SEQ ID NO: 17738 - DNA, 339 bp, Homo sapiens
  misc_feature (1)...(339): n = A,T,C or G
tttgccgaggnataatnaatcactgtctgcantaaacagncagccttnagaaaaanaagttgnaaaagctgnaagnaaaatacaaaagggaaatactgcataccaagctaaaggaaagcctgccaaaagggagtcatcaaggctgaagaaagtaagaaaatagaaggaagatgaagaggaggaggaagaagatagaagatgaaaatgatgatgaataaattggttctagtccagttttttttttcttatctataaagcatttaacccctgtgtatacaactcactcattttaagggaaacaattgaaatgtgtaagatttgtatttaaaaaaaaaaaaa

SEQ ID NO: 17739 - DNA, 283 bp, Homo sapiens
  misc_feature (1)...(283): n = A,T,C or G
gttttnggnaaaatactcacacacacaaaaaagtcatgtgaccacatagtcagaagtgagaagctggccatccacaagccagnaagaatgctttcaccaaaaactgaatttaccagcatcttgatcttggactctccagtttccagaactgtgagaaaatacattttttttcattatttgagtatattaatgtgttagctatagcatatcatataacatgtaaaacatagtctatagaagcattgtatactaaaatatagatggtatattaaaaaaaaaaaaa

SEQ ID NO: 17740 - DNA, 423 bp, Homo sapiens
  misc_feature (1)...(423): n = A,T,C or G
ggggtttggggaaagtacctccagtcctcagagttttaccatgnaaaacaataatactgttcggacaatgtgttctcaataggcttattggtaacttctttattgatcaaacctgaatctctggtaacatgaagaattgaaaacatctggattctgttagaagcatggaactcacttgggaaactggctgctagtgtattggacattcacagcacagcactacccctgtggttttataaataaacatgaaactcaaatctccaaaacaaccactaaggcctctaaaccaaaacacctctgcctgggcagaggtggcaaagcagtggttaacatacgtccctaatgtcattcattagtaatatttaattatttgtttcagtcactctgaataaaatagtttgttaattattaaaaaaaaaaaaa

SEQ ID NO: 17741 - DNA, 298 bp, Homo sapiens
  misc_feature (1)...(298): n = A,T,C or G
gggtccgagcatncacacctgcnaatttnttncttgtgcaaaatccaacaaccctttcttggggtctggatcaggactcctttcctgtaacatctttctggcgaccactgaagggatgatagtgcggaaacccccgacccaaaggctaatttttggtcacaattggagaaactggctattttaccaaggcttcgactggaatggcataccttaaggaatcatgtaaggaatcatgattccttaaggaatcaaacttgacttgtagagccaataaatgccccttggaaaaaaaaaaaaa

SEQ ID NO: 17742 - DNA, 364 bp, Homo sapiens
  misc_feature (1)...(364): n = A,T,C or G
gtttgagagcaccagggctgacttgagtggtgaaggtggcnagaactgccaaatggaagtaacctaggtccctgaatgacttaatggagcagaatttctccattgatcctcacggaattgtgtcatgaatgtgaaacaggcctttattgtattaaatgcctgagatatttggttggtcaaatctcccctgattaagcagttaatctcccctgacaaacgtaggacacttcaaagatactggaaaaattctttcccttcagtgtgatagtgaatacatggatatttatcttttattattctttaaattgtcaatatatgtaattttactttaaacattaaataaaatatttaatgcaaaaaaaca

SEQ ID NO: 17743 - DNA, 323 bp, Homo sapiens
  misc_feature (1)...(323): n = A,T,C or G
ggtttttttnnnnnnggnttactctgaggaggtgaattatcagaatggaactagacaatgggagcgaaagaaacgaatcataagtctcatactaacacccaacacaccatgtaccgggcatgtgcattgagccatgttggaagcacattttccagccccattcaatccttcacgggactgcagccctgactgacatacttgactacaacctcacaagaaaccctgagccaaaagtgttcaaattatcagctcccagattcctgactcacagaaactgtggaattaataaatatttattgttgcatcagacaaaaaaaaaaaaa

SEQ ID NO: 17744 - DNA, 1484 bp, Homo sapiens
  misc_feature (1)...(1484): n = A,T,C or G
cgaccccagggcccgccaccacaccaccacccgggggggccnaccaaggacaccaccncgactccgcgcgggatccatcactctcgccccccccgcgccacacagangtgnngccntggtttgtagaanagaacacacaccacgcgctagatatttacggcngangagagngnngagaaaaaaagagagcacgaaganagaccaaagncgaccaggaggctggagaaggaaaacangnagggaacgacanagngccagacccgaccgacagcgaagagaaaggagacgagagagagcgccaagntagncacgcgacacntaaccgcagaacgaaagaagccaagcgagcagcgcagcgacgcagatgaaaggagggaccagccgacgaccggaacggnacaaacgggccagcacaaaaagagagagcaacaaagacgagacagaaagaaaccaggacgcccgcccgcgtcgtcgaccccaggacgccccgcgccgcgcccgaccacggagaagagacgcaaaactaacaaaaaagatgaacacaaagaccaactcgccacctgaacaccagcacccaagcacggacggcccaccccacacgccaatcggagaagagggggagcccccccccgcccgcaagaaaacgaacgccgaagaagaccgcgagaaagcccaacacggagccacgcgacacgctagagaacccaaaaaccaagccacacaccagacgaacgaacaagaccgaacgacgaaagagacgcgccgcgcgccagagganaagcagaaagagcccccgagaccgagcgaagagccgcaaacgcagagagagcgcccggacggcagccgacacccgaagccgcccacccacaagacaagaagaaacaaaggagccaaccccagccacagcccgcagaccacgaggacccgacaccgcaccccacgaccgccccgaaaaccccaanagaagaatacacgggacccaccccgaggagaagagccgcgacgaaaacccgcgatccaaccgaaaacccccccccagaccacagccccagccgccgaaccccacagcgccatccgacagcccgcctaccgaacccccgccccaaaccccaaccaacgccccgcccccaccacccccgcgggcggagaaaacccagacacaagcantagaccccacccaccagcccagacagaccggccccgcccgcaacctccccaaagaacccaccccatccgcacggaaacccacagccgccgcacacccgacacgagagagaccgccccggcggaccgcggcaagcccagccgacgggccacgacnagccgcgcgcacctangcgccaccccacccaagacgccacagagaacccccgtccaccgacgccagcccgcgaaccgccccaaacaagagaccccacgcatagaccggcgcacagcagaagagcagcggacacccaaccgcccggcaacgcacagcgcgcgcc

SEQ ID NO: 17745 - DNA, 437 bp, Homo sapiens
tttcggtgcatataaaaacagacacttctgaacactaaaactccctccacttgtaagacaacaaaactggctgaaatcttttcgaaccgatacggccagctggagtttgcacagaacaagcttgctgatgtcacagcctggatttccactgcacgttttatattaactcctccccaaatttgcacatgggacctataaggaagcacaaagggatgactgtgcgtgcctgagggtctttcagacctctcctttcctcccaccaattacctgctaatctcagaatccaccctcttaaaccttttctagtaaaagtattgccttaaaaccagcacagagagatggatctgagcttgactcatatctccttgtaagtcaacttgcaataaatagcttttctttctcaaaaaacaaaaaaaaaatggccttcgttggcctca

SEQ ID NO: 17746 - DNA, 464 bp, Homo sapiens
  misc_feature (1)...(464): n = A,T,C or G
ttttctgggctagggtcctggtttgtagactgcacgcagtgtcttaatctcgtctgcttccattcgcnaagagccagtctgcaaagtaaggcgaagggtaccttactgattggtatagtgcgaggaacatgcgtcttcttgtaggaaattgcttaatttctctactcatggatgacttgctgacccagggtgagagaaatatgatgagggtgcatcacactgttgagggtgatacgacactcccatttcatagctactctcatggggcagacccaacctttgacttttgtataaactatctggcaatattacgtaagacacctcctatttgtagttctgtttcagaacatagtatatggtctggtatatctcataatgaataaagttatagcgaataacattaaaagagggtgccgccctattcgataacaaataaaaaaaaaaaattggcctctttggcctca

SEQ ID NO: 17747 - DNA, 583 bp, Homo sapiens
  misc_feature (1)...(583): n = A,T,C or G
ttttccgagcttagngatgccatggtcgtgnacctcgnctcactgcaacttccgcctccctggttcaagcgattctcctgcctcagtctcctgaatagctgggattacaggcacccgccaccacgcccagctaattttttgtattttcagtagagatggggtttctccatgttggccaggctgatctcgaactcctgacctctggtgatccacctgtcttggcctcccaacgtgctgggattacaggcatgagccactgcgccattttaaagtagacaattcggtggcattatctacatctccaccactgtgcagccatcaccgctatctaattacagaacattttcatcgccccaaccagaaaccctgtacccattaagcagtctctcctttccctccttccagcagctcctggcaaccaccaatatgatatcagtttctattctcttgctatttgaaaaacatacacttttctgctttatttttttcctggatttctgttaataagcatgtgccttgatatgtgacataaagcagaaaccaacagctgacaaaaaacaaaaaatggccttgttggcctcat

SEQ ID NO: 17748 - DNA, 856 bp, Homo sapiens
  misc_feature (1)...(856): n = A,T,C or G
tttcgagtctcattctgttgccagnctggnatgcagtggtgtgaccacagcttactgcagccttgacctcctgggctcaagtgagcctcccacctcccctcccagtagctgggaccacagttttggatatacaattttgtcttatgtttcaaaagaagactgcatagaagagttaacagcaggcctgagaagctcttcttcacaggggtctggaatttgggcacatgcttggcacagactgtgtatgtgaccagccctccataaaaccccagggcgctgagtgtctaagaagcttccctggcagacagcatttcacacacacggctccagcttcttcccgtggagtccaccaggagaggacgtggccagctcacgcctgatttcctgtggaattcatcccatgcaccttctctctttgctgattcagacttatatcctctctgtgcaacaatcttacgcggacaaaaaaaaaaacaaatgcgccttgttggccttacccccggagctcccccgcctcccaccttccatacgggctcatctccgccccacactcccacactcacctaactctcccccgcctcccatccctctccccccccgtatcttcattttatacctccctctttccccccacacccccaatgccccccttttccccccacatcccccttcgcctttccgttacctgccccctcctatggccccccccctccgttctctcaccttcttccctatgcctccatcctgtttcccccccaactccccccttgccccccccctaccatccggttcctccaacacgtccacccttttccccccccttcatgtttccgcattcgcctttaatctaccacac

SEQ ID NO: 17749 - DNA, 757 bp, Homo sapiens
  misc_feature (1)...(757): n = A,T,C or G
tttccaggaacagttaacagtaattacacaagnatctttgaagcctggnattcctgccttctgcagtgggagtgatatctttaagtgttcttcccattgctgacctgcagccacatgaggattaaatgaaatgagataacagctacaagggaaaaagatagcatttctgctgaggcttcatgaagtgggagggaaggataaaatgagaatgtctacatgctatgatttcctgggttgtctgttgtgaagaacacagtgtattccaggtcccagtcccctctgtggtcagccatcagacgcaagctgaaggtgacatggtctgtcacactaaaaatcaaacggtaggagaagcacatctttaaaagtttatcacagaagaaatgaggaagacgatgaaacagaggatcatgatgattatcataaactagctggggatcccttggactttaactcagagctccaccctcttattctacagaacaaagcaaaacaaaacaaaattgacaaatataaagaaaattataactcataattcacaaccatggataagtattattcatattttggtggatatcagtttttattatgaaaaattgtatatncattgggatcataattatacataatttgatattggctctttacacagaataacataacacaagtatttttaatgtggataaaaatcttaatatgttgataatctattgccttattaagaaatataccataatttaatgaatcaaaaaaaaaaaaa

SEQ ID NO: 17750 - DNA, 396 bp, Homo sapiens
ttttccgaggtgatgatgccacgaggctacatgaacatgtgcataaggcaatagcctggaatgcaaaagcatataaaactaatccagctgactgcctatgaaaccaggcatcacagaacatgcgcatggaccctaaaacttaaaggaacaataaaaactaaattaaattaaaaaattaaaaagagatttgcaaaaaataaacaacagtgcaatgtctctaagacttttgttttggaaagtgtcatttatttcataaaagtatgccctttgtgttaacatgcaatgggcttattttttaattaagtaatttaaaaatgtatctgtttcaattttaatgtgataaatatggataggtgtaccccaaacaaacagaaactgtgtggaaaaaaaaaaaaa

SEQ ID NO: 17751 - DNA, 508 bp, Homo sapiens
  misc_feature (1)...(508): n = A,T,C or G
ttttccgatgaanctnctgcnctttaccccacacaacaataagccctccggnacatcgcttcaagcagacacagtccactgcagaccactcgacatgaagcacagaagacttcgggacagggctggcctgaagcttcgtggtccctgtagaagaaaattatgctctcactgtgtaaaacaaaacagtacgatggtgacacagtaggaaagcaaaagagaaaatttcaatactagaaagcttactgatttgtttcagattgaattattaatactcatatgatacacctagaaaaaatagtatccaagagtaatagtcctatgccttaacaactatcttttaaaaataattttagaagtatttttgcagaatattttaactgaatttgctattttcattccaaaatttgtcgtttctttgatcaatgactaattacgtagagcaaagttcttcatttaaattctatgatatctgatcttgctaaaaatacaccaganaaaaaaaaaaaaa

SEQ ID NO: 17752 - DNA, 908 bp, Homo sapiens
  misc_feature (1)...(908): n = A,T,C or G
ttttccgaggcaccctagagnacactatggcttaggtgagctagcctctgacggagagtgcggggncttcacccttcctacgtaccacatcatactcacatgacagatactcctactcgaaaaccatcccttggcaggacacacctcgcataatgacactcttagagaagctgtgtggtgctcccgtaaactgacatgcaggacctcattagatgtgtgccatagaaccacaagcaagctcagataaatgactaggaagcaggaagatgcatctgatggcttctctgcatgaagaccaaataaaaggaaccttgtacgtggactctttttaaaaattaaaatttattttgtttcttgcatcttatgaacagaggcctctctaaaagtacaaaacattcataagagaaacctgcatacattttgatattaagaaataattccggggattcttccactcctgaaatgagttgatttggggatttctcacaccttcttgaggtaaatgggagcttcatttctctgaggggtgggcaataaatatgacccccaacatgcacaactctctcaggacttnttttgctccatgattctgacagatacttactgagggggtattttgcttatccccaaanaacgggggaaccccgagaaaaaaattgttgtagcaggcgcctagaaggcggaagccaccccnataacccccgctttttcgggccttaccgatgggggtcccccgcccggtcccttttaaggaggggggatcccccgctccgggcggggtgaaccccggggcgctttctataacccggcgggtacccccttaagccctctcaggggggctctttggtttctccctgcacctggggtaccccccgaggaattcttctttttaaaggacgcgccgtgtt

SEQ ID NO: 17753 - DNA, 495 bp, Homo sapiens
  misc_feature (1)...(495): n = A,T,C or G
ttttccgatggtacagctaanaaccataancaccgctgcatgaaacgggtgtttgatgaccggcaagactcagagaagcaaaaggtctaatcgtgctgaaccagcaaatgaagccttcaatttggtattctcatcctgcacaagcacttacttatgcaaacaggcattctctgcattagtattactgacgtaaaagaaccgaaacagattatagatctggacctgaggctacatctttctaatattaaaaacccacattctgaatttagtttctgcaaaacgacatcatccatcacgctaaaataatgttgttaatttgaattttattgagtttaaattttgtttgtatttaacgtgaaattgtgttttggttttatagtcctaaaagaaccataagcatgagttgtcagtttattctgagttttatatttgtacatagttaaataacataataataaaaatatttacattatcaccatgggaaaaaaaaaaaaa

SEQ ID NO: 17754 - DNA, 289 bp, Homo sapiens
  misc_feature (1)...(289): n = A,T,C or G
ttccaacctcaccctgcattttttcttgtgcaagatccaaaaaccctttcttggggtctggatcagacnctttctgtaacatctttctggcgaccactgaagggatgatagtgcggaaacccccgacccaaaggctaatttttggtcacaattggagaaactggctattttaccaaggcttcgactggaatggcataccttaaggaatcatgtaaggaatcatgattccttaaggaatcaaatttgacttgtagagccaataaatgccccttggagaaaaaaaaaaaaa

SEQ ID NO: 17755 - DNA, 812 bp, Homo sapiens
  misc_feature (1)...(812): n = A,T,C or G
gcctgacggctnctattcctactttctggnagctggnacaatggnatgaaccaaatttgaaccaagtggagaagatggcaatatcnctggatatggtagagggacaagatagatgaaacctggatccctgagtgatgacgcggaactgagccacccctacatcttggaatgctcacttttaggctattttaagacagacataaaactccaagtgctttaaaatagtatattttgaaatgtccttgttagagcagctttagtttgtttcctaagtggtacaggcatccacagaatttcatagtgagtaagaataccatgattaaacaataatctgcagcatacagctgtggaaattgcctgtattttaaagtattttaaatatatcacaaaacaaatatatttttccagttagttggtatgacaatatttaaacacttaactttttctaaggggggaacctaggcagttgaaccttgggaaaataatgagggagcctgaaaatgaaaaaaccttcccttaaaaaaggggctttttgggcgagaggtcttggggtttaaaaccaaaaaatttcccccggttggggccccctctatcgggtttttccgggggaaaaacccccacccaccttcccttaaaaaagggggggggggagaaattttagagagtctaaaacacccggggggaaaaagtgtcttttgggggcaaaacaaaggggggggaaaatctttttttttttttttcaaaaaaaaccccgcgcccctctttttttcttctttcccgaactgggggggaggcgcccccctcttttaata

SEQ ID NO: 17756 - DNA, 780 bp, Homo sapiens
  misc_feature (1)...(780): n = A,T,C or G
cttgcggctaaagcaacagtacacangagtgagtgacttgctgaagcctaaagacttatggagaaaaaaaatatagttgctttcaaaaagagaatgtacagtattagaaagaagactaggaaaagaaaccagcaacactcaatgattttatgaagccaaatgtcttcaaataattttcttctagtctataatgtaagaatgttaaaaccgtgtccctcaaggttgcaatatacattgcatgtgtaaattgtatgtataattacaacataatggaaatgaatatactacacatttctctcactttcgaatattggttttgcaccaactatttttggtttccaaatagagtgaaatttacatccagaatttcattgtatcattaattatatcgacagcttaaggaaaaataattatattaaccaataaatccagttgttaactacatgaaatacataatcttgcttaggtgaatgttttccagaaattaaactagggaaaaagtctctaacctttataagattgtatacctaatgttgctggctgtttaacctgagaactaaggggccacaggagtttatctgccagatgataagccttctgaggtcaagtgagcctgcgcatatccgcttctaccctctgtagtcattgcataactntattgaatgaatttggctgctataaggttgataatctcatgtgtcctatgttatctttattaaaatctttgattcttttttnnnnnnnnnannnnnnnaaanannaatggcctcgttggcctca

SEQ ID NO: 17757 - DNA, 1061 bp, Homo sapiens
  misc_feature (1)...(1061): n = A,T,C or G
gggccggaggggcccgctttgggggnncgaaanaagatttaaagtctttttagaaaancgcccctttttgttatntattannactnncacttgtggtagagnnganaactanctctgntnattnactctnncaagtctttttggaaagtaaccacctgggnnaaattncatncgnncaaaaagaancatttcacctnaggcaccactcgtcgtncagggtctattcccaaagttgaagcatgcaagggaaagaatcttaagagctgtgagacagaagcaccacgtaacctataaaggaaaacctatcatattaacagcagatttctcagcagaaaccctacatgccagaagggattggagccctatcttcagcctccgtgagcggaacagttgtcagggcaagcaattttgtgtccagcgaaactaaacctcatatatggggcttagctctttattcgggtgtctattggtgctgctcaggctgcgccccctttggccgtcgcgcgcgtctcctccgttgagtgttgggtgctttccggcgtggcgtggccgcctctgtctgccgcgctgcctgctttctccgccgcccgcgtctcccgcgttctgtcgcgctccgcttctcgcgcgggcctcgcgctcggccccttcctcgccccttccctgccccccccccctctttctccgtccccctgccggcttcccttccccccccctcccccccccccgccttctcctccttccccctcttcgtccccgcctgtttgtcccgtcctccccgttcttcgttccgcgctccctcttcccccccccgctccccctttggcgtcgtctcccgcctgtgtcccccgtcccgcgcgctctggcccctcctcccccccgctcccgcctgtccccgtctcctcgttctttcgccctcgccttgtttgttccccgtcctctgctcttcccttgccgctcgccccctccctgccgcgtccgcccctctcccccgccttcgcttcctcgcgcggcctgcgcccggccgccccggccaccgttgtcccccctcccacccacaaaaa

SEQ ID NO: 17758 - DNA, 362 bp, Homo sapiens
  misc_feature (1)...(362): n = A,T,C or G
gcaggaggcccacgttggggttgggagttttagtttttggnnnagcactctgttgaactanccaggtttgagggagnaatacctgctagccanaagngacactcttagcatcttacctcaagtccaaacattgaatctttggagagaattattctgcaaagactaagtatacttatcctacagtagctactcttgtggaggtaaacaattgtgtcttgacctagaaacaaaatcttggtaagaatgcaagatgtcagagtgttcataagagagtgaaataggatttatactgtctttttcatgcagcgacttcgatatgactcaataaacaccagtctcttacctgnnnaaaaaaaaaaaaa

SEQ ID NO: 17759 - DNA, 940 bp, Homo sapiens
  misc_feature (1)...(940): n = A,T,C or G
atcttcagctanggaccagcggttggtgtnaaagaagggcagcacagacaaanatagcatgttagcatgcccagtcccctctccacgctataccctgtgccgcctgccgacacttcagagaccagggatgaggccctcaccagaagtgccccctggatcttggacttcctatcctccatagctggaaggaataaatggcttttctttcgtcttctcttttcgggggggggcctcctgcgcggggcgggccccggcggcgccgggggggggggggttggatggttgtgggggggggggnggggggcgggggcgggccgcggggcctgccgggggtggttgtgggggggctgccctttggggggggggcgtgcgtcggccctggcccgctgcttggctcgcgcgtgcgcgttcctcgcccctccgcgctttgttgttctcccgcgcctcgcgttcgtttttgttcgggcttggggggggggccggggccgtgccgcgggccccgggcgccggcgtgggcgggctgctgggggggccctgcgtgtgggggggctgctttggctcgcggcccggtngtccggcggcccgtctggcgccccggcccccgcggcggcgccgcccgcgctcgtggcgcgctcgggcgtgctgtggctctcttctctcgtgggttgtgtttgcggccctctgtggtgcggccgctgcccttgcttcggcttttgccgcttgcgcgttcgccgcctttttccccgcttctttgtgttgttgttggggttgttgttgcgcgtgggccggcgtttccttgttggccgtcccggtcggtgagccggtagtgggttcgtgtcgcgcgtcgcctcctccggttggtgggtcttcccgagtgnccctttcccggtgcattcgttggggcggtgtgacggtaggaaaaaaaaaaagagagggagcg

SEQ ID NO: 17760 - DNA, 1562 bp, Homo sapiens
  misc_feature (1)...(1562): n = A,T,C or G
gtcaacatcncaaagtggngaannannncncaccccatttcctgcntnnngnngnnnggggnnnnaaagngncctnttcaaacgtttatgnnngnnnnnncccnccnnnncntttttctncnctcnncctccntgngtgttnttcttctttctctttctccnttttcttctnctctcctttcttcctctcctcnttcttcctcccttctctctcttctctccncttcctttttcttttcttttcctctttctccccctttctctcctctctcncttttcgtctctctccctcttccctcctccttctttttctctttctttccttctgcgccttccccctccctcgcccgccgcacgggcggagaagaaattatntttactcttccccnctcccgccccgccccttcccccccttctcttccctcgtcgctccttcttgttttttttttccgtttctctttcttttttcttttttttttctttttttttcttttttttttttnctctttttgtgtgtgtttttcttttttttttcttcctgctttttttcttcttttcctctccttgtttctcttcgttccttcctgttttccctctccttcttcttttcttttggtttgttcttcttttctttcctcttcttttcttttttcttccgtcttcgtgtcttcctctaattccctctcctctgcttttcctctttctctcttactctgtcttctctctctctcctctcttctctttttttttttcgtttcttttcttctttcctccttccctctccccntcctctcttctccgcggcttccccgcccctccccgcctctgtctgcttttctttcctctctttaactctttcttgtctgctcctctctctggttctctcttgcgcgctgtctcttcgctcttctttctctcgcttcctctctntctcctttgtncnctcctccaccgccgcgcntcgctttgcttcttntctcctccgctcctctcgtgcctgcgttctcgctctcctncgctccccgcnctttcgttgcccagttcgttgttgtcgtgtccttctgcntgttctctggttctcctntctctctcgtgnttgtcgcgnctttctcgtattggtgggtcctcttcttctcttttcccctcctctgtgtgctntcttttgtgnnctgcgctgtcatgcgttcgctgtgtaccgcnntgtattctgcgctcctcntagttntctcggcatcngtgtgtntctttagaggtgntcggtgtcgtttttctntntgcttgtntttttgctccctttgtattatgggtgtgttgtgtcttgtcttatcacgatttccctcgantgtntcgttggtctcggtgtccgtcggctgcttantggtgtatgccctgttangtctngtctcgttctggtgtgttggtgtagtttntctncttatgtgcgtcctctctttgtgtcccgatttgctcgtgtctngtctcgtgttgtttctgtgcgtgtcgccgtggtcggtcgcgntagtaagtagacnagaagtgntctcttcaacggccnntntcta

SEQ ID NO: 17761 - DNA, 772 bp, Homo sapiens
  misc_feature (1)...(772): n = A,T,C or G
agggcctggaactgtgccgggtcgatgtgccttcttgccctgtctttcttggtggaaagcgtgagtggtcgctttgggcccatcttataagggaacaaatctcactcgtgagggctttgacttcatgacataatcactcccaaagtccccatttccttatgtcattaccttaaggttaggatttcaacatatgcatttgtggggacataaatactcagaccatagcagcggtcatctgcgagtcgagaagagagaccacggaaaaaagcaaacctgtcaacacctttagcttggacttgttgcctgcagaattataagaaaataatagtgtgggggttgagccacccagtttgtggagctttggtgcggggggtgtgacgggggcgtgcgtggggatgggacgtgggccggaagaggtggctgtggtgacgaactgggaaagaaaatggtgagggggttctggttgaggagaggagtaggggcggtaccctgtggggagggggggagggtagaggagagaggctaccaaggcacacgcgtcgcgccgngtgttctggcaggtcccgctccgtgatgcgttgttccggtgcctcgcgcgggggcccgggggcgctggggtctgctcgttttgtccttgccgcgtgttagccgctgtgctccggtacctttgtcgcgtcttccgcccccgcgtgtggcgtcgtcacggcggggcttaaggggcgtgcgtacctcggctcctctctcctacgggagtgcctacgaccgggagaaa

SEQ ID NO: 17762 - DNA, 227 bp, Homo sapiens
  misc_feature (1)...(227): n = A,T,C or G
gtatcctgatnncagcacacatgtgaggagaagatagcaacttcctacaacacgtanactttagtctacctgcacagagtttcacataagaagatacgaaaaacaaatgggttggggaaaaaaaagaagaaacagttaagaaatgtgaatggctctctagtcatgaagacaaaaatatttgagttaattataaatagaaaaggcctcattttataaaaaaaaaaaaa

SEQ ID NO: 17763 - DNA, 961 bp, Homo sapiens
  misc_feature (1)...(961): n = A,T,C or G
gttcttcgtatnataaccagacatccggttatgtgnaaaactgttctgnagtttgcagccctcttacactcagnatgacaacaatcaggcttttggattttggatgacaagttacagcacaacaatggaatggcctcctttactgtgtcaagctggcgacagatcagtagcagtttgtgaacttacgtttagtttcgaagacccaccatcttcgcttgctcctcgctcgcctttctttttttcccgcgctcttccggtgcccgccttctttttttcgtgttcgtggttcggtcttgggggcgtcttcttccgcccgccttgcctcccctttgccgccggtccccccccccgccccccccctcgtctgccctcctttcttccctttcctttctgcgtggtggtcttcttccgttttcgccccccttcccccccccccgcccctctcctccctccgcctcctcttccccccctctcctctcgccctctccctcgcctctcccttcccttttcttcgtcctttgtccgcttgtgcctcttctcctcctccctctcctccctccccctctctctcttttccgccccccgtctcttttttgtgctgctttcctcctctcgctccctcgtcctcccccctcctcctctctcctccccgccccgctcttgctgtccccttccatctttatccggtcggtctctccgccttcctcctgcccctccgctcgccgcgcctcttttcccgtgctccccctttccctcccccctcttctccgcttttcttgtttcttgcgcggctgtccctcccgccgctcttccttttttccgccccgcgctttttttcgcttttctcgctctcgtccttcccccgccccgcccgggttttctctctcctccccgcccaccgttgccgggagtccccgtctccctcccgttacgcgcttgttgcctcgtcaaccaacactag

SEQ ID NO: 17764 - DNA, 242 bp, Homo sapiens
  misc_feature (1)...(242): n = A,T,C or G
ggttcaaccaatctacaaaggccaaaaatattttcacaggccccccaaagatgaaactccatctgctgcccctaaacgcattctccactgtnctgaaagatgtgcanaggcgacggcacagcgttcttcatctcaaatcctccaagtgctgtcagaaataaagaatncccaccaaagcccccaggaatcttctgtctgtatgggttgtnatgactgaggtattcaaaaagattctggggaac

SEQ ID NO: 17765 - DNA, 1055 bp, Homo sapiens
  misc_feature (1)...(1055): n = A,T,C or G
cggccggtgggggccgcttgagcgccgagnagtttagagttttttggcnncngnnngtcaagtaggtaaaatgcgttgtttctgtttagtgctgattaccagtgtagagaataaaaagacaccttcaacatatgtgtcatgcgtactcgagtgagagaatgacaaggaacaaatcagcatctcaaggttgatagtggtgttcactaggagacgtggaattgagactaataacttggatgttaacactggttactggtttttcacatgcagaaatgttctttgtgtattttttctacagaggattttctctgatgctactttctttgtttctggctctgataatccgccggaagcctccctcacatgagctgtcgcccatctcctgcgttttcgcccaccgcgactactatccatctccctcacccacgagggctctggtgccgcccccgccgacttctgggggcgctcttcctccgctggcgcgcccttcccgtcccccgcccgtgcgcgggtcggctggtgccgccccccgcgcgctgccgctccgcgcgccccccgcgcgccgtgcggccctccccgtcagccgctggcccccctgccttccctccgcccagacccgcgcgccgcgctgggcccccccggccgcggctccccccgcccactgccgcctcgcgcgcccccccccactacgctcgcgtccgctcccccccctcgcgccccgcgctccgcggggcgttcctccgcgcgcgccgctatttcgtcccggcgctcccccgtctgtgactctacctggcggcggttgacgcccgcgccccgcctcgcggcgcccaccggtcgtacgggtctgcctcgcttcggttctcgtggtcgccgcggcctagtccacgctgccctcgcgccggcgcttggttcctgtgggccgtccgccgtggtctgttcggggcagccggcctccgcctgcccgtcctcttcgcccgtgtagcgccacccgcccagtcgccattgccgcggtggcgcgccgcgcccgcctcgagaccccacgccccctcccacca

SEQ ID NO: 17766 - DNA, 945 bp, Homo sapiens
  misc_feature (1)...(945): n = A,T,C or G
ggcagaggggccgccaggggcagnnangnttnagtntttggncttgccttggcggatagngacatgtaaaaggnatctggnacatanctgcaggcagggcatattccctgtttttagtggatacagaagacttccagcctgggttatattacagtggccgacaggaccctacagaaggtgacaaccttccagagaatcacagtggttctaagactccagtacttctctcctgcagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggaatttggtcatcctgaagcattcaagtctcttcttggatagttatacagagcaagtattcagtcccgtgtcatgatcaatctctgcagggttattctgccaaggagaacagctccttatcaaaagagactagattagggagagtgatataaggtaatagaaattgcaaaggacgattttaatcttaaccaactatagctctggattgctcaaatttagacttgtctaaatgaaaaacaattaaaaataataaatattcatgtcttcttctttatcctggcacagcgatcgcctaatttcactttacagacctatataagagtgggctttaaaaaacaattttggggcttaatagactgagctaaattctgggagaaacgggaactgaacaattattcaaaaac

SEQ ID NO: 17767 - DNA, 2234 bp, Homo sapiens
  misc_feature (1)...(2234): n = A,T,C or G
gggcccacgcagggcgggcncncgcctatagtccgccaggacaccaggttttagaggtcctatagngaaannaggnnnccttgccagtntatntnagnatagancannaattgttttatgtgtgtnnggnntatggncncnagctctngcaantngnaagntntgtgtgattgcattgagcggcnctgcgcnacnctngngctgtgtgtngaagagagaagatcatttgatgtgtggganaccaggcgaaaatgctgtgcgtgagaaatggatgatgtgtgggtgtgtgtgtgacagagagctgtagatgatgtgtacgtgggcgacttggctgtggacananacacatcggtgtggcagtgcgagtgtgtgaaagtgagacacagctgtgtgagcgcgtggngcgngctgattgaggcatggcgaaananagtgagtgagtgtggcgtggtacacacagagacacacacacagagacacatcgtagacacgatacagaagtggtagacgccatcaaacacacgagcacagcgttagaacnatacgttgtcacgagaacgccgtagctgtacggcactttatgtgatgcgggcgaagggtgtagntganagatgtaggagtggacagtgaggccatgagagaggtagagaccgtgagaagcnctaggaggtgttnagacggcgncttnagcagcgacgagagcgcgnctccgcgcggncgcttggtgctgcgcgcnctcgacgcncggcngtgtacgtcgcgtnntggcggtcgcgtgcctttgcgcgccacgcggcgcgcgtgtcngntnacatgccgccgtgcgcgtgttgttcgcgngtcgccgcgcgcgatcgtcgcgttcgcgcgggtgcgactcgggcggctgccggcgtgngcgtacgacgtcgcgactccgcgctcgtgcggcgtggncctgcgccgcgcgcgactgtgcgctctgctgcntgctcgttcccnctggtgcttctccgccnttctncncgctgcgcgcgtgtgcgncngncgntgcaggcggcgatctcatntcatcgtgctccgtcgtcgtncgcgggtnngcgttccngctgnctggcgatcggtgncgccgcagctcggcgtccntcgncgcgtctccgtntgtgtcntcgcgcctgtntcgtgctgncnncgcncgtcgagtncttcgctgctcgcatgtcctgntggccgcgtcagnttgtccctgcgtgtgggtcgatgtagcgcctcagcgtgcaancactgcgctgcgngctgttggtgctggtntccggcgctgcgtgtnncgttgtttngtctgttcgagttggcgtcgttntngctntttcgctcgccgtcgtcttgcgcgcnctgtacgcctgcgctccgcagccgcntcntgtccgtgtacacntgtccccnnctcgcctttcgtcgcgcncncncgntcgctgctgcgtctgtcgttctgcttcgcttcgcctccctcctcgcntcgcagngncngagtgctncgnctcgcctcgttccgntctcccccgttcgtcgtcgcncccgacganctgtttagcncgtcgcgncgtgctgcgttntgctcgtctcgcncntcgtcntcgtcttggnccngtcacgncngtctcgtcgtgtcgctcntctctctgttactctctgcttnttcgctcgtngtgcgctgtcgccgctcgtgtgctcgcgcngcgtctgcgtcgcgctctgcgtcgncgccgtctcgtcgnactctggtctcntgcgtgcngctgctgcgcgcgcatcgcgtcntngcccgcgccgtcgcgttccntcntactacgncnttnacncctgctctctgcctactcgctatntntctcgncgcggncgtngcacgcacgctctntgccgcggcccgcgtcntcgtgagacntgtgcntgtgctgtctcggcgcgtcgcgcangctcgttcgntntntcntgtgcgctcctgcgttcatactntgtgngttgtgatcggctcgggtgntccgcgagnggtccgcgcgngtccncctctacagctanctctttcaagcgctctcgcgtcgaccgctgcgtcgtcgcgcacnagtacgcggcncttcctntnccgncgncggnccgccntcgcgntgcctctcgncgctcatannctcgntncacacnctcgatcgttnttcgacgcgcttcaacactacatgcgatacgcgacatacaccacagca

SEQ ID NO: 17768 - DNA, 1089 bp, Homo sapiens
  misc_feature (1)...(1089): n = A,T,C or G
gccaggagggggcccgccaagcngccgcaaangtttgagtctttaggaaaagnngttgccgtgttttgaaanaccacatttttttgngattnctgcaagaaaacgctgcatnccaggaaaaatcaggatcccagcaaaaaaagactcaaaaaaggaatctgataaagttgaaacattgcatgactgcctgcggaacttgcatatgcgggatgctgcatttgaaaagtcaaactacttggaaaacaacgtgtgggcagcaacagtgatgcagagtaaaaaattattttaaaaacacaactacatattttaatggatatgaacttaatgttattacctgtgtaatcacacacacacacacacacacacattttaaaaccccatcggcctaggtttatcaattataaataccaactattttattacacacatgacaggatatattgcggaccttaccccatgatggacaaatccactgaatggagatgctgaaagggtaggtgagtgcgcgtgggggcgtgtgggtgcgggtgggcgatagtgctgtgtgtgggagtccgttaaagtggcgcggtcggtaggggaagtctcggcggggcaccacgtgagagcgctcgacggcagagtaaagcagcagtgcagcagccagaccagaggaggcccccccctatcgcaagacggccgggtccccccccgcccagcgctctatcgctccctttctcatcacaaccagtcccactgcgtaggcagcagaggcgagaagaacgcagttgtaccgatgcaccgtggcctgctctacctaccccgcgttccccttaccatatactacccctctcacgttccccttcgttctaccgcctcctcccctctggcttcctctgtgttctctcccgtatcctccccgtatctttttcggcgcccgcccactcgacgcggcgcgcccctcgcgcccgcccaagctacgacaccccctctccctctctnctttgctcttcactccccgcgtacttcgcctctgaccatctcgccgcactgcccacaccccaccctgcaagcagctccaccacgattatagcaaaccacacaaataag

SEQ ID NO: 17769 - DNA, 965 bp, Homo sapiens
  misc_feature (1)...(965): n = A,T,C or G
ccttggcggggtccactgggtagacttttcaaaacagcananaaaatgaccatcaaaataaaaatgtgtcatcctcaaaacaagcctctaaacaggtcagcactgaaatttgaaagcacattgacataattgaggaagagcaagaaaaaatgtgtccctgtagaacatgaagatgtattgtggcagaaggagaagttaaggcacctagaaaaatgagttgctgactgcctgtttgtgttattcaagaagcatggcactagcgtctgtttctcatcagggtttcaggctgcttttacttatggcagaaggcaaaaggaagctggcatgtgacaagttctcatggcatgagagaaagcaagagagagagaaggtgaagcaccaggtcttttttgtttgtttgtttgtttgttttaaccagctttctcaggaactaatagagcaagaactccctcctcaggtctcactccaggacattaatctattcatgagggatctgctccttgacctaaacacctcccattaggccccacctccaacattggggatcaaacgttaacacaagatttggtggggacaagcacccaaactataccatatagttagccaactaatccagcatatttgttcaggaggatatccttttcccactgcactgcagataaacctttgtcatatgtcttttgatgtatgtatantgggtctgtttgggcgcttttgttccattccatttgtcttatttgttttcctggnttcagagacacgtatttcttgttatatctaaaacatagttttgagatctattagttaaggtngtaaattttttgctttcctcatatcaccttggctattcattnttacattttcatataaatttaagaaacaacctgntagttttcatacccagcaganatacctaatatnattactgctattcttatnnatgnnactatnataactttaggggg

SEQ ID NO: 17770 - DNA, 966 bp, Homo sapiens
  misc_feature (1)...(966): n = A,T,C or G
cccctctcttagtananactcgcncttcttaggactgggnacaggaagccactggagtacctgacttcaaatgaccctgcacgttttctctttggaaagaaagcactgggaaaaccatgctcggtaccttgaggcagaaatgggaaacaaatcaagacattgagaatgccgcagtggtacaggtagtatgcaaggttcagcgcgagaagttttcaagatggtgggcctcactggccggagatgagaaaagatcggagctagacttttgatgtcaagtgctgcttaaatgaaggcgacccctgcaaattaatgagaattgaaacttgcgttgctttgcaacttgattgaatgcttactatgtggaaaccactgggcaggataggggaagaaggaggggaacacaggcatcgggaggctgtggttgatgagtgggcgcggggcgggggggcgcgtggcggggcgttggaggagaaggtgcggggggggggcgcgggcggtgggtgcgcgggtggggctcggcgccccccctccccgccctttacgctcgcgcccccgcacccttggtaactcccggcgccggcggtgcgccgccccgtatcgctccgctcgcccggctcgcacgtgtcgattccccccaccgcgcgcgcccgcagcgtcgctgccccacaccacaatgacccccctcccgttcccctcaccccccccgtacccacttacccgcaaccacacacgcacgccggatccccctgccgattccccccccacggcacccctcggtacgcaaccgttcccgtcgatcactgccccgcatgcccgcctaacccctactctcccccccctccgcacatgcgtagttgcccgtgctccgtcttctctggcacgtcctccctctgtccctcaattggctctccttcgttctctgcatccagtcccctacacgcgctcataccnttccccaccttttat

SEQ ID NO: 17771 - DNA, 1012 bp, Homo sapiens
  misc_feature (1)...(1012): n = A,T,C or G
gcctgagggggccgccaggggcngcanagttatagtctttggnnnngnncctgcgcggagttaaatcactgcttagntagaactgnaaccanatgctctttctttacttctaattaacctgttggactcgtcacttgttcatctttctgccttcggctacgaggctagacatatttactccctctccttcactgtacatgaatacagcaataaataaaaatcatgttcttcccagaatctagttcttgctttgtaaatagctagctatttttgttttattttatattttttatcatgttacttctgtaattgtttactgtgatttttacttagatttaagaaaaaatactacatttcaataattttaacttacatgcattttcttcatctttagaatttttctccttttcactatgtagttcctgcttcactttcatttgttattttctctattttttcagggagtcaaactatcaataatttacacccaatatgaaacggatttatcaattgttcttttttttaattttactttaagttctagggtacatgtgcacaacgtgcaggtttgttacatatgtatacatgtgccatgttggtgtgctgcacccattaactcatcatttacattaggtatatctcctcaccatgttttgaaacttgtgattttttttctggtagtatgctttacttccttcccttttcttttttgtatacctgtggcatgttttgttctgctttttaatttgaggtttacatgagctntgcaaaactttaaaattttatacttacttctgaaattattggtttctaatttttaaatttttaatttttaagatttggggccacatagagagtattgctattttacagggtatgtggagactttttgatacaaacatactgctgctaaaaatcacatcaagcataactggggtgtacctcacctgcagccctaatgattgctttgtggccaaatatccaaatatatcctttaacgatttgaacagaa

SEQ ID NO: 17772 - DNA, 442 bp, Homo sapiens
gcttccagctgtctctctttgttatcccatgcatctttactgcatacccataccttggtccgttgtggggactcggctgcaccaggacgaaccttcccattctacataagctgccaaccatgaccccggagggaatggcacttggccaaatgaaatccacacattactgtttgttatcttaggatattttacattcttgttaatatttgggtttgggtgaatgttacgtggaacagaaaagtgagagagaagaaataggttgtaaaatgtgaaaagggagtaaaataaagaatgctttatttctaaaatggagaagttgagaaacgggtaaaataatatgaggagggcactgaagaatcattttttatggctctattttctattaaatctttcttttgatgaaaagaaataaacataaattgttcctgcaaaaaaaaaaaaa

SEQ ID NO: 17773 - DNA, 335 bp, Homo sapiens
  misc_feature (1)...(335): n = A,T,C or G
gcagggggtagttagggtgagagataggtctttggnnggcactccgagnaaaaacgtcctcctgatatacaagagatggttccaggaccgtacaccccccgcacctaatccacgcatattcaagtcccacggtgggccctgaggaacccgcgtacaggaaaagttggctctctacatatgcaggttttatatcctgtgaatagggtatttttgatctgcctttggttgaaaaatatctgtgtataagtggacctatgcaactgtaatctcaaatttacagaaagttacaaaaataaaaacagtacaaggaaaaaaaaaaaagaaaaaaaaaaaaa

SEQ ID NO: 17774 - DNA, 543 bp, Homo sapiens
  misc_feature (1)...(543): n = A,T,C or G
ccttggcggnctaggaactttatgcttcatgttgcccagnctacagtgcaatggcgcaatctcggctcaccacaacctccgcctcccaagtcaagcaattgtcctgcctcagcctcccgagtagctgggattacaggcatgtgccaccatgccaggctaattttgtatttttagtagagacggggtttctccatgttggtcaggctggtctcaaactcctgacctcaggtgatcctcctgccttggcctcccaaagtgctggaattatagacatgagccactgcgcccagcctcttttttcttttttcttttttataatgagcaactattactcctgtattaaggaaaaatagtgttttaaagttctttgagcttgtataaaatgttacatcgagggaaaaaaagtagacaattatgacaagaggccaaagagacatgagtggagtgccatatttatttttctgtagtgctgttcaatataataaaatggtgaaagattaactctcttttctaataaaattattcttactaaaaaaaaaaaaa

SEQ ID NO: 17775 - DNA, 296 bp, Homo sapiens
  misc_feature (1)...(296): n = A,T,C or G
gcactcgcggantnctcatatgccagggtattgtgctgtgnnnctgctggnagnnatcaaattncagtncatggnatcagnaggagaacaactgaacgttacactgcaatcctgggcttggagatgtatctggaactgtagtgtgaagataaggccagtggcaagaagaagagaccaaggactcaactaaaactgaaggcagagcaagaatgtatcacggttgtagcccactcttcctttggacgtcttggtcagcggcataataaattttattgtttaaaccaaaaaaaaaaaaa

SEQ ID NO: 17776 - DNA, 356 bp, Homo sapiens
  misc_feature (1)...(356): n = A,T,C or G
gactcgagtaaaaccccattgtactcttgttgggtttcatggaagaaagacaanacatgctttgaagcttggaactttcagccccagccccattctccatggaggagagaggagctgaatacggagctaataatcaatcgcgcctacatcatgaagcctccctaacaatccctaaaatatggggttggtgaacacatccatgtgccaggaagatggcacaccacaactccacagtgacagagctcatactcaggaactttgcagaccttaccctatatacctcttaatctggctatcatctgtatccttcataatatcttttacaataaactagaattttgtgaaaaaaaaaaaaa

SEQ ID NO: 17777 - DNA, 990 bp, Homo sapiens
  misc_feature (1)...(990): n = A,T,C or G
cggcaggggggcccgttggggcagaaagataagttttggcccggccctggcggttncaaaggnctgtaganaaaanacatttatgtcctgnnactacttcaggcctggnaagaaactccagaatccataataggcaatttcctggacataaagtgaaaccacagtataaccattcccagnanaaataactgtttcaccttcttatagagactcacaaaagtggagattccaagatatccttcagttacttcaaatgttaacatccctcaatgttggcaaatgtgttctgatccgtagagtctcatgttcttattaaacctgttctgtttgttcctcaatgacncacacacaaaaacccccacttccctccctcccctcttcttccccttacccccttcctcctctcctcctctcctctgctcctcctccgcctccccccaccacccaaaaagacggccgcgatgccttccaccggcgacgtcgcgggccttatctccccttgggcggcgccccccacagggtcctccctccctgtctcctttgtaccgcgcgcactgcgccggcgcggggcgggctccccgccctcccccgggcgccccgccggccccccccgccttctcgcaccctactcccccaaccactcccccatacgcgtcgcgttaccggcccagtcgcacgccgcccccacgcgtggtagcgcgctcccgtatgtccgcctcttctcgtctccccgcccgcttccacggccacttcccccccggttccccgcctccaacgcgctgtccgctgcgaagtctcacctccttcccccctacagtgcccgcccgcctgccgagcgcgcgcctccgccggccgcctgttcgcgcgcgagcgactcgtctcccctatacgacgtcctctcacctgctcccccgcgtcgacccgacggagtctccgcgctccgaccccctcgtagagtagagcacgcgcgtcccacagtatccgacgact

SEQ ID NO: 17778 - DNA, 688 bp, Homo sapiens
  misc_feature (1)...(688): n = A,T,C or G
ttgcgaagaaggcactttcttcactaggnanactttgccanagcagtgaagaccttcttggcaaacaccagccatgctcacttctcaccatcccccagtgccacctactctctgctcaacactctccatgcccctcccagagccattgatcccgttccaccagaagatcacatcttagaaatgccccagacatcgttggacatttcttcatgcttcatgagcttcaaaatcttttaaaaatttaatgcgcttatgaatctctaacaagctcctaaataacttgtatgctattgttaaaaactcccaatattaataagtattagtaaaatgttgctgttaatagtaaatcagctaagcgtcaaaatgctacctggaaaagcaagcagaatagatattccaatgttaaagggcatcaagagcaagactcttaaagagcctatgaaatcatttaagtgtgagataaaaagggtgggaatttcatacatatttagcattgcctgagaaatgtctctaagtttttcttttttactctagaaattaccaaagctgaaggtaattacatttgtgctgctacaaaaacactttgtcatgcctcagagatgtatgaatcttccattgggcgtattagggcagagctcttgtagacaatgaccgaaaatcaaatgcttccagaggaaaaaaaaaaaaa

SEQ ID NO: 17779 - DNA, 366 bp, Homo sapiens
  misc_feature (1)...(366): n = A,T,C or G
cctgcgagnatttcactcttgttgcccagctggnatacaatggcgcgatctcagctcactgcaacatccacctcccaggttcaagtgattctcctgcctcagccccccgagtagctgggattaccggcacctgccatcattaatatcacatagaatttcagtttttctaatacttaatttaaaaatctagattaaactttttgtttcacataagtttgtatttgtctgctttctttgtaatgataaaatgtgaaatatatttggatctcacgtgtaaccttacccagagtagtaagaagatatcatatgtgtcaacatacccacanaatattaaattaaaatattttaaaattaaaaaaaaaaaaa

SEQ ID NO: 17780 - DNA, 906 bp, Homo sapiens
  misc_feature (1)...(906): n = A,T,C or G
tcaccgtttgtactcctcgcctccganctggagtacgcggtgcgatctcggcttctgctacctctgcctcttcagatcggggcccctaagacaacagcaagttctgggaagaaagaatccagcctgagttgttttttacctttagaagatacggtcccattctttcgtacagggtctcgctctgtcgcctacgctggagggcaccggtgtttttttttcctcctgcatcctttggttggtggggtgtgggggcccttctggtcccctgtcttttcctcctgcgactttctcgccgcggcgtcngccccccctcccccccccctcccctccctcctgcccccccccttcttcccccccccccccccctccccgctctccttcgtcctcgcgttccccccgcccccccctgcccccccccctccttccgtgctctccgtccccccggttgccggttcgtgggttggttctgggttttgtttttgctcgtcgttggtgtgtgcgggttggcggtgggcgttcggttcattcttgcgtgtctccgtttccccgcgtgtcgtccgctccctggcttcgctgtcggtgcgcgatgttttgtccttcccttcttgtttgggcccgcgccggcgcccgcgtgccggtgcgcggggtcttccgctctctccctcgccccccgccttcccccctccggcgcgtgtcgggggcgtcacccgcccctccgcgtccgtccccccctgtccccccctcctccgcccccgccgcgtcgctcgtctgccccggccccgctgccggccgctctctgccgtcggctgatggtgtcctctccgcgccgggctgccgcgcgccgcgaccctcctcccgtccggtcgcgcgcgcctccccccgcgaaccgtctcccaccccccaccg

SEQ ID NO: 17781 - DNA, 931 bp, Homo sapiens
  misc_feature (1)...(931): n = A,T,C or G
gcaaccttggatggagaacacnaatagtagngcacagncatnctgccatacaaaancgagnaactggnattccactataatgctaggnaccgggnaaanagcaattctactgagaaaactactctaaagatatggcacggaagtaggctatacaccttgtctacagtttgaagtgtcatagagaagatgacaatcatgtttcacataactggattatctccaaaattgagtctgatgagaacaatgccattcaggatggttattaaaaatgttaatactctaagaaggaacatggagttctaaccatctgtctgagacctaactgccattattatattagatcgtgccaattattctgttgaaagtgacctaccccgtcccttgtctgtatgcattgttttcgcctgcactcttgcccgcgcgggccccccgtcgtccgtacccgcctcccctctctgtgtcctcggactggcgtctcttccgcctgccttcttcgtttgacctctctccgctcctatctcgttatccgctttgtgtttactccgtctctctttcgtcctttctctccgttctgttttctttgtgtcgctgcgccccccgcggagcctctttgcttttcgtcccctcgtcgggcttgggggctcgcaccgcgcttctcctgttttgggcgtgtctgctgcttttctctccctccgctgcttttctcccccccccgtgtgcttcccctcgcacgcccgtcctctgtttggccgcgttcttttcgcccagttctatcccgcctctttcctctttttgcttcgtcttcgcgccctctctctttctctgtcccgtgttgtctcgtcgcggtctgccctcccgccgggctgtcttcgccgccctcgcagcctggttcgcctgccggtccgctcctagcacaacagctaacgaaaaa

SEQ ID NO: 17782 - DNA, 810 bp, Homo sapiens
  misc_feature (1)...(810): n = A,T,C or G
aaactacgannngacnnccnctcagncanaaaaaagctccacatcagtatcgaaggggttgattttgaatcagtgagggagatgatgatgatccttttatgaacactagttctttaagaagaaatagaacataatatatttaatggcactgagaaacatgcaagatacagggaaaaatggaaaatgtttaccaagccttaagagtttacagttttttattttaagtattgcttcctgagcctaactcccctagtaagaatttctaattcccagacttcaatagccttggttcacctttgtttttttaacctggtggttgtagtaaggagctttgtttcaatttccctttttgggtgaaggattaaactaaaggctccccttttccatttttttttttcctaagggaaaaacctttcccgctttttttatttgggggcccctttcccccacctttttggggggaagaacgctttttaaaatttaaacttcttttttctttttttttacagctttcccctaaaagggtcctgggggtttctctgcgggggcgggacacttttttgcgcgncccccccttcccggtcatcaccctcggcgtggcttcttttttcccccgtgctgcgtgcccccggctctccgcttggtcccctccgctcctctcccgcgcgcgccgcaatccgacctccctgaacgctcccccatctgattgtcctcccctcacgcgcggcacgcttcgtgcgacgcgaggcgcccgctgcgttagggggggggcgcggcggggcgcagcgggacagaggagagacagagagg

SEQ ID NO: 17783 - DNA, 347 bp, Homo sapiens
  misc_feature (1)...(347): n = A,T,C or G
gccgagggcccgttgggtgagagttaagtctagagnngtcactttgttgtntacacgctcantaacgnccagnagtggnactgttggcttcaaaactgagtaaggaggggaaggcagccctttaaccctgaggcaggaaactgcccccaggcactgaaggagcctgtgagaacaagtgtcttctactacctgagaggcccaatggcagacgacacggagccctggcatcaggaaactcaggtcgcatccagactctaccactaactgcctatgcaccctctgagcgtgnttcttcatctacaaggcaaaggttggggcataataaatctttggctctcttttaaaaa

SEQ ID NO: 17784 - DNA, 537 bp, Homo sapiens
  misc_feature (1)...(537): n = A,T,C or G
cccttcgagtctacaccaagtatcaaaatgctttcatgagtagaaaataataaatcagagtcacattggacagcaactggggaacatacaaggcacttaaacaccacaaagcctggattttcaggtgtgcaacttttcacactgatgagatgtaatatttcaacttgaagaatacgaatccccagtcacctgatgcctactacaaatctgttattgaaaaaaactgaactaaagattttaagaagaaaacacagccctagcttgtaaccttgtctctattatttcccagtgatatcgccttggaaaaagctctgaagatctctcagctacagttcctgctggagataataactaccatgaccactattcctgatgttcatgagagccaaattcaatgttgtctataaagcattatgtctgtacattattacatgcttcttcatatcnncnnnnnnnnnnnnnncncnnnnnnnnnnnatctannccccnncttctctgtttttcttttctattttttctattggaaaaaaaaaaaaa

SEQ ID NO: 17785 - DNA, 407 bp, Homo sapiens
  misc_feature (1)...(407): n = A,T,C or G
cactgcgctattgcccacttaatatnagcaccaggnaacatcaaagtcaaagaaggatgaagagaagttgcttccagcaacagtgggtggggctttccatttaaattctgccttcaacttccaaaaaatatcctcttgggaaacttattactcatgaaaatgaagagaaggtgttttcctccatggagcaatctctgccttgaaaagtctccatccctcttcctagcccagagagatgatcccacaaggaagtggattttgttgcttaatcctagttaactgaattctgttttcccacaataaaataataaaagtaatttggaatagcataacctgaatgttcatatttccacagcctgtgattaaaaattagaaataaaaaatcttgaaattcaaaaaaaaaaaaa

SEQ ID NO: 17786 - DNA, 571 bp, Homo sapiens
  misc_feature (1)...(571): n = A,T,C or G
gcaactcncgatggaaaatccttgcgtgccgggnagnaanagnaacncagcaatgagatgaacctacagaaacccttctcctcaaaaagccagtcaccccaaccttcagcagccagcaccctgaccaggcagtggtcatcaacattgaagcaagactttccactagcaaaaagattacaacttgttgaaggctcagatgattcttagcattttttagcaacaaaaaattttcaacttaagaatctcaagacttctaccaacacccacggaactgtaacaggcctgctaaacagcagtttgcaggcacaagaagaaagaattgatcaatttagaatgtatcaaaggtcctacctgtaactttttctgatttccgaagatattttattaactcgatgttattgttcagatcatttttggccatctgtcatcacagaaggtgtaaaaacaaatgctaattggtatacagaaaagctttttagctttatttccctgcctttttaacccagagactcaggaacactgaagtttttttgaaatattaaaagagattccgaatttaaaaaaaaaaaaa

SEQ ID NO: 17787 - DNA, 1000 bp, Homo sapiens
  misc_feature (1)...(1000): n = A,T,C or G
gcgagggcgcaggggggaagtagtttggnngncctgcgtggaaaactgctttcccgtgagcagccctggnanaggctgccatgccaccgaagcctccagccagcagcaataagctaagacttgcaacagcaatgtgagtgagcgtggaagccgactcttccaccccagatgagtcttgcgatgactgatgactgcgggcctggccaccagcttgactgcaccctcctgagaagccatgagccaaagctatccagccaagccactcgcagaccccccacccttagacgccttgaaagataataaatgtttctcgctttcaaccgcccgccgccaccccccgcccccccccccccccctctcctcccccgtctcccccaaagaaaaaaaaaacaaaaatggcctcgtcggcctcacggggggggccttgtggcccccttccctctcggggggggaatctctgaaccccgccacttacctccctcgctcggccccccggtcggggggcgcccctctccttcctccgaggggtgccttcgggttttcccccctcctggggggctcccgcgcggaaaaaccctgtgcgataaagggccccgcttagggccgccaacccccacaatgggccgatgtgtgttgggtttttccctttggttgctcgcccccgtcggcgcggcgccagcccgtgtgccttcgcgagtggggcgtgttcttcccggcgcggccttttcggtggccgcgccctgtccgctattggagtccagccgggnacctcgcgtttcactacgaatcccacgcctctcattcctccctccatctctccttccctcctctttgcgncccgcccccccgcgaccccgccgcacacggcccgttattgtcgcactggatacgacagtcgcgggcgtacgccagtccggtccccgctggttcctccggtctccccgatccggtcgccgcgcgtcgttngcgcgcgaacggagatgcagctacagcagaccat

SEQ ID NO: 17788 - DNA, 387 bp, Homo sapiens
  misc_feature (1)...(387): n = A,T,C or G
gggaggggggccgtcaggggagaaagttgagttttggnnnngccctcgccgantagaaactncagatctggggcacacttgnaaactacaagccaccaagnaaggttcccaccttggnaccacacaaaatcgccaacctgnaaacttaacaccagtggacacttccgttgttggaacagaagaaagtattggctgaacctacaggaaagggtcaaaaaacttcatcagaaattcaaaaaaagaaactatgtataaaggacattaaaaatgctaacaatggaattttatcttcagttattctttggtacaggaaaggggcaaaaaacatcagaaatttaaaaaaagaaacttgggtttaaggacattaaaaaaggaaaaaaaaaaaaa

SEQ ID NO: 17789 - DNA, 931 bp, Homo sapiens
  misc_feature (1)...(931): n = A,T,C or G
cccctgcggagtctacaactataatccaacacaagtgtcggcagggctggtatcttccgaggcctctctctttggcttgtgaattgccatcttctccctgtgtgttcacatgtttctccctctatatgtatctgtgtctacatttcttcttctaatagtaaaacatgacatcttaatttagagtccatcctaatgaccccattttaacctaattacccctttaaagaccccatctccaaatatatcatattctgaaaaactgagtgttagaacttcaacatattaattttggggaacataagcccataatatgtactattaaattggtattaattgaaactagattattataagttaagatccttaatgaaattccaaggacaactgctaagaaaacaactggcaaatgtttagggaaacatcatgcgggaatcgaatgggcgaaaaaaaaaaaagtggactcggtgaactaaacggggagagatgtgacgagcagtaacctttaaaagggggagggtagataaacccacactcgctggactattagccgcacacccccttcgccttccccgtgccgcattttcaacgcccctccgatgatcgttcgccccccacacaccccccaccctcacgatcgcccatcacacaccccccactccaccccccctcacgtaccacccccccacacgcgatnttagttccctcagcacgccccgtctgtgtgtctagcgccccgaacgttccgacctcaatcaccgccgccctcgaccccacttaaccccgcccctacaccccgccaccacccacaccccatactccaattgcgtacgcccactacccgctcggaaccgcccccctgctcacctcgctcctcgacccatcggccatagcaccgataacgtaccaactgtcagtcacactaccctatact

SEQ ID NO: 17790 - DNA, 914 bp, Homo sapiens
  misc_feature (1)...(914): n = A,T,C or G
gccactttcgatnntactagcgnaganatgggcacagnacaccgnagtttgtttngaaatcctcgccttttcactatctgcccatctgattctggacaaatttagattttcctttctgggcctcagttccctcgtctctgaaacaggaggaataacatctccttcataggaattgctgtgaagactgacccggaggctggaaataaaggcagtcagtgctcagtaaacagttgctcattattattaagtgggaggaaagagaaaaaaccccacaggccggagccagatcaccgtgaaggaaaaaaaacaaaaaaaaggggcccttttggccctcgggggggggcctttgggccgctttcttttccgggggggttattctcgaaccccggtccctctccccccgcccttgggtcgttcgctggcgggcggggcttctcctcttcgcaggggggacccggcttcccccccaaccagggggttaccgcggaaaaaacttgttacacagagtcccgcaaaggccccgcacccgcaaagggccggtatcgcgcgctcttcctcaggtccgacccccctctgggcttcgcaaagcggccgctccgttccggggggcgtaaccccgcgggcagttagataccggcgcttcccctggaagcatccgcggcgcttcctcgtccacctggcggcacccgacccgtggcgcgcccttcccctggcgcggcgggcgtttccctccgtcccccgcggcgccctcccccccgcggcgaccgcccctccccgcgggcgggggcccgcccccccgtctccccgccctcccccttcgtcgcccacacgcacggtgcccccccgtcgcaccccgttcggccctgcggtcaccgcgtgaccgtccccacacacgggtcgccgatacccaacac

SEQ ID NO: 17791 - DNA, 1403 bp, Homo sapiens
  misc_feature (1)...(1403): n = A,T,C or G
gggagagggngccgcaagcgagaaaaagaaaagcttaggaacgccgctacgtngncaaaccaaaatttggggggggnngccccccccccgcgggccggcggggcgggggcccccgncgcgcgggcccccggcngggggcgcgcgcggcgcgccccccccccgggggcgggggcgccccccgcccccccggccggcgggcgcggcgcncgggggccggcngccccccggggcgcccggggngggcgccgcccgcgcccccccccgggcgcccccgccgcgccccccccccgcgcccccccccccgggccccgccccccccnccccgcccgcgcgggccccccccgcccccccccccgggcgccggaggccccccgcgccgccgcgggcggccgcgcggcacgccccgcccgggcgccggcccgcgccangcgcagcggcggcccgcgccgcccggccgggcgggcgggccgcgcgccggcccgggcggccgcgcgcccggggcgaccgcgcccgccccgccgcggcccgcgcgggccgccccccccggcgcccgcgcccggaccccgccccgcaccgcggcgcgccgccgcgcgggcgcgacgaggccgcgccccccgcgccgccccgaggcgcgccgcgcggcccgaggacgcgggcggacgcgcgccgcagacgcccagccggcgcgcgcgcgggcccgcggcgagagccccccgaaaagcccggcggcggggcgccgcgcgcggccgcggggccgcgggcggcggcaagcggcgcgccaccgcgacgcaccggcacggagacgggaagcagagggcccgacggccgccggcacggcgcgccgccgcgcgaggggagacgcgcggcagccgcgccaacggcgcgcgaaaaacaactccgcgcangcgcaacaaccgnncgntcgcgcggcgcgcgcncggcgcacacgngccgcacagcacgcgcgcaccgccgaccgcgngcgcggnggcggccggagcgcaaccgccccgcaccgccgcatcaacgccngccgcgggcgccgccgcccgtgctcgccggagccgaccgcgccaccgcggccacccaaggcgcgagcgcagcagaaaacgacacaaagactcgcggcgcgcgagcgcgcgctccgtgggggcgtgcggaagtagcggtgcaagcgtgnanggcgcggacgagacgcnattncgacacgcgtcggcgcgtcgacggaccagataagcggacgtgntgacgcgagcgcaacagcaccgggcggnnggtaacgggcgcgcgccgcgcaagacgagcatagagagagagngncgacacgctcgaagacacggaaggcgctcgggcagacnagaccggcgaccgagaaggaagatagaaaacaaaacaactcagga

SEQ ID NO: 17792 - DNA, 340 bp, Homo sapiens
  misc_feature (1)...(340): n = A,T,C or G
cccttccgatntngatccacacttgcgcgcaagacctacacctttgttctctggnnaacacttgctcttggnnactgccatnngtaagcctctgaaacgacaatngctgaagatgtcacatgtaggtctttggtttgactgtcccagctgagcccagtctttcatctgtcctgccaagtttccacaccctccaagccagtacatttgccagttgaatattaacatgtgacaactgttgatgccatgtggaacagaataatcacccaagcaagactgcccaaattcctacccacaaaacagtgagctatagtaaaacagatgttgttcaaaaaaaaaaaaa

SEQ ID NO: 17793 - DNA, 979 bp, Homo sapiens
  misc_feature (1)...(979): n = A,T,C or G
ggccgagggggccgccagggggagaacagattaagtctttggnnnngnncctttcgtatcaaagacaaaggttcaggagnacgagactagncagnncttccctggatttcactgcaattcattacgtgacctactccagccacactggacaccctttcacatttcctccccagcaatccagaagccctgcaacagccacctttaggaaatctttgcagtattaataaaaatacttctctgagcggggggccaagtactttctaggcaccactaaggagaattacccaggctgaactaaactgtattttatccagattaaaaaataaatcgtacaaaaaaaaacaaccacccccccggcgcggcgccgggacacgccgcgcgcgggccccggggggggggggggaagggccggccccatcaacacaggggctcccccggcccccccgccgggggccgtgtgcgcccggctccctttcggggggggtgtcttcagaacccgcgccgctccccccgcggggccgggctttgcgcgtgggcggggggggcagccccccccgggcgggcgccccccccgccccctctccgccgcccccgcggcccccccccccgcctggcgcccccttaggcccggcgcccgccgtcgaccgcccggcgagttccccccgcggccgccgccccgccggcggtgggacgcccgccgcccccccgccggaggcccgccggccccttcccccgctcggggccccctcccccgccgcccgcgcgcgccccccccccccggtgccccgggcgacgtcggctggccgacgcccggcccccgcccgccccccgcgccctgcctttcgccgcaaccgccgggcgcacccggtgcccgggtgtggcggtgacccggccgtcgcggcgtacgcccgctgacgcgcccgcaccttgttcgcattcgccgagcgggcagccgctgactgtctccctcccccccccg

SEQ ID NO: 17794 - DNA, 389 bp, Homo sapiens
  misc_feature (1)...(389): n = A,T,C or G
ccctggcggntattttcacagcctcttcgactgnaacacggctgtaatcatactctcacaattcatgtactacnaggttaaagaatcagaagaaaaaaagtaagattgataatagttcactcaaatacttctgtctgtaatagaacattttctcatttaaaaactgatagagcattttcgagttatttttaatgagtaaggcatattttgataagacataacatttctctcaaccatctaagtgagtcctttgagaattttcagatgtggcatatttagattccatgttattacctttttttttaattgggatgtgtcattggacacattaacacatctatgttattgggaaaataaacagaaatgattaatccagaaaaaaaaaaaaa

SEQ ID NO: 17795 - DNA, 475 bp, Homo sapiens
  misc_feature (1)...(475): n = A,T,C or G
cttgcggtgtgcagcagacgtctctccccccctcacttatctcatnccagaagtcaaagggagaaacaaananagcatggaaagcatgacttaaaattggattaaactggctgcgatatggattagtttgccggaaactacactgaattccatgtaaaattaagaaggcatggcaaatagatgctacagaagcaaacagaaagattcagcttcagcatggctgagcctctgaagaatgcggtggaaaggaaatgtgatgcttctcagctttttcactccatgtccacctaactcttcaagtcactcttccatcttcttcatgtgattctgactgtgcaggggaaaaaataactgatgtgactatccatgccttctgaatgacatatgcttaaatgccagctctttgtcttgtgggcttttgtggaaagcacatgtttaaatataaagtatgcagtcttcaggaaaaaaaaaaaaa

SEQ ID NO: 17796 - DNA, 918 bp, Homo sapiens
  misc_feature (1)...(918): n = A,T,C or G
cttcgcagcaagcanaacttcagcattctctgttcggcatggaaaggagaaaatgagactgtagatatacgttgctttggatggcaccaatatgggccaggaagcttgcttgaaacaagataaaaatgtgttttggataccaatgaagtgactttctgaatccttgccttcctaaatacaaactgcatgatcctggctctacctcttaaaaatgtagcaatttatttttctcagtggcagatttgaataataatgtttatatgtctataacttaacactattgtgagaatcaaatgaaataatgatcagtaaataactctgagaatcattaagtaatttatcaaacatatgttttgtgcaaggcatatgtacattatagcaattatttataaacaatttacgcatagtgcaaaaccatcatgcctttttaacaactgacctaccttatttgttgcaccaaatcattttccatcaatgtcctatattccgctactccaaaaaaccacaccatggcctctatggccctcaccgaggaactctaagacccctacctttaccaaggatcacctccaaacctccccacctaacccctcccccccgttcccagtctcccctcccccccctcccccccctacccgccccgaccctgctcccccgcgttccgcgcggccccgttccccaccattctctcacccccccccctcgccaccccccaatccacctcgaccccgcacaccaactaccccaccccgccccctgcgcccggaatagccacctatcacctcgctcatccccttcccccggttctacccgcgtccccccccccgccccacccacacccctctcatcccactcccccactctattttattctcccccatataccaccctctctctacaatctcacacacaaccgcg

SEQ ID NO: 17797 - DNA, 512 bp, Homo sapiens
  misc_feature (1)...(512): n = A,T,C or G
ggcgagggcagtttgggtgagagttgagtttggnnagcactccgttnnanacnaacttgtgtccannccagacaggaccattggcctaagcattatcttagaatacaatcattggttcagagagagtatgtgactaaattgtgtgggcaaatgaggtgaaaacatttgcttggagtttctggaaacggagaaaaaataatttctcatttccacgtgacaactacctagactaaaattctcttccttctggatgtgaacaaggaagaatacaggctccagaatctgcagaatgctgtctatcaccatgaggagatattatagtaagacgagggtcaagcctaataccagctttctatgaagaatttactgtggcactggatttaaccacacccttggagccacatctctctattccttgatttttccagtaattcccttggagggttaaagcccctgatttttccgcacttggaattaaaccttcctgtggtagaattccaaaaaaaaaaaaa

SEQ ID NO: 17798 - DNA, 299 bp, Homo sapiens
  misc_feature (1)...(299): n = A,T,C or G
cgactgggtgggnaagcccgctgctttgtgcagncagnaactcagncagccctatgnagaagcccatggagaggggctgaggcctgtttcccacagccatgtgagtgggccattccggaagcagatcatccagccctcgccaagctgacagacgactgcatccccagccaacatctagactggagcctcacgagagaccaacccggagaccccacccagctaagccactccagaatccctgaccccaaacattgtgacatgataaaaatgtgttgtttaagcttttaaaaaaaaaaaaa

SEQ ID NO: 17799 - DNA, 401 bp, Homo sapiens
  misc_feature (1)...(401): n = A,T,C or G
ggcgagggccgttagcgagagagataagtctttagaaagnccttccgtatgctagccaatcttgcctctcagagtctgcctctggnagnanatgaaaanaagtcttcaatacacacccattgacaaatatggctatgtatccgatcccatgagctcaatgcactttcattcttgccgaaatagtagcagctttgaggacaacagctgacagcattcggcgtgtccctaaggagagttttttccccgagctgacagctccgattccaaccacgggaagctggcttgcaactataacattttactctcaaaggtctgcttgagttgggcttgcttctacttgacctatttggttccccgctgttgcctcgctttggatctgcgcctgccgggtggtctgggtg

SEQ ID NO: 17800 - DNA, 236 bp, Homo sapiens
cataacccatctctattaaactacaaaattagccagcatggtgggcccgtctgtatcccgctactcaggagctgaggcggagatcgctgaacccggagcggaggttgagtccctgaaatgggccctgcctccgcctggtgacagacagattctctcaaaagaaaaaaaaggctcgttggctcacggcgacttgcgccgctccttatgaggttattctgatctcctatgaccctggc

SEQ ID NO: 17801 - DNA, 603 bp, Homo sapiens
  misc_feature (1)...(603): n = A,T,C or G
ccactgcgggtatgaatcactcttcacatcagggnactgttacaactggtcattgtgggtaaaagccatctcacaggnnaaacaacgaaggggaaatccagaggtgattcttcggcaagaatacagacaaggagcttatctgatgttcatttcattgattaaggttttgtttcacaaagttataatgatttaccacttgtcctatatgaaggacctaataatttatcacataggggaagacaaatgtagatgaatgtgttgacgatgtgggaagtgcaagatgtacactttgtattatacagatatgtgatctcttttgaaattcacttagctaatgggatcttctgtgtctggaatctgggcaagaagcaaatagaaagtgaaaaaaaggaattctatgattgaaaatagctatcattcttattattgtaaattcctcccctctccctccaatatgtggttggctctttacaggacagctgtttttttttaatttttttaaaataaattttaagtaatacatcttggcccaaaaactgtgctgatactttttagaacttctcagtttattaagtcgccttgcctaccacaaaaaaaaaaaaa

SEQ ID NO: 17802 - DNA, 976 bp, Homo sapiens
  misc_feature (1)...(976): n = A,T,C or G
gggcaggaggggcacgtcagggggagaaaagattgagttttnggnnnggtcctcggcgatnagaaaaccncagatctggggnacacttgnaacctacaggccaccagggaaggttcccaccttggnaccacacaaaatcgccaacctgnaaacttaacaccagtggacacttccgttgttggaacagaagaagtattggctgaacctacaggaaagggtcaaaaaacttcatcagaaattcaaaaaaagaaactatgtataaagtacattaaaaatgctaacaatgtaattttatcttaagttgtactttgatacaggaaagcgggagaggcatcggaaattgggcgacgcaccgtatgggtggcgcccattagagccgcttggcgtgggcatgtatgcttagtggtcctgtgttccccgacccgggctccagcccgtagcgcccctgtaccgcagcatgaactcccccagtgccctccgcattcgccccccgacgcgacatgacatttttttaactatacttggccgcagcgcccctcggtccccagtccctccccgggccactttcccgacgcggcgcgtggcttccaccgcccacaaccgcccccacccccccaccaccccccagatacctcgcgcgggtgccccggccgtccgccgcgcccccattccttgttggcgccgtgcgccgcgcgccgggttttccgccgcggccttcccccctccggccccacttcgcccccccacgcagagatacaacccgctacgtatcacatcctccattgctgtaagagcccgtttctacagacccgcccagcgccggctctgtcgttcccgcgtagatcccctagcacttgcactttctcgctagtttacctcgtccatcccgcactaacagaccatacttaacggctcggaggccgtttgctcctctccctgctgccccgtttctagctgctctaaggaagccgtcagc

SEQ ID NO: 17803 - DNA, 325 bp, Homo sapiens
  misc_feature (1)...(325): n = A,T,C or G
gccgagggccccccaggcgaggnagttgagtttggaaggcttgcgtagtttacccccttttggtcacaanacactccgtngctccgggctcactcttaccaagncaanagaaggcatttctccaactgtcttttttcatcaagagaaacctgtcctggaactttgcctttgcgatgattacgcatttggggactctacctaaccttgcctgcacccacctgcaacccgaccccgttctctccctctcttcacggaggcccatctccccctgaactacgcccagctctctcacttgcccctatcctgccttacccctcaccctcgt

SEQ ID NO: 17804 - DNA, 492 bp, Homo sapiens
  misc_feature (1)...(492): n = A,T,C or G
cccctggcgggntaggaaatcttcacttctttgttgcccagnctggnatgcagtggcatgatcctggctcagcgcagcttccacctcctggattcaagtaatcctcctgcctcagcctcccagtagctgggattctcctgcctcagcctcctgagtagctggcatgtaccaccacaccaggctaattttatatttttagtagagacagggtccctccatgttggtgagggtggtcttgaactcccagccttcagtgatcccaccccaccttggcctcccaagtgcttgggattacaggtgtgagccactgcaccgggccaattaaaattccatatgcatatccgggtgggttcatggatattccattctctaccaaatttattttataatatagaacaccattattaatggaggtaaatgaaaacaggccatattatcaaactgggtcttggggaaaataaaagtttttttttttacctaaaaaaaaaaaaa

SEQ ID NO: 17805 - DNA, 929 bp, Homo sapiens
  misc_feature (1)...(929): n = A,T,C or G
gtccaccgtagctacacgnaattctgcctcttctgctaactgtaaatctttgaagaccaggcaccacgtgttacttatttgtgaatttccataacatctagtacagtgtctaccacctaattgggcgcaatgaatgcttattgaaaaaataaagaaggctactggggaactttcgggcctttgtgcgcacgaacaggctgacctgtgaggcgtaccctggcaacaggtccctctatctcttcttcgctgtcggctcacaacaatctctcgtcccgcgcgccaccgctttcctggcgtctccctctccttcatccttcttccttccgccggcgtttgccctactctaacgctcctgctcctcccccctccttcttttcgtgcccccctcggccacccgacgcgtacgcctcgtccttcgtccccttccttggccgtaagccgtgcgcttcaccccccgaaaccttccctccttgcgttgtcctgttggagtgattagcgccgcgccccctcccgcatcccacaagcccctcctgatgctcacccctntccgacccctccccgctccggcgtcaacacggtacgttcctacaccgcccgtcaacccctccgcagtcgtcctacccccccgcacccgcgcatttcggttaccctcccctcctccgcgcgcccgattcgccgccccggcggtcctcccccggggaccctgtcgcccccccgcggatccgcgccccccacctcgtctcctcccttgagaacactacccccctaacagccacccgccccgccctcctagtattctcgtcatctccctccttcccgcatttggaatttctccatgctcacacctcaggtcgttacccctatctgtccctcacccgcatggttatctcgtaatactccgaactgtcgtattaaaaacaaccaacacg

SEQ ID NO: 17806 - DNA, 282 bp, Homo sapiens
  misc_feature (1)...(282): n = A,T,C or G
cctcctangagcaggnacctgagtttcttcacactgttagaaagggattctgaagcttgagattaccaggatcaaactgaagttttctccttgaaccagaagaattagaagaaagttgtaaagacataaacaccttttacatgttatccaaatggacagtgcctgtgatgcaccccaagtcattttgttatttttagtagcaacaggtccttgtttgggaaacatttcctcttcccttcccctcattaaagacaaacttattgagtgtnaaaaaaaaaaaaa

SEQ ID NO: 17807 - DNA, 489 bp, Homo sapiens
  misc_feature (1)...(489): n = A,T,C or G
cctgccaggttcatgcccaaacatacctggnaaaaacactntcttgatagcatgaaaaacaaagttctgacccaacgtctctctgatgactttgctggaatgagctttcctgaagttgcccggctctgctttctgaagatgcacctcctgttgatagccatcgaatacaagtccctctttacggatggtttctgctcctcttcgaattggcaagcttgaagagatcctacgacttgcaaaatgcttggagaattataagaatttttcttacggaattatttgtcacctgctaacagatgaagctggatctgaccccatcacttactgtaatgattttgttccagggacaaacattctctgatagagcaaccagccaaatcataaagagtgaatcaactaataacaccatgttaggaaaatccttaagagaggctcacctcttttctcanatacagtcaaatatatgttttattgtgaaaaaaaaaaaaa

SEQ ID NO: 17808 - DNA, 316 bp, Homo sapiens
  misc_feature (1)...(316): n = A,T,C or G
cttcccgactaattggctaacgggcagcatcgggcattgtgattgccganaacaggnaaataaattgggtgaaccctacagttgctccagtttgctgcctatgagcaagttccagaccacagtacactgaagaggagtgtaaaacaacctaagagttttgctgaattaaagagaaagaatgttagtgtttctagatggcaagatggctaagatgtgtggtcccgagtaccagaaacagcagctacacatacaaagncccttaagatctgcagcaggatctaataaagtctttggcttnagatcaaaaaaaaaaaaa

SEQ ID NO: 17809 - DNA, 397 bp, Homo sapiens
  misc_feature (1)...(397): n = A,T,C or G
tttaccgaggttcatttttnccccttcctgtgnatttggcaagcgagccaaaggaaaaaaaacttcaacaaaaagactggctcaaatcactctagggccagactgcaccttcttaacatttctaataaatcacggggaaaaagaaatctctgccatagtggcacatttgacaaattgaaattaaattttgccaactctggagaaaccaagataacctgctttgatatttcttccctgttaatagttaatgggtaagaggggacatttgaggtttctgttttttaaagcgcctccctctgatcaagtgtgattctcaaaaccctgagtccatattcagcatggagtatgagttcaagggctaacaataaatatggatatttttgcaaaaaaaaaaaaa

SEQ ID NO: 17810 - DNA, 486 bp, Homo sapiens
  misc_feature (1)...(486): n = A,T,C or G
accttggcggagntncttcacntacttcaacacctgnacacctncccctgnagnaagcctcaagttcagtgctagctctgcagtcaacatcaacctaaaatattactacagacagaaatcgttctggatcaaaattctgatcttctttccactttttcagactcatcagaagaggtgtctaagaagatgcacaaaaaaatttgcaagtggaccattattgcctgagggtctaaagttttaccagattctttttacaatgaagtatatatagtgtacatgcttggggaaaatgctgggtcttaaacccaacctctattaacacgattattgctcattaatcatggctgaaaaatctggcatcaagaatcaccgagatcctagctactcaaagtgtaatccctggatcaacagcatcagcagcatctgagagcttgttggagatgcagaatctcaggcagacctactgaacgaataaaaaaaaaaaaa

SEQ ID NO: 17811 - DNA, 926 bp, Homo sapiens
  misc_feature (1)...(926): n = A,T,C or G
gggcctccgcctnnggtactggtacctttctgcagcccagcttgccctttcctgccagctaggcacccacaaggtcctgccttctttctcctgtatggcacactggagggggattcacactaaggatctcagcatgagtccctcaaaccttgccaaaagggttttggtagtcttgagatactggcagataacaagaagcattaaactgcataccatgttgtaaacttatataactgcaaacactctacatctgctttaaatccatcatcgactttgcttttcaaataaaatagagagcgactttctctctctgattattaagtgcgcccagaacgccttccatgctgtaaaactgaaacacttctcatgagaaggggcctcaaaaagtgcccaggaggaaatctctttggctattgcatttgcgcgatgctatcaactccaagagtacattgcaggcgtgtgataaagcatacccattctaaaggttcttttgcttgaacaaagtgtgtgtgacaatatttcattgggatggaaaccaagaattcgggccaatgccgtgcaatgttctagagctctctctcccgttggtactataatgactaatggctctgtatgaaaggaggaaacccacgccgttcttttaattaccccgggcgccctccgtcagcttcctctagcgacggttaattcatgatcctgcccctctcaactaattgctcccgctttttccgctggcgcaaggcggctctttttctatacatgcggtataagtttcccacccgggagaggggattaccctaatattgagttgtgggaaaaaaacccccgtcagcccccccccccccacccatcctggtttcctatccgtcagggtccacacccggcaccacccactttatatcccttgttaaactctcctggagaag

SEQ ID NO: 17812 - DNA, 416 bp, Homo sapiens
  misc_feature (1)...(416): n = A,T,C or G
ccacgggaaaaatggcatggnnatagtnctncgnangaaaaagcatggcagtggnagcagaagaaccgatgagacgcagtttccatcgtgaggctgctacatatgtgtcgcctgtaaatgcttccgccacaaaagtgtatcccttctataagaaagacaaattacacagaaatgaattatgtcgttattattctatcgaatgtacaatatctaatagtgctaaatgtcttattattatgatatacctacaggtcccaagatctcttaataaacatagaatcactaggattatgtttggaatttctcttagaaagcactatcctacaaagttttcaggaaaataataagctctgatattttcctttgtgtggttccttaactataaaataaagtgcttaactacaaaaaaaaaaaaa

SEQ ID NO: 17813 - DNA, 576 bp, Homo sapiens
ccacatctttttctccatactttccccctatttaacattttgtgttttcccgaattctcattgctggcttccaaatgctaccagactggtgggccatgttgcgggttgccattctctgcttcacggcctggaaacagtttccagggagtaaactggtaatattttcacacttagctttcttatttcctttatgtcatagatcacagtcctgcacagtcctattttacaatgtttatgaaaactgttttcatgtaattttctagttttctagattataaggtgtgaagtaaatctgtttactattactccagtttattctgaagtgaaagaatgtatgtaattcactttttgtgtcataataattgtagctggatattaatttttcaagtaatttcagaattttgtttttagtaattggtttgtatagcctgtttacaattattatggttactgaaatgttatgttgctattttgtgacttttctttagttttgtttactatgatttctattaaattgcttttccccaattctgttctttttcaattaaatattttatttgcttaaaaaaaaaaaaa

SEQ ID NO: 17814 - DNA, 390 bp, Homo sapiens
  misc_feature (1)...(390): n = A,T,C or G
ggtgcggaattttctcaactcttttccctcacatggtaaatggctttcacanacgctgtgattggtctgcagaatttgggagaaggcaatttgcagggacaccaaaatgcattcccagaaggatcagctaaacaagacaattactctcctggggcagtttatctatacagaagcacacaagtccggtcggatttccttactcaggaattggaattacaggagagacaggaaatgagaaacacccagaaatccagggattcacatggctgagctccacatggacccatttctgccagcaccacttggctcttatccctcttgaggcctggctgttcagattgtaattcacttattccaataaacctctttttcctgctaaaaaaaaaaaaa

SEQ ID NO: 17815 - DNA, 219 bp, Homo sapiens
  misc_feature (1)...(219): n = A,T,C or G
catcccactagtagcaaaatgatctcanaaaatgnaatatcttgctngaagtcacacagctggtttccagtaaggtgaagattccaaaagaattaaacctgtgaccacaagagaatttctgtatatcttattaaagaaagaaaaacaactatttggggaaagtgggataggaaaatgtttttaatgaactatgccctgcaaatatgaaaaaaaaaaaaa

SEQ ID NO: 17816 - DNA, 382 bp, Homo sapiens
  misc_feature (1)...(382): n = A,T,C or G
cttccagnnagacattgtttgagaagcacaggactataaaccaaaaaggaagaaccactctacagggtcttaatgaagcctgcccagagcaacattggccatccaatggtaggcatgcccaacaatgatcttgtgcaaggggatctaaaaagctggcatgcaaaatcttgtgggtttgtacacaaaataaaataataggcctccttagaaaagagaataaacaaaacatattgaatactgccaaaacttgaggaatatgcaattattacattaatgattattaatgataaagttatctttaatttttcacagtttatttagagttaaaattgaatgactttatataaaatgttacaactttgaaacaacaaaaaaaaaaaaa

SEQ ID NO: 17817 - DNA, 309 bp, Homo sapiens
  misc_feature (1)...(309): n = A,T,C or G
ctcccaaggggacacatcacacctgcgcctaccanganagcaaactgaggagacagagccagttggagagaaaccatcaggaacgtattggtccctgtctgcaactgaggccttctgcttgtttctctctgctccagtgccatcaaaaagaaagaaagaaagaaaaagctacaaacatgagtcaaggctgtatatagcagctctggatcctatcccagttgggttgactactttgggctcagtgtctcttggtaagcagtgatactcacttgtcaaaataaaggtggaaaactaagaaaaaaaaaaaaa

SEQ ID NO: 17818 - DNA, 474 bp, Homo sapiens
  misc_feature (1)...(474): n = A,T,C or G
ccagggggccaagtgataaatttcaaagncgaggatctacccttatacggttcacagatgaattaaggagtgcagatgtgccccagggcagctagagaacaagcaaaatcggtcctcaagcattttcttgcttttctcaaatatgtgggaagacctctaagcaggaagagacacaggtaactgtaaatacaggactgaagaaacagattaacctgctcaagctaatttcagaaggtttatacacccaagaaaagtcattcaaacaagccttaaggttattcatatactactcaaatgtggaatccctatttcctttaaacgtgtaatacaattatattttctttaatattaattttgcttcctccttagaaggaaacctacttatctgtaaattacatttcaaatctaattatcctgtcaatttgcagatggcttaataaagaaaaacaattgcatgccagaaaaaaaaaaaaa

SEQ ID NO: 17819 - DNA, 1031 bp, Homo sapiens
  misc_feature (1)...(1031): n = A,T,C or G
gcagggggccccagggagtaagtaggttttggnnggntttttcgaaatattgctattgtgacccatctggtctcaactcctggcttcaagtgatctctcatctcggtctaccaaagtcctgggattacatgtatgtattagttcattctcatgctgcaaataaatacatacccaagactggataatttataaaggaaagagttttaatggactcacagttccacatggctgggaaggcctcacaatcatggcggaaggcaaaagaagagcaaagggacttctaacatggcagcagacaagggaacttgtgcaggagaactcccatttataaagccaccagatctcatgagacttattcaccctaccactgaacagtatggggaaaccaccctcatgattcagttatctccacatggccctgcccttgacatgtggggattatgacaatttaagttgagatttgggtggggacccagccaaaccatattaaggtggtgaaccaccatgggccggcaactaacactcattgagcctttattctattggcgatattccccatatattgtgttttcttaaaaacaatcacacccagaaaagtattaaattagatattttctctttcccaaactaccagctttttcgagggggggaactcacaaaagtctgggtggaccctggacccaggtgcagaataataatacgaccagatattaacctcctgtctgaactgggaaaccttttttgccctctcacatgggcaaatgggcccaatatataattaaattcccaattcattgttccactgtgtccaatttacaaccaattatattagttttctaaacaaagaaagcacaccctcgctgggtttaataaattggacccttcgcacaccaacaggctagnatatggtatgaattctcccacccaatacaaacgctgcgtcgagcccacgggaagacttttcttctgtggtctttagcaagtaacccccccttccaacacaaaaacgcgtctcctctcccaataaaaat

SEQ ID NO: 17820 - DNA, 342 bp, Homo sapiens
  misc_feature (1)...(342): n = A,T,C or G
cagtatattgtgtggnnaaatccacctgcctgnctatgnanacacacaancagcccttatggataaattgtagtggtgaggaaagcagcctttctgaagacatccagcaaggaacagagaccttctgccaaccgccatcttggaattggatcctccaatttctatcaagcccccagatgatgatagacctggccaaccagttaatgagtccttggaagatttcaaccccaactatttaatacttgactaaactaagttaaaccatccccagattcctgacatatgtaaaaactgggagaaattagataaataaatattaatgttgtttcaaaaaaaaaaaaa

SEQ ID NO: 17821 - DNA, 283 bp, Homo sapiens
  misc_feature (1)...(283): n = A,T,C or G
tttccaggttttcattttggcattttcaaaactgnaagaaagnaaaaccttccanatattttttttctcatactgaaaacaggggtgaaaggagagccttttaacatgttacaataacctccactgggagataagggcagacataatgttgatcattgtgctttttatgaagataatactctatagaaagggcatggccatgcctcagactcaagagactcacatgccatctataacattaaataaaagcatatctgcctgacaaaattgaaaaaaaaaaaaa

SEQ ID NO: 17822 - DNA, 370 bp, Homo sapiens
  misc_feature (1)...(370): n = A,T,C or G
ccaagatcatatgattgtaactgttcgggcacggtgnaggcaagaggaacgtacagttacagaatccgtgggcaaagcatctcggggccaggagcgagcctgaaggcactgtgtaggccttgatcagtttagcaatttctacgattctgacatcctctttctgttctttccggattcaggcatccaaggtcacctcattatggctctgtgcgaagacagcaccccaaaggggccatcgatttggaacatctgatcggctttctgagtcagatccactagctcgtaaaatccaataaatgtcaaagatatgtcaggcccattaacctctggaggtctattaaaagactctgcttctgcaaaaaaaaaaaaa

SEQ ID NO: 17823 - DNA, 276 bp, Homo sapiens
  misc_feature (1)...(276): n = A,T,C or G
tttccaggcctgccaccaagnaactactgcaatcagctgttctgaagaacccanaagaactgaatcaccaaagatgcagtttccacatcctgatgattttatcatccttactctgaccaaacagtgacctcaattttacagcccctcacaccctataatcatcctaaaaacttcagcccagaactcctcaggaggataatttgagggtttctcccatttccttatttggctgccctgtaatcattaaacactttctctgctgcaaaaaaaaaaaaa

SEQ ID NO: 17824 - DNA, 856 bp, Homo sapiens
  misc_feature (1)...(856): n = A,T,C or G
cggtgggcccttacctatcaggtgagtcctttcaagggactcctctgacattggaaactcaaagcagcagaaactcactgtggccttaaagaagcaagctgtcatgaaatgaagctgcaaggaaatgaattctgccaccagtctgaaagagcttggaagcagatccttccctagccaagcctccatctgaggatgcagcccagctaacacgttgatttctgccctgtgacaccctgagcagagaaattggtgaagccacccagccttctgatttatagaactgtgagataatgaatgggtgttatttcaagctactgagtttgtggaaattgttattatgcaccatacataatataactaacaaaactacaggtctttatgtgctgattaaaaaaagaaaaaaaaatggccctagccggccctacccgcggagctcctgccgacgctcaccttcgcggagggtacatacctgacgctcagatcctgactccctggcctgcccccccaccccccccccccagccgcatcccccctccctccccgggcggccgcatccgcgcctcccactaccaccccggcctcaggcccgcggacgaaccatgcgctgcctaccccccatccacacagaccctcccaccgattacatgccccaccctacctaaccccgcgtttctccctcccgcccttcaacctcttcctctgtctcgccccgccgcgtgagtccgccacccgcatntcccggccgagtgcgggtcacgattgccggtgcctaccgcgtgcctccagccgcctatacagcacacactacctccattcaccagcccccaacctactcctcgacccactcggttgtgct

SEQ ID NO: 17825 - DNA, 262 bp, Homo sapiens
  misc_feature (1)...(262): n = A,T,C or G
ttaacaagggtcttcttgnaaaatacaacagncagcaagtgcaagcaggnactaagnataagagcctcaaaagaggaagaaggcatcatgctggaaggtttttagattttttactggacagactgtggttggaatccatggcagcataggacaacagaatcaaaatgtaatagctgtcattttagtaattaactacataaccagacaaatgtgtcatattttactaataaaatagtaaagaattattgtaaaaaaaaaaaaa

SEQ ID NO: 17826 - DNA, 1280 bp, Homo sapiens
  misc_feature (1)...(1280): n = A,T,C or G
ggaatgcggnnaaggtagggaggggagggnnnnnnnngatagagggaagtaacagcttaataggtttttaggaaagggggatttttttcccgaggtatgtactgtctaggactaatggccctagntncnctntacaagaatgcctgttagacnaagcttatgaaggaaggaagaaagattgcaccacactggagacatatagggaactcgtggcattaacaggctttgcaaagttgtcattctcaaaaatataaataccattacggcctcttcaacaccacgctaaatgtgtggaaatataagttacagtgtgattagtgaattgacctttgccttcagcatattaatnagaattaggtttttactcttgcncaagacnacactatggattttctagaaacactgaataggccgctggccaagagaatggcggaaggggagattagaaatgtggctgggggcggttttgtggaaggtccacccctccaagaggaaagaataaattagagaaatgggccctttcttttgagagactaaaagtgggtagggaggcgttgtgccggcggccgccttcccgcttgttagagcggagggcgctgagagtgtcatgcatctcttttgggtggaggggcaggtatttttgacaccttctcgctcgcttcaggtatttcccgccgtatgcggtaattaaaacttgaggtcaataaggcgggggtgaatacaagctttcttcaccaaaaggcgcgggggataacggcttcggaaaaacaaactggggagggcataagggtggagggaaaaagggctgagatacccgttgcccccgggcctcgggggcgcctcgcccaccattttacgacgaggcgtcccgcccccggctgttctatccattgcgcgactagctcgctccctttgaagcgcacgaaggtggggtggaaccgcctgcaagggatcttgtgggggggtatcctccgggttgctacccccttgtggaagaaaacccgtgggggtcctcccccgcttggatatatccccttggcgggttatcacgggtatttctatgcccgcgtctccctcccgcgtatgggaaagcgcggggtctctctttccgataagggacagcccgtggggatgtgtttctaactaccacaaatacttggggttctatcacctctacccgtgggccgtggttctaccgaacccctcccgggtccgtgtgacgacaccattagctctttntaccaccactataaacgtgttcttttaaatcatcatttttt

SEQ ID NO: 17827 - DNA, 891 bp, Homo sapiens
  misc_feature (1)...(891): n = A,T,C or G
ttttgccaggggttttcagaaaaccctttgcaactttacatagcattttgaggagtaaagtgacacctggaaaaagcctccttgagaactaactccccacaaactgatcagatgtcacaactgtgatttttcttcagagagagcaaaactatgggttaagatgtgtttggaaggcagaaatctgaccaagagtctgtcgtgaggagcagacatacagaagaatgattcacaagaagacctcctttctgtgcattgaacatctatccacagagcacatcttcattactaggggagagcatccatcagctgacatggtggtggcagcatggtcacaactgaggtgcggcttcagaaaggagagcttttcaatagttagattattacagggcccaactaaatgcctcaaatccccaggaatgtagataataacaattatgcctctttctctcttttcctcacagacaaaaaggtaacttatgttgcataattataaaaaattccaaaataaaaatttgaaatatacaggacacttcaaataatacatctacatgttttgaatcatcttcctaaagcccaaatanttgttgttgtgtacccaggcacagtagggagctgatcattacaaatgacagcaacaacattttaaaattataaatcttaaggatatttaaataaatgtatagcaactaataaaattgaaagcaaaatgtatactaacttaacttatattttattagcagatatttgtctttaaaacctgttattagtaaatttaattatgtaaaattttgcatgtatatcttacgatggcagattatctttgaggtcttattattcccttttttgcggtagagtcaaaatcctttctttggttgggttttatactactgg

SEQ ID NO: 17828 - DNA, 290 bp, Homo sapiens
ttgccaatactgggcattcttctggcatcattacttcttcagcttgagaccttcttttagcatttcttgaagtgtagatctacttgtgattaattctctcagtctttgtttgaaaatttgtatttgcctttatttaaagatactttttttctggatatatgtttcttgctggaaagggtttttaattttgtctttttattttttcatttaaaatttaatattgttccattgtcatctgccctccatcggttctaataaaaataatcaatgaaaattgaaaaaaaaaaaaa

SEQ ID NO: 17829 - DNA, 406 bp, Homo sapiens
  misc_feature (1)...(406): n = A,T,C or G
ccttgccganacacagcccacggggnactgcaagaccgccttttctcacggataaaccccttgccactgtgaactcctccgatgtgacgaatgatcgctcagcacccatcattcgatgagaggacagccaagactctcccgggcctctccggttctcccttgcggaagatgggcgcgtcctgtctgccgcgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctggtcagaaacaggaaaactgggtttcaaatctaaaaaaaaaaaaa

SEQ ID NO: 17830 - DNA, 244 bp, Homo sapiens
  misc_feature (1)...(244): n = A,T,C or G
tctggcggnnagagattcaaagttacccatggnagctgtatctcaaactcanacgtttggaagactcatagtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattggaaaaaaaaaaaaa

SEQ ID NO: 17831 - DNA, 327 bp, Homo sapiens
  misc_feature (1)...(327): n = A,T,C or G
catggctcaccctgtaatcccgcactttgggnaaagagcggnacacaaggtcaggagtttgagaccagccagaccattcatggtgaaaccccatctctactaaaaagaacctttttttctttttgatgtttatttatcttattttttaaaaagcatatttactctgctccttacatcattttgtttgtaatagttatttgtataaaatcttcattatattcattatattttggaaataaataattttatacatggtgttcccatactgtagtttactacccaatgtaatgaattaaatgacaatgtttatttccaaaaaaaaaaaaa

SEQ ID NO: 17832 - DNA, 540 bp, Homo sapiens
  misc_feature (1)...(540): n = A,T,C or G
tttgccagggnnaataanaatggnacacctttgnanagccatttttctgctcaccacaaggccccagggaaatggaagaggatgctaatggagggacccactggcacccactgagttggtatgaagagtattttaaactgaaacatttaagacacagcagatacagaaagaagcctttctggagcttcccttatttgactaaagccagagctttcagagagtgaagctgccataaattccctcttggggagcttcactgccagtaaggagactttactgccaggaaggagaccacttgcacctgaatgacgaattgcataaccgaacataatcacaaattgtcgtaccatcatttgtttccctaaaagcccatttgtctttccacaaaagtatatttgctttcccatagaaccctttctctcctcctcccttttcccatattattggcatataaattctcatccctaactgtacagagagcctcttcacctgagtaagtgtaaataaaccttgtctattctcctgttaaaaaaaaaaaaa

SEQ ID NO: 17833 - DNA, 417 bp, Homo sapiens
ttttccggaggaaaacaattggtggaggcatttcattatgggaccagcatttgggaaccactgcactcatttcctgcccaaccagagttgacaaggctattttcttccttgacctgaacccagggtctttgtataactccagtcagaataccctcctcccacccatttctgcctggaaatctattccttcgaagtcaacataagatattaagtagaaaaaagccattaagtattaagttttatgccctaaacagaggtaatccttctccccactaaatttacttcttgaggggcttactattctaccttttggagttgtttttatataggcccaaatcagcagcatcttctcacctttgtagaaaaggacctcacacaagtaaatatttgccgaatttagtgttaaaaaaaaaaaaa

SEQ ID NO: 17834 - DNA, 549 bp, Homo sapiens
  misc_feature (1)...(549): n = A,T,C or G
aaaggaggcctgagggagctctttcaccctttctaccatctgaggacgggataagtgttaatgtggaaaatggtgccatattttggaaggcaactggaaaatgacacatggcaagcttggcagcacaacagtcgtgaagcagttcatgatcagccttggaaagttgcagagagatggcangcaatgacagtgattcaggccctccctgattatacaggaaataacatctaagtggggnggngtccaaaatttttagaacaagggattctgatggaaaaatatattggaaggaaaaattaaaaaaaaaactctaaaccctaaaattggccttttgttttcaaagaaatcgaaaaggaattntttgggggcgcccccctannnnnnnnntnnnnnnncncccccccccaaaaaatggaaggggggggggtaaaaccccccgcgccgggggggagaaaaaacccccccccccccgttttttttttaaaaaaaaaaatattaaacccccccggcctcggcaccccccnnnnnaaaaaattaaaaaaaaaaaaa

SEQ ID NO: 17835 - DNA, 287 bp, Homo sapiens
  misc_feature (1)...(287): n = A,T,C or G
cctaggcgaggnctgagactttggctcaaggnaccagtaggggcatgggagganagagagcctgggcctttcctcccttgctccagcaccacatctctggcagtgactgtgactctccttagctacagctcattctggatggaacctcttccctggctccagagctcactagcttctggtaatacgattttcttctctttccccttgaagaagcacatagaatcatgaccaaagaatacttatttagggaaagcaggaaagttgttgacactttaaaaaaaaaaaaa

SEQ ID NO: 17836 - DNA, 259 bp, Homo sapiens
  misc_feature (1)...(259): n = A,T,C or G
acctaaaggatnaccctctgnagataaagcattcagtggnaacccaccctaaagagaagaattaagttcaagatttaggaaatattgattcaagactttgactttcttgtctcacttgccagatggccttggataaatctgtttcctttttgaaattgatttttctcatccatgaatgaagctataaatattcagctgtctgttgtaaaatatcacagaggataataaaatatagattctttggtcaaaaaaaaaaaaa

SEQ ID NO: 17837 - DNA, 253 bp, Homo sapiens
  misc_feature (1)...(253): n = A,T,C or G
atctcagtnngatctncagtcgccactcagnctggnatacggtggtgtgatcttggctcactgcggcctccgcctcnctggatcaagccattcacctgcctcagcctcccagtagctgggattacagatgccactgcgagaacgggaacaatggaacaggccctcaccaaatgccaaatgtgctatcaccttgattttggatttgccagcctgcggaaccgtgaggaataaatttttttacttatgaattaaa

SEQ ID NO: 17838 - DNA, 1370 bp, Homo sapiens
  misc_feature (1)...(1370): n = A,T,C or G
gattatcatnnntcttggantnnnnnnanacnnanatccnnagccnncgccctcnnnnncgacncngcnacnncaacnnaagngaagcatccanactgcnnctncntctgncnctggcnctngnnanagnaaagtaattgttagncaaccnaacngncaaacaagcccgaacnacaagcaatgcaatcactccgccctccgtctctcgcngnaacccnncgcaactctgctctcgcacaaggtgtggacccactcggtgatcacntctgttctngaggcgtgcgtgtgctggcggctcgccgcctgctggccttcgcggccgtccgtcctgggcctcagcctctgtgtgcctccccctngcnggggcacctgcgctgcgcatatacttacntcttcggggcgcgcgctcccctcggcggcggcgcggcgccgcgcgcgcttctctttccctcccgggtcccctcgtccctgtcccctctcgcgccgtttgtcggtggtgctcgttcggcgcttgtgtgtgtccgctttgtgcccgcgttcccccctcccgcggtgtgctgtcccgcgctccccccgccccccgcctcgtcccggcgccctcgcgccctccccgcctccgtcgccctgccgccccgcgcgctcccggcccgtcctgtcctgtcccgctgctcgggccgcgtggccccgcgtctcccgtcgcgcgcgccgtgctccttgtgcgcgtcggttcccgccgcgcccgctccccgcctcgccccgcctctccccctctccccccgtctccccggtccgccccggtgccccctcgtcttggcgccccccgtcccccctgtcgcgcccgttttttcttcctctccgcctctgtccgntgccgccccccgccgtctcccgcttcngtcccccgtgcgcgctccgtctctcgctcctgccctccgcccctctcctctgctctccttcctcncttccgctccgctcccgccgtcgggtgtggttctgtgcggtctcctcccgcgccgccgctctcgtcccctcgcgcctctcgcgcnctccgaccgcgcngtcggtccgtgccgccgcctccgcgcgcgcgcgcgcttccgcgcgcgcnccccctccgccttctgtcgccgtcggctggcgtctcgtccgcggcctgcgccctgttctccgccgcgctgctgctctgtctcccntccccgcntgccttctcctccgtctctgctgctntcgtgccgccgctcgttctctcgctgcgcgccgntcgtgccggtcctttccgccgtcgtgcggcgcgcgccgtgcccgcgcgcgccgtctgcgcgcgcggactccacacacgaagacaaangcaggtcgctaccgcctcatca

SEQ ID NO: 17839 - DNA, 874 bp, Homo sapiens
  misc_feature (1)...(874): n = A,T,C or G
acctagctagtggcttcgtgtggtatgacttatcctggnatttagnattgaagataatcctgatgcttcaaananaagagttggaacacagtccttttttctaaacagaggaattgttgaatatgcgactgaacctccgacttaactaattagttaatttggagcagagtttgaacacagtcctttttctaaacagaggaattgttgaatatgcaattggtcctctgacttaactaattatttaatttggaagttataggttttttattacttgaggagcagctttctctgaacaaatacagtgtcccctggggtgtccaaattgtgacagaaaagtagcgccagcttgaaactagctagtcatcacatagtggcatcatgtgaatgaagaatcccccaaatctgtgacccacttctatccttatgaactaattcaataaataaatgagcactttctcagttcccaaactgagagcagtttaaaaaataatgagagcacagatatctatttagagagatggcgagatagaggagagagcaagttgcacaccacgaaacaaagggaaagataagaagagagagtgtgtcactacttccccgtggcagaatcacaatcttttttggatgtcatgttgaaaagattccaattcgtagttctgtgagctaaagcagatggatgcttcatgttggtacaaattcctatttgaagcagtgtggttgcaaagatggcggtttgggtcatttgattttctcccgacaaccatcttgtgtaactgttcaaagactttataatacccaatgcaatgtataatccgggatgcttcttcaaaatgttaataaatgctgacaccatggttaaataaaaaaaaaaaaa

SEQ ID NO: 17840 - DNA, 1180 bp, Homo sapiens
  misc_feature (1)...(1180): n = A,T,C or G
atacgctctgcaccaacaaaaaccttgccccttgtgtcttagccactttgaatgaagcatcactttgcacacggcagcaggggcagaaatcagcaattccgccattcctcgcagcataacttctaagcagctacacgctcttcagactatcatgccggcagttcaatgccaccgggctcaacaaatcgtgccgtcgacgcattcgtaagaatgcatctaacaggcaagcctggacagcatgcatcgcgaccaagcatgncgtgctggccccgtgcacgaggtggggtggtgtggccctctagtccgccgcgcctcctccaccccatccacacgaccatgtcacaagatgccccatcgcttcgtcccctgtactcaaataatgctaatcatatcacttataaagaactttcccaccagagcagataaacatccggaaatcacgtgcacgacgaaggaacacgtaagacccagaataaaacagttcagtgcgcataacatccactctcacctcccccctcacacataaacgcaacgacacgtcacccatcgccccccaacaaccacacccgccccgccctcgtccacccggttccgttcaaccccacccgcccattcttcctccgtacacgcccgcactaccgccatccctacttccccgcacgtaccgccccgcgcacccacgagacgcgtcccccaccccgtatcctaccctctcctcgtcgcctagtccggcgtcctacatcgattcaacgcccaacactcccgcccgtacgcgcgacacacccgcccgcccactaccccccacaccctccagataccgcacggcacgttacccacccctattcatgttccaaccatatccactcaatacctcactccgaatcggccagtccacccaatcgaaactcacgccacccgccctcctcgccacttcgcaacgaatctatcctaccacacacacacttacacctaccatctctctactcctgccaccccccgtcgacctcaacacacacccactcaaccacantcccacacgaatctagagtcgacactcactcagcgccatttcacccgactcctcacctctccccacctccccaccctcatcgccgatcccgccacctcctcatccggacgacacgccacctcgcgcccgtgtcgacccgccccagcacat

SEQ ID NO: 17841 - DNA, 431 bp, Homo sapiens
  misc_feature (1)...(431): n = A,T,C or G
gctggcgaagatactgnanatataaaaaaaccacttctgcccttgaagactcaaatttgtgggattttaacaggaacatacctaaccaaggaagtgaaagacctctacaaggaaagttatcaaacactacttaaggaaatcatagacaggacaaacaaatggaaacacatcctatgctcatggataggtagaataaatattatgaaaatgaccatactgccaaaaccaatctaagaattcaatgcaatactcatcaacataccaccatcattcttcacagaactagaaaaaacaatcctaaaattcatatggaaccaaaaaagagccccacgtagacaaagcaagactaagcaaaaagaacaaatctgaaggcatcacattacccaaatttaaactacactataatgttgtggttaccaaaaaaaaaaaaa

SEQ ID NO: 17842 - DNA, 252 bp, Homo sapiens
  misc_feature (1)...(252): n = A,T,C or G
ggaggggggcgtagggggacgtggtttggaggctcgcggtcttcaggtgcccccccaggnagcccccccccgaaagaganaacaaaaaacgacagagattccctgtttgggccaaaattctgaagttgaccaagacactttgaactattcggctgcactcttagctcaaagttgctgatgtctgcagatgggccattgacggggaacactcgggagatcccggacttcgtgtccctgacttctgccacgaga

SEQ ID NO: 17843 - DNA, 312 bp, Homo sapiens
cttgccatatcagggcactcacgatctgcccagctgattttgaaatcctgagctcaagctatcagcctgcctcagcctcctgaagtgctgggattacaggtgatagcatccggccttcaatattttcttgatgaaagagaggacttattactagtcctagattattatgaaaaacagcaatatcatgattaaatttttgttcctccttccagtactgtgttctattaattagataaaaaatggtaatgaacaaaaatagacattaaatcaaatgttttttactttctaaaagtcgaaagaaaaaaaaaaaaa

SEQ ID NO: 17844 - DNA, 1334 bp, Homo sapiens
  misc_feature (1)...(1334): n = A,T,C or G
cgcccacggggggggcccgcttttgggcnctagtagaatgattagagttctttaggaaaaaagnccctgcggtgagntacattacnagtggtttgcgacccaccacgaagggaggacncctgcctgcctgcctggagncagnatgaggaacaaaggaaaagcgaacagatgatatccctgtttgggaccaagaattcctgaaagttgaccaagggaacactttgttgtgaactgcattgcgtgggctgcgagaactgactgtaggacatggagaagggttgtgcgttcgatggttgacactgcgaagtacttgggtgcgcaggtgatgagtcagaggggcgaaaactgcctgcagggagattgtgcgaaggagctgtcggtagtcaagaaagtgacttctgctcgcacgaggcacggaactcccagtccttccccgatacaggaactctcgtggttgtcgatctgacaacgtgaggagtggtcgttctgtcttcctctatccttcttcctctcctggccgcgctctccatctctcctctcctcgcgcctctgcctctcgttccctcccgcctcctactgctcgcggccgccccttgtctcctcgtttccctttcggcccctcctgttctgctctcctcccccacccgtcaccccctccctctctcctttgcccgccgctgccctttctttccctccctcatggtccccgntcccgcgatcgcgtgtttgcctgcatgcattgcgttcgccgccgcactcttcccgtccctcgcgctcgtttttgttctccgtcctcgactaggctattcatcgttgtccggccctcgcatccttcgccgcgctcttacgtcggggatcggccgctcatctctcctgcactcgtttcactcctggcgcccaccctgccctcctccgccccgtcccgcgtctctcgctccctgttcccccatactccgtccgtctcctcctattttntccttcatgtccgantcccgcacgtcacgctccgntctcgccctcggtcggtcnctcgtcccgttcctccgccgcctcgacactcctcatgcgtcacacgcgcgtcctagncgtctcctcgctccgcgctacgccgtccctaccgctcacgcctcgtggttgtcgtacagtatctgacntcgtcctctcctctctacgcgtattatacgtaccagtcacgtattcctctntccctctctcgtatcgctattcctattttgtttngcttgtctccttgctcccgtgacacttttctccggttccgcattncgtatcattcggaccatcctgaggagacatgacgcgaaccacgcaaccag

SEQ ID NO: 17845 - DNA, 601 bp, Homo sapiens
  misc_feature (1)...(601): n = A,T,C or G
gggcaggggggggcccgcttagggcgcngaggaagattaaagtcttttaagacacaaagcccctccngttgagncagcatctcccgacgtgtttcgcncacacncacgagggntagnacncctacctacctncactgaaagttggatgnagtaacataggnaacagccgnaacagnatgcanataccctgtcctggggagcccagnacatctcctngacaagcctgcctcaaagggaacacattctcttggaactccattcctgcggctggcacaacttagcttaccactgtacaacaggcttctcgctgtagcatcggntctcggtngccnaaggaagcttggttcgcacatatgattgtatgcagagcggcgcaacacatcttcctcgnagcgtagtgatgtgcgcgactggactctctccanctcttgcacacaagagtggacgtgctcacctnggatnggaagggagggtaatgcccgcacccgcttccgcgggccggagcaaacccacgctcggctgtcgcaacgcagccaagctggacagctgcttggctgccgctcgcaccaccttgtccctccacctcgctgcgcgggagtct

SEQ ID NO: 17846 - DNA, 338 bp, Homo sapiens
  misc_feature (1)...(338): n = A,T,C or G
gcttggccggagtncanaaagactagtccgttcctggtttggtgatgctggnaggaagaagnagacatctacgccagagaaaaagagtttattattcacagtacaggaaagaaaaaagccatgcccatcagaatagacttgactttacacttgaggaccagacagcatgataatgaagaacatgggctttggaatttgacaggtcttccttttgttaatagcatgtctttgggcaagttggtaaatctgtctgcgactacttctttatctgtaaaatgagggtatcttattgggtcacagaggattaaatgagatatagcacctgaaaaaaaaaaaaa

SEQ ID NO: 17847 - DNA, 766 bp, Homo sapiens
ggtgcgggtcattcatggtgcccccccaggtgactctctctgagagaggacaagaaagcgacaagattccctgtttgggaccaaattcctgaagttgaccaggaacactttttgaactcattctgggctgccaaacctaccttttaagggcccgcacaaccccgcctttccaagaggggctttggggtttggggaggggtccccttggcccaaggaattgggttggccctatttttggaatcccaaagggggggcacaaaaacctttcactttgcctgtggcgctcaacattggggaggccccccgggggccgccccccccctttttccctttttttttttccccctaatatcagcgactcctcttttattcctcattttttttttggaggggggggatatattccccccacccgccgattcttttcccccctttctctcgtattgtgtcggcttattaactctgctccctttttccgcgcgggggttccgctgccgagcttccccgggcgcgcgtcggccctcattttaatatgatctttcgctttctccccccccctgcgcccctgcgtcttactcccttttttggtgtttgtggtctattatttgcccgtgtttttggcgggatccgtgccttccatgcttgtcttcttccccccactcatatttctttttgtatatgtcggggtcggttgttgggatcatagagggggacagtgtgtgttttttttttccgcttgagtcggcgagtgctcttctcttttgtg

SEQ ID NO: 17848 - DNA, 543 bp, Homo sapiens
  misc_feature (1)...(543): n = A,T,C or G
cggcggtggggcngccaggggccgacagtttgagttttggaaagacctcgcgtgnnagagacctctgtcgcccagctggnacgcacggtgtngactcggctcactgcaatctccgaatctccgcctcccagttcaagcgattctcctgcctgagtctcccagtagctgagactacagacgcccaccaccacgcccagctaatttttgtatttttagtagagacaggatttcaccatattggccaggctggtcttgaactcctgaccttgtgatcagcccgcctcggcctcccaaagtgctgggattacaggcgtgagccactgcacccggcctatgtattcgtttctttttaaaaaaaacctatggatactaggtatgtctacatgacacaaaaattttttgccaatacagaaaaagtctatgggtattataatttaaacttagctttgagactattggttaagattaaaaaaatactactaaaagctgaggttttaaaaatttaaaatgatcatttttattatgggctgaaaaaaaaaaaaa

SEQ ID NO: 17849 - DNA, 446 bp, Homo sapiens
  misc_feature (1)...(446): n = A,T,C or G
cgcctgcggaggaaaaagctggnactcgganaagnaaggnagcatgccacacaagnatgaaggctagtgatgcatctacaaagccaagaaagtcagagactgcctgcaaaccaccagaagctaagagcaaaagcacaaaagcgattctctcccacagccctcagaaggaaccaaccctacagacatcttgatctcagatgtggagcctccagaactgtaagacaacaaatatctgctgttctaagctacttagcttgtgataatttgtcaaggcaaccctaggaaataaatacagggaacttcacctatgtctccgttttctgtatctgtaaaacaggattagatctaacaagcacctagttattgaggttgctatgaaaagcagttgtgataaaataaagcagagtgactagtccgtgttacaagctcaaagaaaaaaaaaaaaa

SEQ ID NO: 17850 - DNA, 669 bp, Homo sapiens
  misc_feature (1)...(669): n = A,T,C or G
gctttgccaggaaaaaccaaaccatcaatgggacgatacacaaggcacgctggnagaggccctggatgaaaagaaagtaaaagcgaggaacctcacatgatttgtatcattatgtatttctgagccaccctgcaagaaagacattttctcgtcctttacccttaccttctgcgctctatcagaagacgaagagacacggacaatcagaactctctcagtggaaaagccagtactgccgaggtttgaggaagggccaatgtattcaaaatctaactcagagaaaattcacaggagtcttttttaataaattgagtgccttcctgccctgcatttcaaaagcaaatggcactgtgtgttctgacgtcaatgaagtgagaaaatgccacaacacaactcatatatctctcagaaatttgtgctgacactacaaatcccctttttacatatttaactggaaatgatgacagacattcagctatctcaactgcgaaacagagaaaataataataatgtctgctaaggtgtgtgaaaattaagttagatacattataaagagtaaaatgctcaattaatattatttgctattattatttctaaaatgccactattaatcatttctttaaaagagaggcaatagatattacccttttaaagtcaaaaaaaaaaaaa

SEQ ID NO: 17851 - DNA, 442 bp, Homo sapiens
  misc_feature (1)...(442): n = A,T,C or G
ggttctgggnctatacatccgtggatgcacgccttaatggnaacacgcctgcctcatacctcgtatcagtgtgagtatccctggaaaactgaccctattatccatcctgctgggaccaagatgattcaaagggtccctgcaccctccagggggccaatggtctcctggggaccctatgacggggactgccaggttgtggctgctgcggggagagatggacccgtgaacacctccaagacgagctgatgagactctacagaccgacaatctcaatttgttttatctgactagactattcttggaacactaaacctcattgttctacagataaactgaaaaggcgccttccttctttcgcagtttgctcctaaaactggttttttaaatagaaatatttggccactgaaaacaaatgcaaaaacaggcctctttggcctcagca

SEQ ID NO: 17852 - DNA, 329 bp, Homo sapiens
  misc_feature (1)...(329): n = A,T,C or G
cttctggttttgcgtgtatcttccttgnaaggacctgcattcctggnagaaggaagttgggatcatgtgttggaggatacatcgatgaataatgatcttcccacctactgatgagaactgtaaccaaactcagaagtttcttagtgtcatcttgtttcttctttgcagtttctcactacgaactttaacagggtttaagaatagaaatgtttggttgtacacattttcaagcagccttagagaaatctaatacttagatgaagactatgatgctaatatactctataaaactaataaaaaagaaatctccaaccccaaaaaaaaaaaaa

SEQ ID NO: 17853 - DNA, 352 bp, Homo sapiens
  misc_feature (1)...(352): n = A,T,C or G
ttttgatttnaaaactcctgnaggaaaaagnaaacattttatctttcagaaaaaaaagaaaactctttgccaacagaaaacataatatgcggactctatggctattgtttctgaaaaatataagagatgattacatcacattgtgtattctgtaggaaaaacactgtagtgcttatatggctaataatggaatgatctaagtcaatatattgtgcagttttgagtgacagaagaattacaccattattctttgtattttggtttctgcactaagttagtcatgttcactgtttcatcatcaattatcattcactcattttataaaattttagcatctgcaaaaaaaaaaaaa

SEQ ID NO: 17854 - DNA, 438 bp, Homo sapiens
  misc_feature (1)...(438): n = A,T,C or G
tgtctgagtgnacccaggccttcataaancctaaaaaacttcagncttgaaaaaaaaaaaccccagtcaagatgggtgcggctcttgtcatcagcacacaggcagtcctaatctgaacaagaaaatgcgtcacccatcaatccaagccctccaagaatgtcaagctcctccttgaatcatcttgtcctgacaccacctggctcccagggcctctgggcagctgtggctgtgcagcccctgcttttcacctgtctcctgtcctggagtgctcgttgcatcttcagtgtgttagttgcaccactcctttaagagaggctcatgccttaccttatcccctcaatgactgtcttatttttgtatgcccctaagagcagagcatggggctagagtggtagtagtgtttcaataaacacttgttgacttacaaaaaaaaaaaaa

SEQ ID NO: 17855 - DNA, 550 bp, Homo sapiens
  misc_feature (1)...(550): n = A,T,C or G
cgccgcggggggcccccccgcccctgggggcccnnggnnnnnnntttnnggttttttttgnaaanngnnntttttccgantgatnnccatatgcccnaaactgnncaccaacgagnctnctagtnaaaaaggnaatnatncttgntaangtgtncattccatgggactttaatggaaagaaacgcccaataggcctttcttcctttggaaaattggaagtttaaaaaggggggaacccccaaggggggaaaattgggaggggttttttaaagaaaaacccccangggagaagtttttcctcttttttaaaagaaaaagaaaaaaaatttttttcccctgccgccgcccagaggggtttttttattttttaaacacccgcgagaaaagaaaaatattataaaaagcggcgctgcaccccttctctttgtaagaaaaaaaataatttctcccttttttccccgaaaacaaatatattttttcttttggggagaaaaagacgcccgcccccccccccccctcttgttgggggttttgtataaaaaaaaaaaaa

SEQ ID NO: 17856 - DNA, 426 bp, Homo sapiens
  misc_feature (1)...(426): n = A,T,C or G
tttcggactctattctaatttgccgcaggnaatccccacactttgagaataggtgttgatttaattgttgcaagacatgaaccagacaattaaaaccatctgagtaatagccctccttcacaaccattttacagagaaggagaccaaggcccagagacctgatgccagctggccaaatgaccaagtgggaacggcagaactgggaagatgtttccatcccctgaatttcaagcacatgttttttctctttgtttttatcttgttacctctttggaaacccctaagccttaagccttctttcaaatattgaatgtctgaagggaactatttcattatttctaacctcttttcattctgctttcatgcataatttttctctttttctttccacctcacattgtataaataaaaatgttgatataaaat

SEQ ID NO: 17857 - DNA, 228 bp, Homo sapiens
tcagctttccttatcctgaaaagaccaacaacatttgggagattggagaaaactattatgaaatggaaggggcctgagctgggtggaatgagatcagtgaggagtcctgggggtactccaccaaaaaaacatcaaaagaagaactgaaaatgaaagtaaagcctatgttgaattagaaagtgactgcctttgtaaaataaaatttaattaaaagcaaaaaaaaaaaaa

SEQ ID NO: 17858 - DNA, 1566 bp, Homo sapiens
  misc_feature (1)...(1566): n = A,T,C or G
gaaaataataantanaattgtgtgcagacagccgcccgacttcggtgtaattgttatgnggatantngttgtatagtgacaaagacaacgtaattttcattatacggacggcggcgcgcgagncgtaacgttgatgatggttgttttcgttcagacaccacaggcacaaggcgcatagaagaagaaaatacccaaataacaactcagaactatgatcgagatgagacgcagagaacgtagagaagacgctcgcgacggacacgagagagagagcaagagaggaggagcagcgagtcagtgacgagtaggcgaacgacaatggcgagcggacgcgtcgagccgccgaccatataacacaaagatatacaccccggcacagtatctccctcctagctcacatagcttggtggtcgccgaagcgcgcatcgttcggagcgtcccacgcaaaagactaggaaggggggtgtataagccagagggaatatgaagaaggcgtgccaccgccctccctcacaactcgtagactcaccgcttctaaccagacgaaacaacaccggccccacaagagatgagcacaagtatccattacgagggcgcgtatgtacacgcaacgcagccacaccaccgacaaagtgacccatggttcagctcccggagcgtaattgccgttgccttagtcgcgggtagtcgagagtacgccggttncgcagcgcagtgtcccgataattataggaggaagtgtgtacgtatgtgcagactcacccacgcgagcgtgcgtnagacccaagagatgtggtaaacaagttagtatatccccgaggcgcacatgctagctcgggacatcgcgccgagctgccgcacccaagtattgcattatatagaacatgatagaaccacgtatacaccatcgcgtgcgctcagaacgacatctcgacgcagacgactgagccgcgacaaagacagttacacaagtacgnaccganacactattacacgtaacaacaccgagataaatatcaaatcacacgagcaattacgcgcatgcacgcgcgacagatagagtagattataaagagtcttcatgacaatagaagtgctctttcaactgccatgaacgtgaaacgnactagctaaactcaggttcaacacgtgcggcctgctgtantactccgagagagtatatatctcgtacactttagttatacaagaacgtatgtacgccacacctggcctgtactnacccgcatgcttatgtttagtaagagacagtaatacgttaagtcgtagagaggtacatacccatttatatccgcgcgatcctgcagaccgccacacgccgatatatgtataacacacaaaccaaatgcgacgcatcaccaagacaacacacagcgcactaccagctccgatnacgccgtctccacagaacacgcgacagagntgataagagatcacaccacagcacgccgntaaacacatgataacacagatacgagacatcgcgcataaccaacgcacgacgntgacacacgangccgcacacgccagtagaaagaggtaggccgg

SEQ ID NO: 17859 - DNA, 907 bp, Homo sapiens
  misc_feature (1)...(907): n = A,T,C or G
tcccagagagctctctgtcctgcgatttctgatcagcaccatnacaaacatatggttgcttacagtggacccaggagcaaggaaaccaacttgaaagggggcatctggtccccaccaagatttatacttcattttttgtagtgatgccttctactcatttaacttgataagaccaacagattggctactgataacacagaacacttctgaactggtgtgtgcacacactggacatcctctatctccgccaccagaccccacccccaagccgcgaaacccctgcccccgacatccgtcctccgcggcgcacgcggccgacgcacccccatatcgcccctacccccttccctgcctccccccccccaccctcccccgcccgcccctgagccgttctcatgaccgcgcccgtctttctatagcgctcggctcctccaccccccccgcccgtccacccgcgcccgcccctccccccctcgtacgtttgcggggcggcccgcgggcccacgcggccgccggtcctatacccgtccaaccagctactcagcggccctcccccccttcccacgcttgcctcgagcacatgcgagcggagagacaggtagcccactctgccctgacacgtaatgcaataagtcactaccaacccgtcacctctacatacccctcaacgccacttgcgcccgccccgctctcctatctttaaacccgcaatacatcctacgaccccgggagatcggcccttagagacatagagtcttgagctgacgagggtgagacggtagtgggtgggcgtgtcctatagatcaccgggccaagaggccatcttcagttttgattatacagacataatgagataccgtaggagtaagtccgaggactaaacgtgtaaatccgatgtatactcgct

SEQ ID NO: 17860 - DNA, 1850 bp, Homo sapiens
  misc_feature (1)...(1850): n = A,T,C or G
tcattctcatgnctgctctatcttgtatgcaatacgaancacacgatccacaagtaactgtgcantatgatcgttaagatcantactagtatgtagtacgactacactgcctcctatacacacgacacaaccacgcacatgatctataacgtcatgattgtgttatacacgagcgggagagcaggacggttcagtatttagcgacctcctaacgcatttacgtatcatgtgcgtaggagccgcgtgggacttgatcgttgatatagtataaaataatattataatattaactacgagaaccgtcgcggcgcgcgcggtcagcccccgcgttcgcgcgcccgccacccccataggcatataaaatttaattctctcctcgctcttttctcttgtaattaaataatttcctcgccctctgttccttcattcgcccccccctcctctctgcctccgcggcgggcacgccgggcccccgtggcaggcgttcttcacattttccgccgtagcgatgcttgattaattatttgtgtgctgaggcgttgtgttaataatctctctatcatatagcgctgttatatcaccaccgcatactgtagagtcccattaatggcatcattcgcagctaccacatttatctcaccttcaacattaagataatactcgatcacgccccatcccgcaccgattgattgtcctcctgtctccatgtgttactcccgctataccatactcgaccgctatctacatatttccacagctatcacacgttnctataacactcgacgatgaccagttatgtacaacttattgcctgttgtacacgccgcgtgcctgtagcgtacgtcgcacgtccatgctttatatcgcagataactagttctgtgcgtgcgccgcgcacttgagttatatatgcacgacgacgtctctgtcagtgtcgcgaccgncgncnctatatgtgtgatttgatgtgaatctcactcgaaacncatcagcgcacgncaacatacctatacactgtatgacgctatagacgcggtatcattntactcatgatccatagcgagcgtnacnncgcntgatcatatgaacgcgtcatcacattcatctctcgcacccacacgagtnctactatatactctatcacacgcattgttatgtgttctcntcttatacgcacgcgcacgtgcatgtgtgtacantccacgacagtcaatatatctaatagaactatgtagcatantgactacgcagcaactanttgtgatncctggatgtgacagtatatagttcgttagntnacgcaggatntctgacgtcacctcgtctatatgcagattatggtcanatacntacatactcgacgtcatgatatntatattattcttctcattgtantgtctcgtcnntacttgtgcaatacatacgcggcgttactgttagcactatactctatgttgtagtttctgcccacgtcnctatngtagtccgtgcgtgtgtagcgctnaaatgnatctagcacgctcatattcgtcacacgactcgttacataagcacctacactnacatctcttaatatagatagtcagcgacgatcagtangacgcntctcgacacttctcgctcaggcacgtcttcntgctcgccgatcttgtatccagacggtcattcgcgagctacgtcacaatcagtctggttatgtagttgagntaactgagacacgatgtcgggatcgtgtgtnngacancntgcntgtggtatatcgtggttcgtacntnagtatccgcatccatgcgatatttcatactgcggctcgtcnctcgacatttatctagcatgtatgtacgctgtcg

SEQ ID NO: 17861 - DNA, 445 bp, Homo sapiens
  misc_feature (1)...(445): n = A,T,C or G
ccatctgtggcatatgagacataanaaagnaaaactcttgctttttcctgaatgcacaagtctgccatgtggaaatatccttcaaggaaatatgacaaggactctattttgttttatatatataactttatttataatataattccacagaaccctctggtagaaaaacaatgtcctctgaacttcaactcagtatacttctactgataatcagattgcacattgacatgaccttgtaattcccatttactaagccatttctatttgaaacaagaaatgattttgccctctttcttatctgaggtagtattaaatagagtttccctcaacacgcccagtcactcaatctccttgtttcaaaatgcagtatacataatcaagttgaaaacatgtttactacaatatatttaataaagaagaatggtaaccttcaaaaaaaaaaaaa

SEQ ID NO: 17862 - DNA, 1676 bp, Homo sapiens
  misc_feature (1)...(1676): n = A,T,C or G
ttttnnnncccccccccccnccccntttttttttttttttttttnntttnnncnnnnnnntttatctttttgtgcagggcgcaggagccgtgtttatttgttttaaccatataaggaagcaacgatgtgctctgtctattagagtgtacaaattagtgaaaatggtagataggaagtgtatacagagatcagtacggatgtagagntagagggtgacatnacaatatagttttgtgtcggctacacgagtcgagcgtggcatacggcgccaagtgatcgaccccacncacccagccagcccattcgacacgccgcgcacgaataatagaggattagatggagtcggtacgtgagaganatattgtgcatgtcgtcgtttcaatggacggctagaggcgcgcccgcgccggcagagcgcctccgcggccgcgcgccacccccttntcgcgtggccgtgcccggtcgcccgtngcgcacgtgagctatgtcagtggtctcggcttagttggtgttgggtagtgagtgtgaagatgaatagagtgagatgccaaagctggtgtagacgtgttatatatgtctataccaatatgatatccacttcactattcttgtgaagatcacacccgcaattcagcatcagtacgcacgtaacaccgtagtgattacacgacaccacagcgngncnacacgtgccaaatacaagaacnccgctgggttgcgcccaccagccacacgtgtttccaggaacgcttgatcgccgtgtattaatagtgccgctgtgtcgcgactacagttaccgataanatntttctatcttatattatttctccgtgtatgcgacgacggccggattctcgtgtcgacctaagatggtagtgtcgntgaggatggatcggcgcgcgccatgtgaatatatcgaatatcacgccgagngcgcacgccctaccacaaatatttgcttgtatacgaagcgacgaacagctggatgacacggacaatgtagcacgaacgctattacggatgacaaggtggtagagcgcgtaatatcgcggtaatggcagtgctgccgcgccgcgggagtcagtcgacacaccggtatttggngttgataagagacgacacanaggagtaggacatgtaacgacaaaacatttagatacgtaataatactcctctgtacaatctgctttctgaggctcctcgtatgcgagactggtgagtagtgaggaccacgtctagtgccgtggacggattaatagcaaccagatcgtattcgtgcacaacctacttctgcttttctctggtgctcgcgcgcggcgcggcattgactgtgcctatattttctttagtactatacganacgcagacatttcgtggcattactcatctcttcgcgacgtatagtccgtccgctgatggcgtaccgccggtgcgctgtctagtnttagggcagaggacggacatagtgggggcgaacangaaggtgcagcgagagtcggttcacacgttttataaatattcctccataccgcctcgcatatggaggagactcacattatcgaggcgatagccagtgacgtacacaggacggtggngagctagtgnaatgtcactcgatcactcgtttagacgagtgncagtcgcgcacgcgtctgtatagtantnagatatgccgg

SEQ ID NO: 17863 - DNA, 340 bp, Homo sapiens
  misc_feature (1)...(340): n = A,T,C or G
ccttgccccggggcnncttgcanctncaactggacganatttgnacctggcaggnacaaattgttcactggnagaaatcaatgaaagaatttgacctacaaggacaaattgttcaattgttataaaattttcagtatttctaaagttatgatttataaacattagaaattaaaacttttacttcatttgttagtaaatatagtttttaaacagacatattttacagaaattgtttctaaagattttctcattgacaaagtgaagaatatctaaactttttaataatggctgtatgtttaatattaaatttctgtccagtacctgaagaaaaaaaaaaaaa

SEQ ID NO: 17864 - DNA, 925 bp, Homo sapiens
caggtaagggccccggtggctgacatctgtaatcccatgctttgggagacaagtggaaggatcacttgagaccaacagttcaagaccagcccaggcaacgtacaagaccccgtttctacaaaaaattgaaaaatcagccaggtgtggtggcctgtgactatagccccagctacttgggaggatgaggcaggaggattgcttgagcccaggagttggaggttatagtaatcgatgattgcaccactgcactccagtctgggccacagagtgagaccctgtctctaaaaaaataaaacaaaatattgttctcatccatgagttcttaatgaaattctaaattttgcaattataaaatgttaattgcatactccttaagatgtgaacatgtgacatttacatgtttgacaaattaacgaatgagcgaatgaatgtgaatgaaggtgcggaatattttacttgatgaaaactacatgtggaaagaaccatttctgagaccattgaggtgagggggaagaaaaaaaaaaaggtaaatggcctaagtggactagacggtggaactgtgagaacgcttacctttagggagggataatagatgatacagagtaactggactcgctacactacaaacacacaattgcaccgcaaccgatccgcatagctgctaggacgggttgacgcggtttcgcatatgtcgggtacgcactgcgaagaacttatctacaccgtccctcgtggtgtgcaccgtaataggtcttcgcgctaatacctatcctctcgccctctccctcgcacgcgtctcctctcccctcccgtcacggtttatttaattcgcgcgtacgtcacctgcgccttccccgtcactcctctcgcctaccagaattccaacgaaacgaagccttccatctctacctgatgaacatatatt

SEQ ID NO: 17865 - DNA, 929 bp, Homo sapiens
ccctgacctcaatgtgaaaaaaggatgaacaccttatgagatccatttccatttggtgaatgatgaagaataattaaggttattggctggatgaagttaaccaagcaaagtgacacaatgggaatctaaacctgattccaaagttgcacatcttttaaaatacattaagttcgcgtgctgagctgctgcgaataatgcaaagaactcctgatgctagatgtaagttgagaagaaattagaatcgggttggtatgaatggtaaacatcacgggataactggttcagtgtggccggactgagatgtagcagactagtgccgtgcggaaaaaatagattttcaatgggctctctgacctcacttcagcaagtgtaagatcgctaaacttaacagagggcgggaaggtgagcctgggtcccttcctcgttgattacaccccacactctcaccctgactccctcccccccccgaacaacccgctctccgcactacccccactcccttcactgcacggccgggaccttcgccctacctctcccggacgccgtttgcgcataaaccagtccgccccccgaccccctaccccacccctccccaccacgacccccccgacgtcctccccaacccccctcatcccctcccatcctcgccgacacattagcccccctcacactcaatcccccccgtacaccccaccaaattccaccgaatccggcgcccaccaacacgaatccactcctgttattgatgccccccaaagcggggttacccccatacccccatccctacgcttaccccctgccgccgcccccaccccttatcctgtttttggtaccccctcccttacctccgtccctcttcgccaccccgctacccccgtctcctcccccgtaccctccctctttcacccatcacactgccacactgttat

SEQ ID NO: 17866 - DNA, 288 bp, Homo sapiens
  misc_feature (1)...(288): n = A,T,C or G
cagggttctgcccanctagnaaaaatagcagtcttccccactttacttatgccacagaggtgatggatcagccacagagaacacaaggagcttagagaaatcgagtcctggtcaggcgtagtggctcacgtctataatcccagcactttgggaggccgaggcaggcggatcacctgaggaaacaataactcctgctgtggtagcattttctaatagaccttgctgcgtgtcaagaagtgaaagttgacccagaattaaagactcctgttttctttaaaaaaaaaaaaa

SEQ ID NO: 17867 - DNA, 280 bp, Homo sapiens
  misc_feature (1)...(280): n = A,T,C or G
cattgaaggaagcataatatcagtgccagnagtgatgcatgtganaaanactccaccagccattgctggctttgaagctgtaagaagaggccaccagccaaggaatacaggtggcatctggaagctgcagaggcaagagaatggattctcccccaggacctctgcaaaggaacacagccctgctgacatcttgatattggtccaggagactcattttggacttctgagctccagagctgtaaaataataaatgtgttgttttgagccaaaaaaaaaaaaa

SEQ ID NO: 17868 - DNA, 277 bp, Homo sapiens
cagtattcacactggccttgcccaataccatgctgagactggacctcaggactccgaacacacgcccttttcagaaatttgtaatttcatcatttcttgaccaaatgactccaaccacagaaaggcacaaattttccattgggatttattctgccctcccctttggtgggtatactttttctctttcttgcttttgaaaccccactcattatgtgaagtataggtttttcaaactgattttaaagtaaacttgttattaaatataaaaaaaaaaaaa

SEQ ID NO: 17869 - DNA, 262 bp, Homo sapiens
  misc_feature (1)...(262): n = A,T,C or G
aggggcagcccgcctgagtttagggaagggtttagccgagtaccttgnaacttcctgttgncttcctaccanaantagagnactcactttcccgtctctcctggccagtgcatgcccttctcccctcccaccttcaaacanacgacggatcctgaattcttcacacggatagtcagcacttgcattaatataactctgtaattgttcactcttgagccaagtactatatgataaatgcatttcccttttaaaaaaaaaaaaa

SEQ ID NO: 17870 - DNA, 345 bp, Homo sapiens
  misc_feature (1)...(345): n = A,T,C or G
cagcatcacaatgccttgcnagtctgaaaaaaagccagnananagttctccttgagtcctactctgcaaccaagcctttccgagtggctgctctcttgtatactggggaagggaggatgatgttaaccaaaaggacccagcagcagacatgaggagcaacaaggcacaagacaagcacacagagcacaagttgctgaaaagggcacagacgggacaggacattctggccaagctggagagacaaacgtgattagaaagagatggaatggaatacactactgacatgcgtgggtattaggggaccaatctgtaaggggaaaatgctgtggaggaaaaaaaaaaaaa

SEQ ID NO: 17871 - DNA, 329 bp, Homo sapiens
  misc_feature (1)...(329): n = A,T,C or G
gccctttcgtgngnaccagccagnatgttagnagnaagnaaaacccggnagaaaaaacagcaatcaacccttgnatataggcggnaaaatatctactataataattatgtatcacttttcccaaaaaggaacactagattgttaaaaagagtaatccctgaatttgttataagtagtgctttgattttatgaatatatgttcttaaaatattttcctttccttattttctagtgaggaaagatttaaatatcctatcctggatgctggaaactgttgcatcctcttcccgccaaccattaacttttacttccttgcaaaaaaaaaaaaa

SEQ ID NO: 17872 - DNA, 933 bp, Homo sapiens
  misc_feature (1)...(933): n = A,T,C or G
cagggtttctttgcttctggnagaaatccaagaaaaaccacttgttgttgaataaccaagaacatgatcactactgcgaatgaactcacgctggagtagaaaaatagacatgcaagccagcaatttaaattttaatatgctatctaccataatagtgggatttgcaaagtcctgtgagatgaggaaagaataaatacctatctcagtgttctttaggatacttactgcgatacttcattcaagttatcagggatttttactatgtgttgtgaatgatacatagccaccatatataaatgtttgctgaattgaagattactacggtaagaaactggggtgcatgagatggaaacaagacatgcgtatatatttgaggatgtaatatggcagttgcgtgcgcctattgactttggatgatgtaataaaccttggtttttgttgggaaaaaagaatatgactgggctggaggacctgaacggcggaagactcggggacggtttcctttacggagggtggattgctgatcctgggtgactgactcagtaacgtcgggaagaataatgccatgcgcagagagatgctcctagaggtgggacgccgagttgcgcgcgcgggcccgtcgcggcgtcgagcacgtcgtctcacttgcccccatcgcacttaacctgttctgcgcccaccacctctctcccttacgcggcctccaatcccatagatacattggccgaacattccttccactcctcatttccttccccccacgtgctatgtgcatgtcggatcgcgcgacgaacgttcccccccacccttgcgcgttgtccttcttttttatgtcgccaccggcattcttacccgtctcgtttgtctctccgccgcttcactccttcttatccgtcatatctcattttatatatgcttctcgcctctcgtttc

SEQ ID NO: 17873 - DNA, 887 bp, Homo sapiens
  misc_feature (1)...(887): n = A,T,C or G
caatctagggagccccggggggngccgtggctgccctggnactggggtggcagagtctctctcctggttttgctctcacagagcgtgacatctccctggagcaaggtgggaccactgctgagctcacatgagacactgcacttcctaggaagctttctgatacaacgacattggctgtgagttgggattccggcacacaggacaaagaaaagatgacagataatgtgtatggacgctgataagatggctggaggtagagtgatcatttgtaacaacttgttaaagtatgacttgataccttcaacctcgcgatcgccgcatctcccgccacgccccgccctgattccccaccacaacaagtccgccctcgtccgcgtctatctacgcaccccgttccacactccctacccacacattccttctctccggccctcctctcgccgcgcccccccgttaccccgccctccccccctcgcgccttccccgccgacgcgtatcgccttcgcccccgccgcacctccctcctcctcccccgcacccctctccgtcacgctggtcacccccccccccccccaacctcccataccaatagtcaccctcgttcgcacgggttcagccccgcacccaaccgcctagacaatacgaacccccacctttcccgcatctccccccctattccatcaattaccacccccgccggcgtgctctcacactatacacttcccccctccggtattacctcaaacgccctcagcaccatccaccccctgtcccattttgcctttcctattttcccccccccacccataccgtcgcccactcaacccatcccccacgcctctatcaccgccgccctcgcttgggccgcacaagctgccgcaccgttg

SEQ ID NO: 17874 - DNA, 481 bp, Homo sapiens
cgaacccaaccagctccctgtcaccctgtcacttgctgctcctttcactgctccccacacgctctatggcacaccttggtcaaggaccatcactcaacacttccatgaaagtttccatgttttctttttgctaccttcagcactatcaaccgagactttcttacattggtcccattttatgactaaaaatagaaaatgtaatctgtaagcaagtacagattttgtcagcgaagagaaaaattctttgaaattttaatgcgatgttactgctagacattatatgattataataatgggaatggagttgaaggcgtaccggaaacttaccagtttatggaataagagcatgctaataataattgttataagacttcattaacactgatactatcctgggttctatatatagaggaaagaaaaataaatagctcatcataaggaaagcaaataaactaatatttaagaaataaaaaaaaaaaaa

SEQ ID NO: 17875 - DNA, 398 bp, Homo sapiens
ccagttaatgcaaaaaaaacacaatgatttttaaaagaaaacaacagggacaacaataaaaagaaaaacaggaagcccaaacctgcagaaacactcagtaagaaaaaatgactccagtgaacatgtgcataacttcagtaaacatactgtgcatgtggcccctcccgagtgccagcaggccactgtgcatgaagacagccagccccaagggaagaatcaggagagaagaaacagaaaccctggaaccatgccaatgtatataacctcaagtaaagggccaaatgaggcagctggaactgtcaaggtgcctgcttggccctcttccaagtgcactttcttttgttcctgttccaaaaacattttaataaactttcactcctgttcgaaaaaaaaaaaaa

SEQ ID NO: 17876 - DNA, 493 bp, Homo sapiens
  misc_feature (1)...(493): n = A,T,C or G
gggcggggggagttaggggagagagctgattttaggnnnngcatcngtagtnctacacccattttagggaaacnnacagcctgcgggggaangngnggaaatgttctgggagagcagcagctgggcccttgtgacgagccccgtcctgccttcatcgatgaactctacaaggatgtcatccagggcccaggcgtcttctttttggttcacttccaacacctgaaccctggagagcaatggggcatcggttcaacgcagagattccagaaaggatcatctttggctcggattaccatgaaatgggaaacctattaaaagactcccaaacgccctgattttactctatactcggaataaaaaactaaggccctctcaaattcaagtggggggttatttaaagtgtacctaagtataaaaacatgtacttttgaataagaagaaatccttttatcttgcaccctgtttaaattgacacagcggaaaaaaaaaaaaa

SEQ ID NO: 17877 - DNA, 1006 bp, Homo sapiens
  misc_feature (1)...(1006): n = A,T,C or G
ggagggggtggntaagggacggaagggattatgtttctcttgngggaacctccgggggtgccctgcccacgatctctgccccaggctgagacaaatcccaatcctcaagaaaaggcccatgatggtggctccaaaaaataatacctgctgagcctatacttccgccaccccacccaagagccatcagggaaatggatgccccatccaccagccatgggagccgattctgggagaagaagtcacttcagtggagggccatgcatcatagagcagagagaagatggaccttttgtgtgctgcctgaagtgctggccctcagatctcacaggcgcaataaaaagggagtggtaaggtcaacaaacaaaaaaaaatatactcgtttaccacatcgagaggagcgtctgaggcccgctttcctatagagagggataactcaagatcacccctcacgtgactctctgcgtccgggcgtacagctgcggaaagcgacattatccttactcgaccgccgctgattcggttgttcgcggaatgaggggataaggcgagaaatgacatgatgatgataaagtccacagtacaggaaggcaaccaggacatatacacccgtcgtagggtgtgcgttcccacaaggatatcctatcgccatcatcacccccgtatatttgcccgacgtgctttgatgcgtacgatgtccaatacgacagccaatatctgatgaagtgacaccaacacacgtacgtcttccgcggtcactggtgtggtgaggagacgatcataatgtaactaacataagtgtgcagagaacaagaagacagtatgacatctgtaaaagagtgaaggcgaatagtaacgcgtttgttttctcacccgtattctcaatacacgagatgacgacactacgaaacaaatagtaaatcgtcaccattatttaacttgaaacaacaaacgaaacactaatataaactatactgagccttcgatttacataccaccaacagcaccg

SEQ ID NO: 17878 - DNA, 501 bp, Homo sapiens
tcacgcactctacctgagtctcttactccaggcttcctttgggttgacttggctgagtgacatctggcccagaactccggggccatgcaaagaccttggggtgtgctactcccccagcatatgaaatgtaattagctacgactgctctgctgagaaccctccaaagcgcacactcggctccgaaacatcctccacccactggatgccagcggacaacgagaaaagccaccctatcatcacacctccccgccccccccacccccaccccaccccaccccccccccccctctcagcccccccctcccccccaccaaacatcccaacacacacccaaaccctaaccaccccacgacacccacccaacccccccccccaaccccccccaataaccatacaccacccaccaccacacaacaccacctcccacccccctccccccacgcccacacaccatcaccccactaaaacctaacgccacccacatctccccaccccaaacaa

SEQ ID NO: 17879 - DNA, 905 bp, Homo sapiens
  misc_feature (1)...(905): n = A,T,C or G
gggctcggcccaagnctatgacagccncattctaanctacagnatggtnncttacaaatggnaaccccaatgagctcaactaacaacttctactgaggacccctgcaccaacccgctggccctttgactggtataaagagttcccctctggaggacactacaactgcagggctccttcttcaacccatccagcaggaagtagctacagaggtcattgcccaattcccaacagctcttggggtgtcctctttagaggggggattgagaggtgaagccagctagacttcctgggttgagtagggacttggagaacttttctgtctagctggaggattgtaaatgcaccaatcactgccttgtgtctatctgaaggactgtcgacgcaccaattagacctcttgaggaaaccaccaacgatgatctgggtctaactacacatcggtgcgctcctcttaacattctgtatgaccgaccccgtcccactcggcgcccacctcaagcatccccgtgccagtatgcctatggtttcccatgcccgttccgtcttcggtaaaactcctattccctttacacgtcctaatcccttctttagccccaacaccacccgcacactaccccccatcacccctgctgccccttcctcgccccccagcccccctctttcgcactcaccttcccgtctatcaccttacctaaacgaagggtcccgcctcgcctctctactctcttcaccttgccccaccgcccgctttgagccactgctcgcccttccaccccgctagcccgcatctatcgcgttgccacccctacaccgccgtgccgcactctcccgcccccaagccatcgatacaccctctcggtacccacgtaccatttcctccacacccaacctctcacatccccct

SEQ ID NO: 17880 - DNA, 981 bp, Homo sapiens
  misc_feature (1)...(981): n = A,T,C or G
agagtgcctgtagggtttggacgggcttggcggagttagcaaagctccagctccagaatgaaagccttgcccctgaccttgcctggctctcagacatgaaaacccaagtctctgggctctagatccagtgctctttctacgacatcactcctgcctcccttgaacttggttagagcccaatactgatgaggactccccatcacacccacctgcattttaactcttcaatctctgcatggactcaacacctctgactgtggtctctgagcaacccctgaaatattcccatgccttcccatccccaggctccaagagctccccaagggttgcaccaccctggaatctgaactctaaatgcaggatgaactttacatgatagggttagaggctgtgaaacaggaagcgttgttgaaggtgacccattgggttgccgtgccaggaggaagaaatggagctccactgggggccagggacttactgagaggaggggctggtctacaatgaaagggttactgcctgctgcgaacccggaggcgaccctgacctgcctgcgccgatgctggcgttgttgccaggccttctgcaccggctggacttgggacccctagtccctcgaaccaagagacgctccgcgcccctcccctctacgcctcctatacattgttcggtgcccccctctctctgctgtcgtagcncgctgcgttgtgggcgttctatgtcagaccgacaccgcgccgctgacgctcctcccgcataaggcaagcgacgcccgtcgaccgtccggcacgcgcacacccgcggtcactcccacatgcgattcgtgtgctattttccccaccatacccgtgacagtgctagactacgagtcgcgtatcaccatgcccccctccctgtcaccgccctcgacctctcctcctttatccccgcatgtctcacttcgagttacttttgcctcgcgctctcgttccgacccatctcgcc

SEQ ID NO: 17881 - DNA, 897 bp, Homo sapiens
  misc_feature (1)...(897): n = A,T,C or G
caggcttcataggcanaaggncttgccttgtctcacatganctttggacttggacttctgagttaatgctggaatgacttaaacctttgggggactgttgggaaagcataattcgtattgaaatgtgaaaaggacataagatttgggagaggccaggagttgaataatatgtcttggctctgtatccccacccaaatctcatctcaaattgtaacccccctgtgtcaagagagggaactggcgggcacgtgattgcctcatgggggcagtttcacccatgctcttgttgtcataccaacatcacaccatctggctccttccattatggcagactccccccccccgcccctccccgccccccccccgctctctaattatttctcttcctctgctcccctgcccctgtcccctgttcccccctccccccctccctccccgccccccatgccctctcctctctcctctcccctctccccctcccctcccgccctccttccccccctccccgcccgctcctttctccctcatcttccctcctcttcctcccccccccccccaccccctaccctcccgcatcctcccctcgctccctcctctgcgtccccgcgcccccctgcgctttcctcgtttccgcccgcgccgaccccgctccttttcctcccccccccctccctcccctccatttcttctatttgcgtcccctctcctcctgccctgctcttctttccccgcatccccccctccccccccccctcttccctcctctccccccccccctcccgttgtgccccctcgtcttcttcacgcctcctgcgtcaccgcgccccgcctcctcgtccagttcctcaattgtgtcttacgtccacacttacgcgaccctcttctctctctcaccgc

SEQ ID NO: 17882 - DNA, 954 bp, Homo sapiens
  misc_feature (1)...(954): n = A,T,C or G
caggtgttcaactaactgcattggnaataacctcccttcaaacctatggattgcccaagctgatcttgaattttagcctccagtgatcctcccatctcagcctcccaaacactggaattagaggcataagctaacacacctggtctcaacctgtaaatcattaagtctacaggtgtatccagcagctccgaagagacagcgaccagtgagaatgggccataatgacgatgtcagttttgtcaaaaagaaaagggggatatgtagggaaaacaagacagatcaaactgccactgggcccttgtgggaaaaggaaacataacaaactacattttggacctgacctaacaaacttgattcgcccttgccgaggtgcgtcctacaatgattataatcccgtcgctagggtggtcatatgctctggtcactcgtgatcatgttataagggtctttgcgttggccgcgtattaccgtgccaccacacagctcaccccgctcgccacagtccactcgcgcgctcaccgtcccgccctcccctttaaccccagcgcccgcgccctgtccacgccgacgcataaacacggctgacttacactccggaacagtcgtcacccgtctctcccgcttgtcctgcggagcccttccccctatgccgttgtcgtgtttcacacacgtgcccggacatctctctacgacgaaagcagcgacccgggctgcgacgaggttgcggttcgcgcgtcgtgcgccttctcctccccacgctagaatcgtgcacccgcgccgccatcctcttccaccatcacacctcctagctactatcaactcctatacacccgctcactgtacctacctagctgtgcgtcgtcaagggattgtccgtctcctctccacacttgcgcgctggctacgcgcactgtcatgtgtcgcgcctcgcctcaaagtccggcatgcaccccc

SEQ ID NO: 17883 - DNA, 982 bp, Homo sapiens
  misc_feature (1)...(982): n = A,T,C or G
cagtgaatattgcagccttctggnagaanacaagcaggcatggttcagctctctctggccgagtaaataggaagaaacacaagacaccatgcaagtcccagactcatctgagaccttgtgggacacggaagctgacattttgagatggggtttcaccacattacccagggtgagaattgaactctgggactaaagcaacctgaccacgctcagctcccaaagtgctgatattactggacacagggagaagatgggcctgtgtgaaccaggaggggggccctgacgtacgcacaaatctgacagcgctaaggagcacgcctggctccggttttaatccaacttgaagggaaccgtgttgttcttcctggcacctacaaccacatcgtaacatgagacccttcgctcgaggattttctaccacctaatgagcacacagtgcgaaacctcacaacccgtagagccacgtaggatccacctgctctcgtctgccgcctacacttcttcggcacatgacggcacgaaggacacagactagtcgccaacgtcctcgagtattggttacgctgcaccactctcgtaacgaactcatgcatgatgccgtctgcgattcacgatcttaactcagagactgcgcgcgccactcgcccaaacttctcttccgtctataaccccgcaccattactactccatattcccctacgcccacatccctcacaggcgaccagtccctccccctatcgacgcaccccccccctatacccacactctcccccatccgctactacccacccctctcactccttctccgtctgtttcactatccacccacacaaccacctttcattcctattttancaccttctcgcgtcacagtacgcactacggcgntcgctcgcgcagtaaccccgggccgtcgatagcattattattatcctcagtgatatatattcgaatccccactcagttgtcagctcatcccccc

SEQ ID NO: 17884 - DNA, 962 bp, Homo sapiens
  misc_feature (1)...(962): n = A,T,C or G
ggccgagggccgcaggcgagagagatgatcttaggaaaaggccttcgttttnttncaccnaatattggagnaaactncatntntncacctaccatcatttcattacttgatggattcagaagctcaagaagacaccagagaagcctatgatgacaagcaggtggtcacagagatcatggcgagatgttttattccaactctgataacaactacttcctgggaaagttttcattttattggtgatgagattcgaattactgaggccatggattgttatggtgctgttgtttggncctcggtttcttttggtccggggtggggggcgttggggtggttggtgcgggcgcgggggttggttgtcgtggggggttgggggcgggggggggccggccgtgtttgcttcgttgcccgtcgccgtcgctctcgtcgtcccgcttttcgcggcggctgcgtcctgcccctcttgttgccgtggcccttgctccttgtctgtctgcccttctgcccccgcgcgggtctctccctcccctcttccccggggggcgtcggccggcgttgccgctgttctcgcctcccgcctgttgccctgtcttgttgcctcctcctcccgccccctccccgtcgcggcccctcggctccccgcgccccccctccttgtctcccttctttcggcccgtctccccccgtcgccgctttcgtttgctgcggccctcctgccgtctcgncggctgttggcttttccttccgttccttcgttctctttttctcgcgcgtgcggctcggcggccgcctcgtgcttcggcctcctggccccgtcgctgcccctccgcgtcctccccccgctttctccctcctctctccggtcgcgttcccgtcctcttctccctcgtccccttcgttctcttggcccctccgccttcggcggccgcttcctttccctctcgcgccaatcccccacccct

SEQ ID NO: 17885 - DNA, 1015 bp, Homo sapiens
  misc_feature (1)...(1015): n = A,T,C or G
ggcccggagggcccgccaggggcgtgagnagttagagtcttaggaaaagngctcgcggtgatactgcggtattttgnatatgnananacagcaagnaggtatctggtggaagaaatgctaacggcaaacattcaagaggaacanacataaaatttggaaaatttgcaacttgacaatgtcatagaaaaggaaaaaaatattctggagagaaattaaagcctgctgcagaaatttgtgcccagaggtccaggagggagaaattgtttcctgtgccagaccgagggtcttcctgttttgtgcagtctcaggacatgatgccctgcatcccagctgcttcagctccagccctggctaaaaggggccaaggtaccgctcaggccattgcatcagagggtataagccccaagccttggtgggttccacttggtgttgagccagtgggtgcgcacaagtcaagaattgaggtttgggaacctcccactcgatttcagaggatatatggaaatgcctctatgttcacgcaaaagtttgctgcgagggtagagccctcatggagaaaccctgctagggcagtgcacaaaggaaaatctgtgcaaaccccccacacagagttcctacttgggcactgcctcatggagctttgagaagagggccacagtcttccacatcccacaatagtaggatcccccacaactttgtcccatgtgccccaaaaaagccccagacactccataccaccttgtggaaagccccccaggggggggggggctgtacccctgcaaagttccctaaggcagagcttgcccaacgccacggaggccatccccttgcctcagggggacccggttgtgggacctgggatcaaagaaaacacttcggaactccaaacttagggccgccccattggattttggcccagatgatcctcggaaccctctgtttgagcttgagtagccttaagaggggtgggagcccccagccagcccgtttttaggaaaagccacacagcctagat

SEQ ID NO: 17886 - DNA, 1980 bp, Homo sapiens
  misc_feature (1)...(1980): n = A,T,C or G
ggcacgagggggccgccaggcgagaacagcttgagttttggaccgggcctggcggnnaaaacaacatttttagtatgttgccgtgcctgacatttgctggccccgtgacattgtgatnatgaatgcctgcgcagaaatgggaggagaaacctggacgaaggcgaagnctagggaacgaggcacgatganatgtgggcgctggcgaggcactgtgacacctgtggcagggaanaggcgaangaagctgacaggtgtgtgcgcanagagatgatgccacgcacagatgatgtgtgtgacagggtggtgtgaagtggaagatgtgtggtgtgggtgtgatcagtgtganatgagcgatggcgatgcgcgggggtgtgtgatgtggggcgcgtggcgcgagtggcgtgcgcgggtgcgttcggcggtcgcgttgcccagtctcgcttccagacgcacatagccgcgcacgtaggcagcgctgcgcacggcggcccatcccacccgggcccggcgcggcgacttcctgggaaggcagaccgcgtccagacgcctatataaaaagagatgtggcgcgcgaacgcgaaggcgagcgggacgggctgcgagtgtcgcagcctgtcgcggtctgctcctgtggccggcgtgtcgntggtcggtctgtgacgatcagcgcggtgcgcgcgaccgatataccgcggacgtaacagtccactgacaacgtgcgcgcaggcagctagcgccatcgctcgcgntctctcgctacgcctacggctaccaaggggtcgcgcgcgtgcccgcgtcctcatacgatggtacggtcacggacgacgcgacngtgcgcgtcgcgcgcgccggatgcgaccgntcggcgtgtggcactgtaccgangcacagcatgcgcgcncgtcgcgcgacgcagggttgccgcgcggagcgctctctcgtcgccgnactgacacggcgctcctagtgcacctcntctgtcntgcccgcagcgctaccgaatgctatccgcgccgtgcacgccgcttggctatccgtccagtgtattattactcgtatnggtatagatcgctatgtgtgnacagacgtcggtggtagngcagngtgtgagtgctcganccttatagactctgtcgcgantaccacncgcactgactcgtgtcnaaccgcactggacacacgccgcatcgcncncgcagacagcataccgcctcgacgagtatacacgctatcgagcggcgtcggcggganatcgcgtgtgtcagcgacacactcgcgtcgcgcgcggcactgcngtacaatagctgtccgatcgtgcgcatcggagngcgatacacgtagcgcatcagcggcgncgcgtcancgcgtcctcgatgcntacatcgcaggntgacgatctcgtcncgcggcagtgtgcgcgactcacgtcgcgcgctcacagcatatgntgcacgtgtcgtcgacgcgcggtataccatgtcgtcctncnagaccgaagtaaagcatccgatgctcgnactactgacgtcancatacgtntgtacacgacatagctngtcctnagatccaccncagcgcgacgcacngcgctcgcatccgttcnactgtgacacagacctactcgtctatcacgtctgcgagcgctngcgccgacggagtctgcgctgcgcggcgtcncgtgacgacacgccagttgagntctacgtatcgcgacgcagccgacggtatcngacgctgtcctatagcacgtgagatgagtgggtcacacgntcgcgaggtacgcgcgactgcatcngttcatgacgctcgtgctgagactgtcgcgtactgctgtagcgcgccggcagcgagatncagcggtcngcacgtgacgacaccgacgactgacgaccacttntcatctcatacggtanncggcttgcaccccccgtactactatcgctacngcgtcagatccggtagcngtcatccgcctgctct

SEQ ID NO: 17887 - DNA, 477 bp, Homo sapiens
  misc_feature (1)...(477): n = A,T,C or G
gcggctttcctacttatatgaatggagaaaggaaaactaaaatacctacctttcattcagatgaagagaaaggagtggatttctaacacaagcagactttattgatattattggtattgaccaagtaccgtgcataaaaaaaggattggccatgggtctgctattagaatggtcaccttatctggtcaaaggaaagaaanaagttttaaccaacttttcctggcacaacagcggcattaaacaaaaggtgtggcttggttacttcacaatatttctctggactatattaaaaaaaatttgatgccggcactaatcttttttgtacatttagaagttattaatttccccttcctagcccatgaatgggataatattcctaaagctatattcttaccaccaatggtttctagnaatttaatttatgccctttcccttccttcttaaaatggactatataaaagggggcatccttatatt

SEQ ID NO: 17888 - DNA, 1214 bp, Homo sapiens
  misc_feature (1)...(1214): n = A,T,C or G
atttatcgttatagttgttgtcctttatttgcgtcgcatagtgtgagctttcactaccattacatgacgcgattctattccctctatccctatcccacttcccgctccgcctttctatcctcgacattctctcctctttatactgctatacgaacacaatatactctacgtacaacacgtatcaacacctcccccgtacctatcgtcaattagccaatactttcttacggtcctagcacttttatccatgtccgtctttagtaatgctcactgctcgtctgtcacatctatcttaatcgcacctatgcgttactgttcctccatcgacaattcggactctctcgttgtctctcttctccttatttttattttatattatcacatccgcttcttactcatttttatatagcccgtgcgacttctcttcatcttctcttctctctttttcatccccttgttccttctgacctctcgccaccttaatcttgtattgctgaaactatcattgagtctcatgccattagtatatcgtgtgttctttgcggaatgattctctgatcgtgttagagatgtcctctcctcacattttcccgtgatcttatgtctcacacctttactatctagcactcacgatggacgaggcttgcgccgtgttattcctgtccgctgttgtaatgtctggcgagttgacagatgccactcaacaaaactatggtctagcgaaatatatacctcgagaactgtatttgatggaattgtgggatcagtggttcaatttcaggttatcctcccttcctggcggtgtgcggtagtgttgatcgcgcaatattaatcgaatcggacgcgtttggctctcacacttgntatatgctcgtcgacatcgttcgagatattgtggaatttatttgcgcgactatgtgggtgtattcgtggaaggcggatcgggataatatcgagttggtcggatcacggggtgatgtgctgataggtaaatgggggacatgtggattgagacgtgtgataatggacatcgacggctcgaatatctgggattagcgcgcgcgtatatgttgtcacgttcggggggtttttcattcgcttcgcgttcattctcgttattctgcgtattcattataagtatcgtgaataactttgttgccggtcctttatatatgtcgccgatgcgaacgtcgcgttgcaggtcattctggttg

SEQ ID NO: 17889 - DNA, 1842 bp, Homo sapiens
  misc_feature (1)...(1842): n = A,T,C or G
tttagtaagtgatngggcgnggtgaggagggttgntgtgatatagtgagngtggatgntaantagtgatgagagttgtaggatgtgggagtgatagacgtcatgttgatcaggtattggaggatgtggctacgtagagatgatgatgatagtagctgaatatantgaggtggtagatgtatatacggagcgtgtgtattagtgttgtgtagtaggtagagatatgtggtgtattagtgatgntcgtcgtgtgtagcgtgtggagtanagntgtatcngatagagatggttgangtagtagatgatattagtgtgtggctgnnganggtgggaggcagagtaganatgctgatgtagtgtgtatagtggtggcggtaaggtattgangatgtgaaggtatggttgagatgtgtganagggagtacgcgtgtgatgtgtngataagtgtagatgtgtggggcggcgcttgatggtgagtgtgtcgtgtgtgtgtgattaggtggtagtgtagtagacagangatgcacgcgtagagtgtagtgtngtgtncggtgtgaganatntgtgatatatgagtgatagacnangtgacatatgatctttagctntgagagtgagggcggtggcgttttcttatacgattggtggtatagtagtggtgntcngnggagtngagntgtgcgantntntggaggtngatgtgtgatatcacatgtatgagagtggtgngtgatgagtgtatatggtatgagagcagtggtggtgatggtaggtgtgggtgagtggagtagtgtagngtgctgaagagtatatcgaaaatggtggatgatgatggagtcgtggtggtatgtgatgtgatgatatatattgatatatatggatgtggtganagagnanttaggtgtgtgattanggtgagggaagtgngnatagtgggtgtacgtaaaaggagaggacgcgcggttagagagtgtgttgtgtacatgtggtaggagaggatgtagagaagagtttgttnttgtgaatagagagtgttgganagaagacantgtaganaagagagtggagatgttantgtggtgaatatattagtatgatatgagtgatttgtatgaagattatgcagatgtattataacttaaagatgcttgtgttgtgtntgagtagatagagagatnggagagaggagatcgttaagcagaggtcatgaggggaanatcggagcggtngngtggggagagagagtagatgtgttgtttgtgttttgtagtngtgtgaaagagagagtgcntntataatagaaagagatggagggacaagcgcccatcccatatagtgaggnggagtatatgggtgtgtgagggataaagagagtgtatgttttgtgggtatatataagaggggagagtattttagagtcgctgagagaaggagtttatgttgggtgtgtggaggtgaaaggtgaattttatgtggtgtatatgattttatgataggtggggcgtagtttatagagtagtaggtgtagtaagaggttggttagatttttgtgtcaaggttcagaaagagtttcgagggagaggaaggaggtgntnntgtggtgtgttttggtttttggaagaggtctttattatttatcagtcacnagagaaggagagagagagtgtgagaagaattaattgtgcagttatataataaatataatgtgttgagaagatttgggggaggatgcggatttaaatgaaagatacagagagagaggtgtatgggggggtggagaagtttgttgttttttggtggttggtttgttttgtgttttgttgtatattgtgaagtgggtggg

SEQ ID NO: 17890 - DNA, 1725 bp, Homo sapiens
  misc_feature (1)...(1725): n = A,T,C or G
catctttactcctcatcccgtctccgttccgtcactctatattaactaccacaccctcaccattacacctatactattatataatccgtactactcctatcatctgtaattgattatacgcatgcccaacatacacttattttccccccgctattcgttatatatcacgggtcttaggcggtatccaacacaacacaaacccattccacccattgtcccnatgttcccttcataccctcattccacaccaccatcataatttccacatcccgataccccttatacccccacttcgtcctcacttattattaccacattttgtcgtcgatttacctccttcccatttcacgtattattatccactcataccattgcgtgatccgttctatatnattcacaagtacaatcggtacntactatactacgtctcatatataaagacgagatggtagcactcantattacattccaacatagtcgccatcatatatcctactatcgttcatatatctaacgataatctcgaatgtagtcgcacataccgcagttgtgtatcatctctgcgtatcntgacgataactcncggtgcgcgatgtatctatttacatagtacgtgcgctaacantagacantacatgtgcgntgcatcatcagaatatgtattatatagcattatacacntaatgattcacgaatcactcntcgtctcntcgtccncgctgnacatgtggtcagcgtacgtatgtatcaacatactcactacgtatagtgcagctgtactcgcattgacagtntgtcacagactatatatgtanctactatcnacatntcnanaacatctatgctagatgatgcacnactccgatagacncgagctgactctcagctatactgtatattagtcacatcgctgtatatancatcatggtatngaacattcagananatgtcacttagtaccatgattntaacatgctngatanaatgctgtgtgtgtcatcatacaaatcgagtgacntagaatgactgcacattanctcatatgngacagagtattatgataaaacgatctgatgtaaacaagngacgagctanagttatgatgcgcgtatgtgagtagagtatgntcactacaacnagtngagatacgngacactacntacactatattgntacgtgagacttancgtgacncagagagcaaantgcagtgtcacnagacgntcgnctatagtgnagtatgagatctctagtgngatgtgatcttgcngctatattnatnacagctcacnaatgctctactacgtaacatacgtctgtctcgntagatgtgtntatcgcgtcgancgcgagtngggcagatacngaacctcacnctcgtnanatctgccatctctacgatcntcgtagtgcacgcaccgtagtgtaggtagcgactagctcnctatcacaacgaagtacgtacgacgtcgtntgtagtgcgtcggatcgncgcgntcgtanaacagctatttantagtaagcacganagaccgtatatacatagagtatantncacgctcggataactattatacnactatnttntcgtcacaaangcgtgtatatgtccgntcacacgtgacntatgcgtagtgctgttgtctcgatagccgccacactcgacatgatatcntnagtaatatatatactnacgacgatcatgataactcntcatgttgttat

SEQ ID NO: 17891 - DNA, 846 bp, Homo sapiens
  misc_feature (1)...(846): n = A,T,C or G
cggcacggagaaagggggagancttgtctgcagacacactctnaactttccaccgctacaactaacgacagcaacacgttttatgagccgggcaaagaaactgggacagcacagaagaaacaggcacgccagacggagacagctgcgaggtgccacaccgcgcaggggaaggcgacggagcaggaagaagaggggaggaggcggggcgacagacccggaggggacaagaaagattttagggagcacgggagaaaaagggaggggagccgcgcggcggccgaagaggcgcacgcgggcgaccgcccgggcagcgcggcagacgcgacaagccgacgacgaggcgagtgagcgggcccaaagagggcgaggagccccggcagtgggcggtagagcgagagagagggacgagcagagggacagagacgagcgagagcacgtccaacaggtcgcaggggagccgagaggccttgacgacataccccccggcgcggcaagcgaaagtacaggtagaccggacgctcagagagacgccgaacgaggtcaggacgcgcggcggaaggccgtgacgacgaggcccccagcncgatgcgcagcgacagacgacaggccaccagacggagcggcgagacgagggcagagactgtagaagcgagaaggcgaagcgaacacgcgcggaaagagaaaacacgcagacaagaggaggcaccgaagcggccacaggaagcggcgtcccccgcggagacagcnataaagggaaccaagataatcgaggggcacggagcgagaaagggcgcggagtcaagcagcagacagaggaacagacgaggaaagagcacagaganatag

SEQ ID NO: 17892 - DNA, 209 bp, Homo sapiens
  misc_feature (1)...(209): n = A,T,C or G
ttggtgctgaggcggttaccgggtctctatccttctggtacgncggtctgcgcacaaggctgctgatgagtncatggncacgncctagctggctagagctgtactatcaaccacaactgtctggattaccacatcttataaccactccgcgttcatctgcaaacagcctcatgcagactttcggggagggaacattaccatcgcgttag

SEQ ID NO: 17893 - DNA, 1147 bp, Homo sapiens
  misc_feature (1)...(1147): n = A,T,C or G
cacggtaacgcccaccgaagtcggcagagaaatttaaaaaaagacataacacgcgtttcacgatataacagcnttaaccgaaattttgactacgatcgtctatgaagaatcacgactcaacttaccacaaaatcgggcgcgtttccgtttatttcaccggtcaaagacgggtctccacttgcagtacccagttcacccattgtccattctcccatcatcacgacatccaacacaaccatatatcccatcgncttccacagtacgcgccggcgagcagttttttcaacattttccgattcgacgataaactatttcccacccttcgttcgatcttatcggtcgggaacgccgccgccatatggggagggcgatggaaacaaatcagaaagataacaaaataacaatattaaattacaataacaaataattatatataactaattgacaggacccataagaggaaggaagaggaagactcaggcatcggcggggaaggaaaggcataatagaataacaagaaagaatagtaagcaagaaagtatctaatgtaatgtaaagcgacaagagaaaatcaaatgatgaaatagagtagacgcgaataagatagacaaagtggaagatgacgtaggatgagcaggagagtggtgtgaagataaatgatatataacggaagagcaagaccaacatcagagtatggaaggaatagttataaacaatggtgctatgaagagagccagagtaggggaagagaatagataagagataggtagaagagaatataaaagaagaaagatgatgagaaatggaatgaaacagagataacaaataatgaagaggctacaggaggcgaaagataaaaagaagaaggaatatatagagagataacagagaagatagatcagaagagtatcaagagtagagaaagacaagcgccgagtgacgaagagtaggtaatgatgaggaagaagaccgtgtacnagatgagaattatgtaaggtatgatgagagcnacaggatagacgagtacccaaatctacgttgattgatctaaccgatgagagtatatgtacggaatgaggagagatcattatgagtagacgaaaagagagaagngggaagagaagagcggcgaggattatagagttaa

SEQ ID NO: 17894 - DNA, 733 bp, Homo sapiens
  misc_feature (1)...(733): n = A,T,C or G
ccgcctaactactactaaaattgaagagcttaccagttctgccaccatcgttaatgatgataaccgctagacccacccttcccgagtataaatttatatgcggaatggccaagcccagagatggaacgtgataattttatccagcgctgcttnncaaatcgttttaaattagcttcctggtgaatccgaaagtcatggcccatattcaaaaaaatatataccgaatttgacaacgttctttgttgcacagcaatgggagtctagcacccttcaagagagagaatgatataattccaatctaatggaagacacttttttcgacgattctcttaacatagagtcgtgggatatgacaatatggncctataatagagttttcttagcttaatatattatgttgaggagagaaggttagnaatcactcgcccggtatccctgtaaaggaaggggctaaaagatggatacctcgtaacttaatacattgaaactacggacggtcagctttggtggaacgctttagggtgtgcataattaaataaaggaatatcagacaaaaaaccctcgtttcctattggcgagagcaagagcagaaatttaaaatagcccctattttaggattattgataaaggagccccaaacaaagaatgttgagggagtagagccttataggactaagagaaacagaggctctnccccgcaacagatgtaggtagagatgaggcaagccttctc

SEQ ID NO: 17895 - DNA, 137 bp, Homo sapiens
  misc_feature (1)...(137): n = A,T,C or G
ggcgagggaggggcccgcacccgggccnggaaaaagtttnggtattttggnnnggaaatgttggtgtagggtnaccgggcnccccccctcgnggtncgnaggtntncgntnaagnctctcatggccatagnnaggcc

SEQ ID NO: 17896 - DNA, 1329 bp, Homo sapiens
  misc_feature (1)...(1329): n = A,T,C or G
catcagggttcactcatccttagtcgcaaaggcgcctgaaataaaaggccggagcaccatctactgaccgggacaaacatcttatgcattttttagggaaaacgaaccacatagcgtagataacaagcgggatacaaacaacagagacgcgcccttttccgtaattggggggcacgatggcggtacacacacacacatccacatacccccttgtgctcttgtccataatccccgtcatcacaccaagccatgttaaccggatccgcaacagataatgcggcccacaccacgaccgtattatatactcgattttacacgttttcacccaccacacctatttctctccccgctttgccgtatcatcgattatatccgttcatgcagtgtctattcccgccncagggagggggagagcggggattacgcgcccnataatcagcaatatggacgcggtcggaagaggcagaacggagcgagccactaacaatattcagctgtgagggtgggagaacaccatgacctagcctagtcagggagtgggtgagtngggtggagtactcggcccccatagaataagcacaggtagtagtgcaaaaaagagaggaggagggcagaagttatcatggataagggaggatagaagatagagccataagaatagtgggaccaaataagaaatagcaatgaggatagtctactggggaagtaggtgacaacgagccgcactgggaggaggtgggtaggcgatatgagatcgcacatgaggactgcgcacgacggacagggagtagaggaagcaggtgatatagagtatggacgagggtaacgcgagagtatgaagccagctgatttgatggggtgtgtgagtcaggtaggatggattaatgaacgcttcgggagacgcggcgcgcgcacgtgtgtgtagcttaatacgagtaccgaaggagcgcagcattctcgccatgaaacgtgaatatcgtcgctcattggtaacggcagaagcgggtgagacacggagacacacagagtctcacacagatcaggtgactaggggangcaagacagcaagtcgatgagtgagggacggaagtcgccgcgactcagagaagacaagacgcccgtgtgtagacatatcgtccactcgagacgcgtagtcacatcgatgtgtgagcgattgangatatgagcatagaaccacgccgaacttgtagcatatgtccgcagtggctgcatanaattatatgaagacatgagtggaggtaatgagaatgccaccatccctgctcggcacagctaagagacatatcgagcgntagatagacagagaat

SEQ ID NO: 17897 - DNA, 1373 bp, Homo sapiens
  misc_feature (1)...(1373): n = A,T,C or G
agcaggcagagcgcagagagcaggagagaggagacaggagannanagggnttccgttatgtaagaagngaacttgcgagcgcagcacaggaaggcgctttcagngcggaggcatgcggaaaccangagggngaanagagagaaaggaaggnacgcgctcttgagagncagancgcagagaagcgacgacgagcagacacacgnangcagcnagacnngcgaggcgcagcacacacgcngcgnaggagncnagcagcgacncagcagncgaggaccgcactcgagactgcctagccagggcgacatatcnacgaaacgcgacaatnacaggacgnangacacggccgaagccaggatggagagagagnagagagacgcagccgtacacacatgcagcagcacgcngacgtcgancgacatgcngcgncacgagnacagcagcgagtcagcaacaacagtcgaagcacgcgcctgttctgagtctctcacaggcgtagnagcagcagtacgcaacgtcacagccgnacggagagcagcgaccgacgaacncagtcgacaagcngaacagacagcacgatacaggctcgatgacgcgagagacgacacgcganancgtagnacgactcggagagaccagaccaggacgcngcactgcgcatcggatcctgnacaaccacacgtcagncacncagagcactgncagagtagtatctcgagcaagtgacgacgagctcagcacgcagagcgagcgcgcacgcagagacgcggcagcgagagcagcacggcgaacgacacgacacgcgtggaggcagcagacgcgcgagcgccacaggagacgacggagacgcggcgaggagagtatgaagaggaggagaaggncgcacacgaactagaggtgagccaaagagaacggagctacacagcgcgaacaggaggcgtacgcgcgataagangagacgtggtgccgagcgaagaacgcccgccacgacagcgcncgacagcaccgcacgatgacgacgccgacggacgaaccgctgcagacagaagaggcgaagaggngcgaggaggcgtacgacgagcacgcagcgcacgcaacgcacgagacacagcagaacggcgcgggcgacgacggacgcatagggacggcgcgtacggaagacacgccgcgctcggagtatagcgtcnaggtgcagcacgaacgccaacagaacgccgacgatggcagacgacgcacgagcgcgcacgccgcacgacgacggaccacaaagcagcgagcatctcgacggagaagaagatagaagcgngtacaatcaagaagagaggtcgagacgagaagagacgtagacgagagcacgtacgacgctaagactaacg

SEQ ID NO: 17898 - DNA, 112 bp, Homo sapiens
  misc_feature (1)...(112): n = A,T,C or G
ggggggccgcaccggccgaaggttatgttttttgnnngncgtggtgagggtnaccgcncccttcctncgggtncgncggtntncgntnaanctcatnatggccatagnagcc

SEQ ID NO: 17899 - DNA, 318 bp, Homo sapiens
  misc_feature (1)...(318): n = A,T,C or G
tttctcgagtgaggnaaacgtgagcctggtaaaagtgaatgacttgctaagggcagggctgaggtctgaggcctggtctgagtccaaaacccgggcaggctctgagagctccaccctgctgccatcttacgtccaggcagggcctgcaagggacagcaatgatgcaaagacaaacaaaggaagagcaaccccagccctgccacagaaccagctgtgaccacggacaaaaggagttattcgacctctccagcctcagttcttcacttgtatatgaaaccaacaagagtaaatatagaatggagttgaaaaaaaaaaaaa

SEQ ID NO: 17900 - DNA, 309 bp, Homo sapiens
  misc_feature (1)...(309): n = A,T,C or G
tttccggttgnaaacgnagaatattggccctngaaaaacanagattaaatacacttctgagggagccccaggctggacctccagcttgtgngacgcttganaacacaacagcatcctggtgacaccagggaagcattactgcaagagaagtgtctttgctgtcagccacttgtatcaccttgggtaaatggtttcacccctctgggcttcagttttctcacaaggaaataaggaaaaaaagaagagaaccaataagattttagaagaggaatatacaataaacacacttacaatacaaaaaaaaaaaaa

SEQ ID NO: 17901 - DNA, 252 bp, Homo sapiens
  misc_feature (1)...(252): n = A,T,C or G
tttccgancacctgncctccctggntacanctcacaccacccanaccagtaatctgacccagaaacagnaaaacattaagaaaaaccnaatttcaaccccctatgattccatctccaacctgaccagccagcattccccacttcccaagcccctacccaccaaattatcttttaaaactctgatcccaaatgctcagggagactgatttgagtaacaataaaactccggtgtcccacacaaaaaaaaaaaaa

SEQ ID NO: 17902 - DNA, 781 bp, Homo sapiens
  misc_feature (1)...(781): n = A,T,C or G
aatggagcagtataaaacacttcataactcattctggcaccagcattaccctgacaccanatgacagaaaaaggcactacaagnaaaacaaaaccacagaacaataccccttatgaacattgatgcaaaaatcctcaacaagatattagcaaattgaatttggcagcatattaaaaggattatttatcataactatgtgggatttattcctggaatgctaggatggctctacatataaaaatcaatcattgtaatataccatattaacaaaaagaagggggaaaatgtggatattttaattaaaacagaataagcatttgacaagattatacacaattatatgatgaaaacacccacgaaacaaaaaatagaagaaaactacctcaacctaacaaagaccatatatgaaaaccccactgaaaacatcattctcaatggtgaaagagtgaaagctgtttctctaagatcaaagacaagacaaggatgcccactttcaccacttttattcaataattcaatatagtactggaagccacagccaaaacaattaggcaagaaaaaatatcaaaagcatctaaattgggaaggaagaagtaaaattacctctgtttgcaggtgatgtacctgctcccccttcaccttctgccataattggaagcttcctgaggccctcaccagaagcagatgccggcaccatgcttcttgtacagtctgcagaactgtgagcccaataacctctttttaaaataaaaaaaacaaaaaaatggcctcggtgccctca

SEQ ID NO: 17903 - DNA, 747 bp, Homo sapiens
  misc_feature (1)...(747): n = A,T,C or G
cggtagtgaaacctgnagccactgcagtcatcttgctactatgaggcatgagcctacggataaaaagcgcagagttgtcagtgacagcatgaaccatacgaaagagcccacgttctaaccttatcacagagcagctgcacaacaaaacagcaaccacccgtcccctggcctcttgttaggcaagaagaacaaacctttccttgctcaatccactattaaccagatttttctcttattttcagcagagtgtgttcctaaattatataccatatcattataagttttcatatatatcataaaataacataattggaatttatcctaatttacatatctaatttccaattttggataatttagattatgccaatgttttaactaatttaaataatcccatgttggacatctttgtatataaagactttttcatatttataatttcacattttctttagtcaggattaactttctgtagtaatttaaggctttttatacatattgttgaaaagctttacaaaatgtttgcaccagctcttggcattctgtctttttaagcactgtactgtagtgggtagaccccatacctgcttcgtaaatgaaagaagcagacaacctgagcaaatcaaaatgaaactctgccagactaaattttatgcatttcatctaagaaaaaaacagccttgatatgtgtttcaatgagtttggaaaaggataaaagaataaaaccttatattaaaaaaaaaaaaa

SEQ ID NO: 17904 - DNA, 481 bp, Homo sapiens
  misc_feature (1)...(481): n = A,T,C or G
cgtgcaaatacatatagctgtgtcttaggaaacagnatctcatcaaatgtgaaggacattgcccatgtccttcagataagcccaccagtacaagcagaaatgttaagagagtactctgagtgctatggaaccctatcaagaaacaaagtttatttcattattgtgctatgattataagttaactgatttaaggaaaaagtattattgattaagaattaatgtatgccattttccaagtgacaaataatttagttttaacgtttaattttgtatgatggaatttttttatatcctctgaattatggaatggattttcaatgagaaacagattaacatcagtgtattaatatactcttgcaacatgcatgcttctccgtaactaatatagtgtattcataaatggtaagttcttctgtaattttgtttaattggagccatggaaaaataaaattaagtcagtttattgggaaaaaaaaaaaaa

SEQ ID NO: 17905 - DNA, 457 bp, Homo sapiens
  misc_feature (1)...(457): n = A,T,C or G
ttccaaaaatgaaacattnccagaaancatgctgnaacactgtaatctgaaattaaggaagaagctcagtggagcaacngaaagggaaacaggnaaaattaaacttaaaaagaagccgatgaagagccaggcaccaactgactcaaaattgtccatttaacatgttcttaaagagaaactgaaaatgctctttataaacaagatttagtggtatcaaaagagagcagcttttctgtaaaataataccaatgttgccaaggcaatgcatttcttaaccaagcaagttaatattgcttctgcctactgcttggcttcaaaacaagcaaggccagtcttatacagtgatcaaatccagtgcactttaagtgaattgtgtagatgtactctgtagccatccacatatataaggtgactctcatatcaataaattggtaaagtaagattaaaaaaaaaaaaa

SEQ ID NO: 17906 - DNA, 267 bp, Homo sapiens
  misc_feature (1)...(267): n = A,T,C or G
ttccgggnnacttncccaaagtaaagcagaagtgagtcacagagaaccanaggtgagtgagatgaatgtataaaagcatgaacttttgacctaagcattttggtgtttaagctgggctagaactacatcctcagatgatgtattctatgtttttgcaatcttacaatacgagaatttatttatattgagatgatgcagatgatatatgtacaaggcttaaatgagtgctccaaaaatgaaagaaagaagaaaagaaaaaaaaaaaaa

SEQ ID NO: 17907 - DNA, 329 bp, Homo sapiens
  misc_feature (1)...(329): n = A,T,C or G
ttcggccagatctcgccactggncancattttcttcctcacctgcanaatcgctgtgacttatggctcctctgattgcacctgctttcaccagcagccctggaagagagctcttctgtgtggataagagttgagagatcttggtttcattacttgtttaaattggaccctctcaaatgaatgtaagcacataatggggggactacactatgagattaaaaggaatccagctgttaccagaaatgggtgcctgccaggtttatccaccaaattctttccacttcatgtcattaaaataaaatttgagttttaaaatgaaaaaaaaaaaaa

SEQ ID NO: 17908 - DNA, 818 bp, Homo sapiens
  misc_feature (1)...(818): n = A,T,C or G
caggcctcaccttgggcattagaaacagggaggcccagccctgtgcaggacgccatcccatcacaggngcctctcacagccaaccaccctcactcagactgggaccacatagccatgcccatggacctcaagtgcacctggaggaaacccaagtacacatcagtagaacatgcaacctcaacacagacagtggccccagctgggaatcaactttttttctcatcaatgttatgggcaaatgatactaaatgaagcaactattgaagaacatgctatgcataatagattgaatgatcactttcatttttttatcccttcctgtagccatggtttttgctagtcatactacctggtccactgactttgggcttgtccatatgacaggttttggccaacagaatgtatgtagaaggaacaatgcaccagttctgaatctaggccttaagaaacttcacacctgtttatctgtctttctttccttttaaatgctttcaaaatgttattttcttggggaaaaaagaagacagaatctacagttacttaaagagaaaaaacttgaataaatattcatcatgacccaatatactttcagggaggcaaaggcatcattacaatgcgaatttttctttgctttttttcctccctaaagncattatagagatatatttatatgacatacaatcgactaatttaaattgtacaattgaattatttttaatttattcagagttgtgcatttatcactacaactacttttagaaagtattcataatcttanaattaaaaaccttccccgntagcaatcaaaaaaaaaaaac

SEQ ID NO: 17909 - DNA, 1230 bp, Homo sapiens
  misc_feature (1)...(1230): n = A,T,C or G
ggtgagcccccccgggcattgctcgcctccgttctctgcaggcctgtgtcgggacaaaaaactcttttttatcctgtggaaagcacaggattctacacagctccacctttgattacaatacttgcgcacagcatcgtgtatcgtttcgaagatttgcaaattaacaactcacacaccatatatcctcggccatgggcaccaatcggtctgtcgtgcgacaaacatgtgtaatcctcatatctacagtataatagttgtagacacagcacgtggcccacatgcgttatcattttcgccccccgaacaggcacaggatgcacatctcgtcagcctctatacttttcacccggcaccacatntgacactgctggcgtgcacgcccgcccacctccactacgcgtctaatctttttggttattcaagaacaccagtaaacgatatatctcctcccctccactccgttaccccacccgtcgacacagcgcgatatccgcgcgagcctgtgatacatactcgagcgtaccacacccgccccacgctgtattaacacgtctgttcactcccactcacccttaatcttttttctggtttgccccatccacctataaccattccgcgtcccgcctccttctctccgtggacaatggggactgcgcgtttttggtcatacactatccgacgccccgcttcctaccacacgcacctaaattcgacccttacaactataaatcgctctccggaacatacgctcccgtacaccgcccgcctcgtaccccgtttgaatgaaaccctcggcctccatctcccaaatcaccgcggctatattctccccacgtgtctcacattgtcatccccttgctctgtttccgcgcctatgtgacaatgttctcccccgcccgcccgtttctccgcaccccgcttacngataattcgcgtcgctgttcccatcctcgccttgtccccaccccccttttattcccgatcccacacctaccgcgccaacattgctaatatgttacagcgggtggccgccttcctcccccatntgcacgttgtacagttgttttgacaaattgaggtactgacctcgccgccactcccacccggtcctcgaccaactggcggacaaagcgtccatccgtgctgtctccgccatctttacaccaggcggtgacttaactccatcctagttgaccacccgacgnttctctactcctcactgtgtgtatg

SEQ ID NO: 17910 - DNA, 311 bp, Homo sapiens
  misc_feature (1)...(311): n = A,T,C or G
ctctccttgttagtggaaactctttnagggaagcgaatcataatgaggagtattttgttcatgatggctcccatgtagtatatggaatttctttgagcactggctagacattctaaaatcctgatcactggtgttgattttggcaagacattctgtggctataatgaaactccacttgcagctgctactaagctatacctgaaggcaacagtcatctgataccttctgctagacgcagaaataactgcacctctcagcacataccctgtagtaagatagaatgtccaataaacgccactatttccagtgtc

SEQ ID NO: 17911 - DNA, 530 bp, Homo sapiens
  misc_feature (1)...(530): n = A,T,C or G
cgagggctataagcaccccacncttccaccaaatttcaagtcactaggggcattatgctatgtcccaggagtggccaaggcttcaaggaccaatgatagacctgctgctctaacctaggcctgctgaggagtacaattcaacctgtgtttctgtgtggttcagcaatcttgctgagctcctctaagtcagtccatcctgccacagctgggaagaatcaagaaactctccaagaagacgtttattggttgataaaaatctgtttatctgcctgttgccaatgagaagacaggtctgctgaccatggcaggcatggcagcacgtgacaccgtgtttgctgctcactgcatgttccacctgaactttcccgtccggtcaatgagtcttgacagtggggtgaaggggactcactctcaaagaccaaggctgacccgctttgagtacaatgccttgacctagttactgtcactgtggttttgtcttcaggaactaaaaggtacaataaaaacttgttcatttaaaaaaaaaaaaa

SEQ ID NO: 17912 - DNA, 407 bp, Homo sapiens
gctccggagtctccttgctgtttcctaaaacacagtgttctcctgcctatatgtcgacctggaatacttgaacctcaaaacatttcatgccttatttaatctaggaaaggctttggttgtcctagccaagagggatcccgctctgcgtttctacggtccatcactgtctctactcttcattcatttgccacttaaaagctacttcatatttgctatttttaaataactttttacaaagcacaaaaattatttcaaaaagtacaagactgtttagaggaaaaaaagtagtaggcctgcaaattacagttctactgcccagatttaaaccccttgttacttttagtgtgtattcattgacgcttttttctatgaatggaaaaatatataggggcacaaaaaaaaaaaaa

SEQ ID NO: 17913 - DNA, 762 bp, Homo sapiens
  misc_feature (1)...(762): n = A,T,C or G
tttcgggcacccttctagtggcanaggnaagcacataaaggaaacaaaagagttggagggaaagaaatagacgattggagcatctggattcaactatacctcaagttagattaacccctggactttttaactgcatgaatcaacaaatcttcttttagtttaagacattttgagttagtttctgccacttgcaacccagagtcctaactaagatcccaccatcatccccagggtctaactgtggcaactggactaaagcctcacctccttgtactgtccgccttgcctgcttccagttatggtcctatccctaagccagttctagcaggcttgtggtccattcctcatcctttctagcatttccaaacttaatttggagtgactctccaaatctaacttagactggtcccaaaatcttggaagaaacctattctccaacttcaacatagactggccttttttcctttgaggagaaagaaaactgaacagcgtgaatatcctcacataaatacacgcaaatacatcactagaatcagatgtggagctggaggtaccccaccagggcagctcctcctacgtcatatccaatgcagaaatgctgtctcattgtctatgaccatccatcctctggttaaatgcctccagagacagaaagctcactacctcagaagccatcctgttctattgatggacgacttctatatatgagatgcgtcattattataccaaaataaaaattactccctctgaaaaaaaaaaaaa

SEQ ID NO: 17914 - DNA, 315 bp, Homo sapiens
ggccaggacgtttcggtgtgtcaggattcgcactaatatccaaagggttaaaaatactatacattacacacacacacacacacacacacacacacaccaggagttctgttaatttcttactctatctacctaaaatgtgcttatctatattatctatctatctataacaactatattagtgaactgaagtttttatagtcactgatacttttcatagtttttaaattaggtttatttctttggaaattattctgatatttcaattatatacagcgtttaaataaggcttactccacctacttaaaaaaaaaaaaa

SEQ ID NO: 17915 - DNA, 403 bp, Homo sapiens
ctgtactctcaattgggaaaagaaagattttattttcaacacccttacgaactgaaactctactgccatcaaacctagcactggtaattgatattactccaatgcaggcatgggtttgcagggattttcagaacagatcagcatttgaattggcgactgactacagaggattgccttactcaatatgagtggctagagtcaacccattgaggacgtgactacaaccagaaagtggagaaagggaggactccacccctctctggctaactggccttcaccctacaccaccggatttactgggtctccagctttctgatggcagattttgagacttcttggcttgcataatctgaggaggcaacacttactaatagatcagttttatatactaaaaaaaaaaaaa

SEQ ID NO: 17916 - DNA, 502 bp, Homo sapiens
  misc_feature (1)...(502): n = A,T,C or G
ttttggggngnagaatcctncttgngctgaacaagggacagttcagaatgcaagacacctgcttgatgctacctgtaaacttccaggatccaagcacatatgaagaaatgtggactaataccagagtcaagtagagaacatccaacaacatcttagattatgcatgattaatgcttatattctctcagcagtttgacgataaccacagtttcactgttttggttatccagtctttctacaattttaattttcactcctttcacgtggtctctcttttctctagtatttttaaaatttgtttttgtctttggcagtatacagttttagtattgagtttcatgttatttattttgctttggacatagatctatctaaagagatacaaactttatctcttcaaatattatctcacttccattttttctgctctttacacttgagatgctaagtgatatatacatatatattaaatcttcttatttcatcctcaaaaaaaaaaaaa

SEQ ID NO: 17917 - DNA, 1157 bp, Homo sapiens
  misc_feature (1)...(1157): n = A,T,C or G
ggtctcttgaacncgggccccggttttgttttaannnaanngcgntngtggnnggngnnancgcgaaaaaacccagncactggaggggagggcaccgtggtgtaagcaagaacaccgcacgcatcgggagagtgcgcgcgtgtattctngcncactcactctncaccgatgtgctttcagtctccaccccagtgccagggcggtgtctcgcgtgtcgcatgcatagcaagaatncatgtggagcactcgtgtgccaacaatggagggggggaggaactctgggagtgtcactatgccacccctttctttttttttttcttggaacatgncgncacaacgtctgtggagggggggacanatggtaatagtgcactcccagcacggacactctgcacgaatgctaagtgagagcagagcggtagaacatctcactcgctgaactatttcggtcactgcactttttanaagcaagtcacaccgcctcagtatgctgcatccatgtggaaccataatcgcacngaaatcatgatacatggctctctgctgaatgacggggatcttaccactgcttgtatcgcactctaaatcaaacaatatggcgcgccacctaccctagcctgtactgtgattattaatagacgactcatgcgccaaagcagtaaccaacgaataaaagaaagtggggcccaaggggttcgggcatcaggccggcaggcagcttcctgcgcactctgctctccttttgagccgggggcttccctgcatgcatccctctgctcaactgcagtacccgcgcgccctgggccgctccgggtctggtgaccgagttggggtcccattctctcccgcgcgcgagacggcgaacgcccggtcattcccacgagcaccccgggcggggtatactggtagcgcaaggtacccatgctgccagcggcgtcgggccaatcgacccggagcgccagtcccgccgcgttaaatgcgccccccaggttgagtcggcgcttctctgcacgcgggtttgcccgctcgttccgccccccccgtcgcaaaagtacctgaacctttatcccaaccagtaccctgtgcgttcctcccaggcggtcttgacacttcccaagcagtacgtgccaccgtgcaagcccacgcagaacacagat

SEQ ID NO: 17918 - DNA, 262 bp, Homo sapiens
  misc_feature (1)...(262): n = A,T,C or G
gttcnggnnccaagnctctctcatcttcttgttggccactggnagattacttttctgtcctcttggagttacaactggatgcagaacttgatctggacaccaaaatgtcagtagaagtgatatgagatacttctgaccagaagttttgtgaaaaagttcattgttgccaacctcttctccccctgcaaggacccaagtagaggctatcctcaatctgtgtaagtgagaaataaactgttgtttccagtcaaaaaaaaaaaaa

SEQ ID NO: 17919 - DNA, 539 bp, Homo sapiens
ctcccaagtcaggtccttacaaaaaactaatataatcttcagacaaagcatctccgatggaacccatcacccaggggaaacaagctgctgcgtgtatggagttggcaaatagtgaagagaacctctcatatagctaaatgtcacttgaagcccagcgagaacaaagttcattcttcatattaggcttagaaatatattactagtggtctccattaaagtgcaaaagagaaaacagctggtcttctcagtcccaagttcaatatttttatttgttatactctgtggcttatgtcaaaatgtttcaaatactttggatatctctatgaaatctttcaattgggttttcttcttgctttatagagtatatatacatactatagtgtatataggatgattataaatcatatcagcattgttcataacaaatttgttacgtataatatttttatgaacaggacagatgtgatttatagttttacccaatgattgagtattctgaagacaaaataaaaagaaagttacaatcaaaaaaaaaaaaa

SEQ ID NO: 17920 - DNA, 301 bp, Homo sapiens
  misc_feature (1)...(301): n = A,T,C or G
caatagtatggcacacctggngattaagtggagtaaaaatacagaagaatgcctctggcggaagtacgagcttcccataatgatctacaatgagtttggtagaacttcttcccttttgtccaaatgccttggacctgctttaatatgctgctaagtgttcctttatttcattgtgagggtagatgatgtgcctttgcacgtccgtgtgcacactcagcatcctcctaagtgcctggtgcccagtgggtgctcaatacatgcttgttgaataaaagaatatgacaagtcaaaaaaaaaaaaa

SEQ ID NO: 17921 - DNA, 586 bp, Homo sapiens
  misc_feature (1)...(586): n = A,T,C or G
cggtgtggccttgccttgttccaaatgctggnacaccctttctgcagaaagcaagatgccttgctgagaggtcctttgtctccgtgctgacttttcttcgtggcaccgattatctatttctaacagagagtcatgggcatttggacaaagaaataaaaggattgtgcgtttcacatcaaatatagtaagttgtcaatctccttagggcccacaaagccatcttcttttctttcccatcaaaacattcatgacttcactgttctctcctggccacagaaaacagaaattcccagtgccaggagcagtgaagtcagagcaatacaacggcctccaggtgttttgtaagactaattcctggcatgaggctttatatttttctctgcttttatccttatcattaatgaccatgtcattctagaagcactaacagaatatcagaaagagatgagcatttttaatggggtttgaagaagtcaaatggaagaccaaccatgggatatatttcttaatttgaaaatcaagctaaatttaattgatccagattgtttttcaatataaactgtcgctaacttcaaaaaaaaaaaaa

SEQ ID NO: 17922 - DNA, 407 bp, Homo sapiens
  misc_feature (1)...(407): n = A,T,C or G
caggataagggttaacctgattagtaggttacactganagtcaggaagaggacttttcaaactgactccaggaacagaacaagggcaaacttccatctcacttcctactcatggagaaaccagttattaagcataaatttactcccatccccacataactcaccactcttagttgtagtcctacctgtattttcttcacttattcaatactagaggtgcaaatgactgcccccttccctgccacttggctctcccaggctagtttgtctaccttctctctgaatcctttcacctgataccttattcatttatgcttctgacccctttatctttgactctttcctctctactgttgtttcccttacctataagacatattcaaattttgccaatcaaaaaaaaaaaaa

SEQ ID NO: 17923 - DNA, 242 bp, Homo sapiens
  misc_feature (1)...(242): n = A,T,C or G
caagggtcctaaaactagnagaatttntctgacttccctgnaagcagcctaaaaccctcctgtgagagaccaggctgggcgatacagcgagaccctgcctcgaaaacaccatcaccaccaccaccacaaacagcagcaaaaccccacccaggtttaattacttcttcaggtcttcattttttttcatgtataacttacattaaataaattagtatgctttcttcttcttaaaaaaaaaaaaa

SEQ ID NO: 17924 - DNA, 1488 bp, Homo sapiens
  misc_feature (1)...(1488): n = A,T,C or G
caggagccctgcttatggggcatggagggagttatctgtcctatttggccccgcctgggttgtgaggcgatatgaacaccgagtctctggtcttttgnacttgtactctnaggccctgcctaatacacagaaactgccaccaatggaggaaggtnatcaccaatcttggccagtcgtctcctccgaatcttcgcactggccaanatgctggtcatacaggcacaagacgcttctcagcacaatgaaggaggggcgcatcatcgacgtttggcgaacattcttaggtccttgtcttgtcttcggtgactccctctagcaacagtgcacgactctaaggtcttgacgcgtagtgcgcacccacacatacctccgagccaaaccgacttcctcccattggtagcaaaactcagtataaaaacctgtcttgttcggccaatctatgctccttaccaggcggagacgacaacccctttgcgccccctccccccaacggtaccataactaccctatttgcatccttacacgatacatatcacaacagaagncagactcaaaaggtgacccgaaggtggctagaacaaaaacaacttgcgctccagctagtcgctagattaaagccaactccccgctctctcttcgccactaactccaatagccccccatccatcccctccacccctgcaacaaataatcacacactcctcccgcttgcacgttcacctgcgtctttcccgcttcacacctacccacccacccccaacactgataacccgtccgccttcacaacgtccactccctcacacaccaatctcccgcagcagaaccacatctaccgccacaagtgaaaacacctcacatctaagattactcgcgcacaccgcactnataacacatcaataacttcgtcctactccttcccgcacgtactgtactacacgcgagcagntgttacatctccatatcgcgctcctgtcgatatctctgttcgtgttggagttcgtctctctgtgctgcttctgctcatcgtcgccaccatctcacccgccacacctctaccacgnactcataccctcttcacgcgataggagattgcgctcctcatccccgcccgtcancaacttcacactntctcttgcataagcggctctcatgtgaacttctcacgatcgcactatatctcacaatgtatacttctgcttcgtccaagatcacatatcgggatgtaggcgacactcgactttctcgtcatccacgcacagcacgacaacacacagaaantgcgaggcgtgagcgcgccatagctgacccgctgagcagcagtacggccacacccatcgcattatggacgtacgacacaatttaatctatatgactacactactctcttcntccacnagtgttaatcatacattttcatacgttttacttttcacactccatgctacatttgtgtaatacccactctcacagtttgtctgtgtattagtt

SEQ ID NO: 17925 - DNA, 190 bp, Homo sapiens
  misc_feature (1)...(190): n = A,T,C or G
cgggataattttacctgttaacttgnaaacatcgataaatttcttgaatatccatcactcctttaaaggaataaagaaaataaggatcaactggaaagtttgaaaagatacacaagcaaatattatttagtgcattattgtcctcagagccactcaggcaaagaatgcacttttagcaaaaaaaaaaaaa

SEQ ID NO: 17926 - DNA, 454 bp, Homo sapiens
  misc_feature (1)...(454): n = A,T,C or G
gttccgactactcttcngactaactttactggnactatcanaaaaanaaaagagtgaaggaaagacacccagccacacaaaagaacttcatgatgccaacagcgtgattgcttagaagttcctacacaaaaaaaggatcatttgaaagcacctggaatggtttattagcttcacaggattttattcttcttggcttctatttggagggaaaataacataaattcaaaaggattccaatctgaagcccaaatcgtttgcctacataacaaaaatatctcatcttttcctgcacattattattcttttatgggttaaaaagaaaaataccttttagtgttttagaactctctcatggtaaaaagtgcaagaatttaaaatgttgctttcatattcctataattctccaaaagtattaaattcgtatatgtttgagtgattttcaaaaaaaaaaaaa

SEQ ID NO: 17927 - DNA, 786 bp, Homo sapiens
  misc_feature (1)...(786): n = A,T,C or G
tttccaggtcgggccacgttcctccgcagcagctccgtctcgtcttccaccagctgcaggtgctgccgcagctccgacgggattcgctctgctccctcatgagcgggttggccgagccgttgaagtcatcgcccctaaggtcgtccagttccgccttcaggcctctgttctccacctccagttcgacgattttcctgcccaggatgttggcttcttcctccaccagccttagccgtagcttgagctcggcctccctagtgctgggagggcctccggcttctcctttgggcaaaggactgtccagatccccataaaaggatctgtacttctggagctcgtgttcaaatctgtccttttctttatcaatcttggccattttctttctcatcaaagcggcttctttcttaacaaactgcagctggcacttcagatcttcattgtcctcctcatttgggggaaaagagggaaaaggataggagatcatttttatgttaatcaaggaaacaaccacaagaggacacctggataaataatttttcttgcgatccagatttaatgacggagagaaccagagcagatactggggttttttttcagaacacttaaatattctgggcagattaaggattagaacaatgttaccttcctggaagncaaaagggagagagaatatgaaaagagaataactgcggcgtcactatttcagagattattattatgttgtaactgcctacaactggtggggggatcatttcaaacacggtttcttttgtttcattattggac

SEQ ID NO: 17928 - DNA, 936 bp, Homo sapiens
gcgcgccccttgggtacgagccgcaccgtctttggccggccgttctggttgcttccacccatattttagcaatactgcagtacaaatggcaggatgtgcttgctgaatttgattgacgaagaatcccatgaaaacacagtgaaccatttggaaagcaaactgccaaaaataatagttagtcatgctctcaggctggtaattgaaagttttgttcaaatcgtacttaatattcaataattgtttaaccataccactgcttatcttgggaatgctgatactatggagacaataagataaggtggctgctgaaaatcagactcacacactactttgattataatcattttttttgtatatcccatgaaggtattatatgatagaggttgatctaatgcctaatatgtatatagcaacatagagtaaattcaccgcactttatacatgccatattgccgacctccggcaaaagctaacttaccatactgaaatggctcggctgcgtaccccacccaggtttatttttgtacccataatccccaatattatccggttgctgacccctaggagagggcacccgaaatcacaccgggccgcgctcccgcccggtacctctgatctattgaacacggcccctgagaatcagtgggtggtttgaatagcccgaccttatcgcatcatagacgcatatcaactagggtacacgccacgaaaaccacagaagattattagcttattataataaatcgacccacggtggctgtccctcgctaccacatcccctttcaatccttgtccgcaccccctctccctctaagggagctcgcaaactgtatattttccaacacctttattcacaattgatataacccacagactcaccttgtcacacacccgagtcctcccaccgccgacgtaaccacccccgctttgcatcat

SEQ ID NO: 17929 - DNA, 467 bp, Homo sapiens
cagtggacaatagtttggaatacttatattgagtcaaaattgcccgacaatttgcaaaaaaatttcagaagatgaaaactgtgcatttcaagaggatcccaaaatgcaaaaggtggttttttgtacttttattgttgcatctaaaccatggaaatttgaactcaccatgctgaagaaacaatgcaaagatatgtagttatcttctagtgtgttctgccacactcatttccattttaaagaagaagcaaagacacttgcaagaactagaacaacacagttaacccattaacttcatttgtttggcctttttgcatttttgtgtgttcttcatgggctgatgttgaaaatccatgatgtgttttgacagcattgcatagcctattcttgctggatacttcccctactagctgggataatctgctgcaataaatggaagtggtttctacacctcaacaaaaaaaaaaaaa

SEQ ID NO: 17930 - DNA, 468 bp, Homo sapiens
  misc_feature (1)...(468): n = A,T,C or G
tttccggctagcagccacacacagnaaanaaaacatgtaagcagtccatctgcaaaacaaggagagaggcttcaggnaaaaagcaaccctgcgcacactttgatcacagacttgtggcctccagaatgagacaaggcttgccgtgttgcccaggcttgtctcaacctcctgagctcgagcaatccatccaccttggcttcccaaagtgctgggattagaagtgtgaagtcactgcacctagtcttataaagagaccgtgaatcccctgattgctgactccctggtcccagcactgtgctgatgaattcctgatgtccacggagctactacaagatctgagatttatagctctgaaacttcagaagataatcgagatgatacctttggataaagaacctgaatgtatcaactagactgtttgaaaagacacattttaataaataacctgaatatagaaaaaaaaaaaaa

SEQ ID NO: 17931 - DNA, 277 bp, Homo sapiens
  misc_feature (1)...(277): n = A,T,C or G
actcgngggnggnataaccntcctgnaggagcggagnatcggcgnacacaccgacagcactggcagatgctggcaggccatcgactggctngataacacaaatgcccaggggaatttggctggggatggtcggaggagagtctggctgctgagcaccttgacttcnaggggaaaaatcaccttcccactccatcccccttctggctccccatcatctgctgagagctacttccaccactcaataaaacctcgcactcattctccaaaaaaaaaaaaa

SEQ ID NO: 17932 - DNA, 843 bp, Homo sapiens
  misc_feature (1)...(843): n = A,T,C or G
attcggtctgctctcctatgtgtatggtgctgtgataataaaatttggccacacacaaattaatggccttgnaaaaattcaaagttgtttatcttaagggatatatgacgaacactattttggaaaagaaattagtccagttaaatgttgattcatttctcagacagtgaacctgaggctcatggttaaatgagattagtctttttaagtaatcttataaataaatgtggaaaagataataggcaactagtagtcgtttcattcggttctctgttcataaactaaaaatcttattttctgccactgcctttttataaaattacgaaggagattggagaagaaaataaaggatcagcataattactatgaaaacatatgtcccctgtctaaaaccccacatgactagggtagggttttggcttgcaaaaagttgtacaataccacagcttgtgggatgaagaatccagtgatctctaggagcacctatgggcaaatttacatggtgatccaagagccccttgagagaaaaaaggtaacaaggttcccacttttttctttattttcactatgataggtatatttacagcggctgaaaaggaaggtccttattgactgactagtagacaaggaaaccaaattctgcactgagcaagggcgtgggaaacaaatttcggttgaccagggacttaactatgctggcttgagttgggcccgagaaaggggcatccataagaagcctgactgttttggttgaaatccaccaaatattttcctgacaacttatggggtaccccattatttattggacatactttttggtttcctaactcaaatacagattcg

SEQ ID NO: 17933 - DNA, 969 bp, Homo sapiens
  misc_feature (1)...(969): n = A,T,C or G
gggccagcctgggcctagaggcccccagttttttccacccatgttgtggggaaacaaacccattttcttcatgnatcttcatggcaaaacactttgtgtgactgcagcacggctccctctctgacaacattctagtactcttctttgtcagtatatcaacctacagctcctggatgcaaagccacaagatgtttaatggggacagtgggcactctcctgcttgaaaacccacttgggcagaatggactcacccacccaggtcttctgtatgaaacagccaaggcgtttggcctctcgcagcacgaagctcaacctgctactgacagagacccaaccgcacgaacaaacaaagacaatccccgcgaagctttgacaattgaaactgttgaagcgtccgcgtaccccacaaccagaagacttccagcctgcaccccacccttgacgccgcgggcaagccttcgcctaacccccgcccatcccggcgacccgacaagcgtcctcgccccgcccatgaatcccccgggcggagatgccgttcgaggcgctacaccgcacaatcagccccgcggtagcacacaaaacacgccggggagggcacaccgcggcccgccacccccgcatggaaccatgggaggcgggccccccacgccccccgcacgcccagtcgggggaacgccgcttcgcccgcggcatttcaagacccaacagaaaccccgagcccggaatgcctgaaccgccgtaaagagtcttccgggcacgaactccgcccccaccgtaacataccggcgacgaccccccgcgccccgcgccggcgatgcccgcgcgccacaccgccacnggggtagccgcgggccgggcaccgaccgacatctgtgtggtcacccttggtaagcagagcctgcggggacggagagtcacacaactattgccagaccacagttctggtccacacgcacaggtcgtagttat

SEQ ID NO: 17934 - DNA, 463 bp, Homo sapiens
  misc_feature (1)...(463): n = A,T,C or G
gttcggggtngcaacccacttttaggaaaactgtaacagtccatctgcaagacagggagagaggcttcaggnaaaaagcaaccctgcgcacactttgatcacagacttgtggcctccagaatgagacaaggcttgccgtgttgcccaggcttgtctcaacctcctgagctcgagcaatccatccaccttggcttcccaaagtgctgggattagaagtgtgaagtcactgcacctagtcttataaagagaccgtgaatcccctgattgctgactccctggtcccagcactgtgctgatgaattcctgatgtccacggagctactacaagatctgagatttatagctctgaaacttcagaagataatcgagatgatacctttggataaagaacctgaatgtatcaactagactgtttgaaaagacacattttaataaataacctgaatatagaaaaaaaaaaaaa

SEQ ID NO: 17935 - DNA, 841 bp, Homo sapiens
  misc_feature (1)...(841): n = A,T,C or G
ccgaagtcacatggttttacagnanaaaanaanaattgtgttagtccattttcacactgctataaaagactactacctgagactgggtaatttataaagaaaagaagtttaattgactcagttccacaggcttaatgagaagcatgactgagaggcctcaggaaacttatagtcatggtggaaggtggagaggaagcagggagcttcttcacgtggtggcagcagagaatgagagagtgtgaagggggaagtgccacacaccattcaaacaagcagatctcatgagaactcactgtcatgaaaaccgcaagggggaagtccacttccatgaatcggtcaccttcccccagccccctacgccgacacatggggattacaatttgagatgagatgtgggttgggacacagagccaaatcatatcagagatgatctctgtcttcttaatttgttaagagtgtttcctgacctaacatatgatctatatgggaggacattacatgtgaagttgagaagaatgtgtattctgtagcttgtggaatggaatgttctgtaaatgtctattaaggtccttttgatctatggggcaagggtaacgcccagtctttcttttgtgattttctgtctggatgacctgtccatttttcaaatggactggcatatgctttcagctagggacacaaacagttttgagggccctaagctgaacttaaataccttccatttgcaggactaaaaaaatttcgtcttacatatttgcatgccccacaggtcggtggcatatatatttgcgttcggtatcatccccttattaaaaaaatccttatattatctataaaagac

SEQ ID NO: 17936 - DNA, 309 bp, Homo sapiens
  misc_feature (1)...(309): n = A,T,C or G
cggggcatctgcacttcgtcgnaaaacaagacttagaaccaacagnacccattgctttttaaatatagacagcggaaagaaaagactttggctacctgcatttcaaatcgtacgtgcggtctgagggagcacctggcacttgcaagaaaacagcatgcaaaaatattttgttctattttcccattgtaatctctcttccagattttttttgtccctccctttgttttcttgtcaagattgacaagcatccatgtgttaccaagtgacataaagttcttgcttgaataatcatgactaaaaaaaaaaaaa

SEQ ID NO: 17937 - DNA, 348 bp, Homo sapiens
  misc_feature (1)...(348): n = A,T,C or G
ggcggcgcgccgccctgggcctgtcccgttacgtcttttaaaggggtgttcgggngancaacacaggttacggcctgtgaagtgtactgttctctggacgcagggagtacaatgtccctatggtatgggaaagaaacaaagtgaggggaaccagtccctggtttccatgtggcaacagtacccatgagtgcactatggactgcacagagaagactgacttccttaggcattgatttgtcatgagtatctttgttatagccacttaacgttaccttaatacacccacttcctggataagtaaaactgaggcttggataaaaccacaccgacacagcaaaaaaaaaaaaa

SEQ ID NO: 17938 - DNA, 741 bp, Homo sapiens
  misc_feature (1)...(741): n = A,T,C or G
ccagttcttttnccacaanaaaaacaacatagtncaaagcagatcaaataactaaggggngaaatgcaagatggctgtcacttaacacagaacacctaacaaaaatcagcggtgatgttggaaattcccaaatagaagatatcaaccttgttctcagctagatgcacttttttgcaaagtgaatgaagaggaagttaatatgctaaaaggtcctaattaattgccaagaacttcaactttaatatgtaacttaatggaccttagattcaccaaccacataaaataacaggacaaaagagctctaactgcccacaagttactgtcctcaaatcaagatcacccagaaaatggtaaaatgaggggaccaagagagacgaatcaaggaaaccaatacatagttcagtctggctacatgaagatttattaagtcataaaagagatacaatttaaagcaaaaagcaccatgaagaagaatggaaagaagaacaaagaacaagatatggagcaaagaaaaagaatactaaaaaataataaatacagtatttaccttaagaaaaaaatcaaaaggtatgcttaaaatctataacatatgaataaaatctgcaccatattcagtgacagactgtttctaatatttttcaggacaagtgatatataatcctatttgagactgaatgatcaagagaatcgaagaaattaagtctcaggatcctggtgaaatttgctagaaaaaaaaaaaaa

SEQ ID NO: 17939 - DNA, 557 bp, Homo sapiens
  misc_feature (1)...(557): n = A,T,C or G
tttccgaggccaccaccccctncactnctnaaactggctggcccagccttcagtcccgcagctccattccatctgtaaaggcatcggattcctctgctcagactccttcaaggcacccccatccactaccaactgcagccaaactcctcagcttcacgatctggcccctgtgctcttgccaatttgaaactggaaagtggcctggctgtttcacttgcatgtccttgattgtgatggctggacagtttttcacacatacactggccatttctatctctttggtaacttgcctgtgcactactttgctcattttcatactgaacattcatattttcttatcgatttacaaaagcttttaatattattgatcctgtgtcatttatatacctcaaatatttttctcaagtgtgttgattggcttttacttttgtttatggtctttattgatatactagagttttaaattatgccgccgtaaaatcggattttgttattatgcttaggaaatctctccctacccagagattataaacagttacatatgttttcttttaaag

SEQ ID NO: 17940 - DNA, 384 bp, Homo sapiens
  misc_feature (1)...(384): n = A,T,C or G
cgctattcagaagtttatagtaatctggnaaaaagcacnttgcctttttctggnaaataggganaaacaaagaatgagaatgtcaagtgatttgcttggaaacagaaaaactacagtgggactgaagatgaaacacagattaacttacttccacaattgatcacaaccaattttttttctccagatagctctttaaaaatacagctttttattttgaaataattgtagattcacaggaagtttccaaaaatttaaagagagatttcatttgtccttcatccattttccccaataataacatcttgtataactataagtgcagtattacagtcaggaaactgacattaataaaatctgcataactttttcagaaaaaaaaaaaaa

SEQ ID NO: 17941 - DNA, 830 bp, Homo sapiens
  misc_feature (1)...(830): n = A,T,C or G
tttcaggaatcaggcccccaaaggaggaccggctgaaccatggcagaagacatggattgtgaagatttcatacaccttgattagttccccaaattaatacttttataatttcttacgcctgtctttactgcaatctctaaacataaattgtgaggacttcatggacacttgtcacttccccagtcaatacccttgtgatttcctatgcccgtctttactttagtctcttaatcccatcattttcgtaaactgaggaggatgtatgtcgcctcaggaccctgtgttgattgcgttaactgcacaaattgtacagcatgtgtgtttgaacaatatgaaatctgggcaccttgaaaaaagaacaggataacagcaatgttcggggaacaagagagataacctcaaactctgaccactggtgagccaggcagaacagagccatatttctcttctttcaaaagcaaatgggagaaatattgctgaattctttttctcagcgaggaacatccctgagaaagagaatgtgcccctgagggtaggcctctaaaatggcccccttggatgtggccatcttctgtggtcgagctgtagggatgaaataagccccagtctcccatagagctcccacacttattaggacgaggaaattcccgccctaataaatttttggtcagaccagntgtcttctctcaaaccctgtctcctgaaaagaagttattgatgacaatgtgtgcctgaaacttcattaccaattttatttcaccccatcccttgggtcctgtgatctaacccttgcctccattgcctgggggattttattacctgcgaaggca

SEQ ID NO: 17942 - DNA, 838 bp, Homo sapiens
tttctgagccagagaccaatctccctgggacacccctaccggcagcagggctggaaccggcagcctggtggacatccgccctgcaggctctccctcgcagagactgcagaagagggtgtgcagtgctcagcgcggaaggatgttctccctgcttttaaggagccgtgactattttgctcagcgtccctggcgtgcctttctctgtacaaaaaggagacttagaggcttccccatcccattaccacagctgggcggcttcttgcatgagggcaccttgctgaactaagtcaccccaagctaccctaggctccctgtgcactgagatgctgagtcctgaggtgccttccagcaccagtgaatgggactaaagtcttctgcagtgtcgcgaccgttctgaagtgagtattctgtggtcatttgctaccctctgtgaagcccaggaagcagggattcagggctgaccagggaccactttgttctctgcccatgcatggaaggtctgcacttgggccccaaagcctgagtaaagtttcaccgtgaacttcttgcagcaggataaacagtagggttcagtactgagggtctccagtttaaaccctgactccactacaaaataaatgctagactgggccacatattttaagctgtgttttccttatgcttaaaatgggcagtagaactcctttcagaggccatgcacgcgagataatgcccacagcaacgctcacagtgcggccttggcaagacacagggctagacaggggctggtcatttactgctgggatcttttattgtcggggaacgttatctattttcctacgatttcgcaacttcccta

SEQ ID NO: 17943 - DNA, 661 bp, Homo sapiens
ttccggtttttcacgtgataccaaaagctttgtgcgaactgctctttggtgacatcgtgcttaaacacgtcatccccagtgcaacccaagatgatggccatttgcacttcctttttaggcatctgacatcagcttcaagaagtctctccccatatgcattaagaatgcacagtaaacaagctaaagtgcagacgctttcacaggtttctgttggacaataacaaccaccggtaacgaagaggacaagaatctggttacaaatgtgtatttcatcaggcaacacctgctctaaaatggccagagcctgccatttccacaaatgtggactaaaatgaacatacctgaaaaaaagatttttcaccttctaatataaaatattctgtcttcatttcagaggcgtaatgtatagtatacaataaggtggtaataatcttatagtgaccgatggttagagaaactgggtaacggacttctattggatttataaaaggaaagagtttgcctctctctgatgcttagttgtggttccactgcaaatggagatgaatagaagtgaatgaatttccccttagcactatgattttataatgtacacctttttgtttagaaatgttaaatttaacattaaatatgaacctgctcctggtcaaaaaaaaaaaaa

SEQ ID NO: 17944 - DNA, 873 bp, Homo sapiens
  misc_feature (1)...(873): n = A,T,C or G
ttccgagtagttacaagccttgatncaagatatctacaatgncaatcttaccatgatcaacaggcaacaagaagaaaatcacatgatcatatcaattgattcagtaaaaattactataattctacacctcttcttgatcaaactctcagcatattagggaatacagagggatttcttcaacttgataatgaacatttacaaaacaaaaaacaacaacaaaaagtttacagataacattatactaatgatgaaaggctgaatgtttccccctagaactgggtacaaagcaagaatgtcttctcatgactcttacctgacacagtaatggggatgtatggcactgaaacaagtaaataataaaataagacataagaaaaaaaacaaattgaaaaggaagatatcaaacacttccaattttcagatgctatgatttctatatggaaaatcccaaggtatctaccaaaagaaaaatcctagactaattgagtttggtaaagtttcaagatacaaggtcaacacaagtaaatcatcaacatttctttatattagtagtaaacatgagaatataacaattaaaaacagagtatcatttacaatcactccaaaggaaataaaatacttaacaaaacatatactgactctacagactgaacattaccaaaagctgatgaaagaaataaaaggagacataaatgaatggaagaaatatcatgttcatgggcttcaaaagtcaacagtaaagatgccatttttgcctaaattgatctacaggttcagtgcaattccttccgaatctcaccagggattttggtagacataaacaagtttattctacaatttgtatggnaaagccacaggatactgcgactaact

SEQ ID NO: 17945 - DNA, 676 bp, Homo sapiens
  misc_feature (1)...(676): n = A,T,C or G
ttccgagtttttnagtgtggaaacaanaagactattgatgcgaactgctctttggtgacatcgtgcttcaacacgtcatccccagtgcaacccaggatgatggccatttgcacttcctttttaggcatctgacatcagcttcaagaagtctctccccatatgcattaagaatgcacagtaaacaagctaaagtgcagacgctttcacaggtttctgttggacaataacaaccaccggtaacgaagaggacaagaatctgtttacaaatgtgtatttcatcaggcaacacctgctctaaaatggccagagcctgccatttccacaaatgtggactaaaatgaacatacctgaaaaaaagatttttcaccttctaatataaaatattctgtcttcatttcaaaggtgtaatgtatagtatacaataaggtggtaataatcttaaagtgaccgatggttagagaaattggttaacggacttctattggatttataaaagggaaagagttttgcctctctctgatgcttagttggtgtttccacttgaaatttgagatgaattagagttgaatgaatttcccttcagcactatgattttattattgtacacatttctgttttagatatgtttaaatataaacattaaatataaacatagttctgttcaaaaaaaaaaaaa

SEQ ID NO: 17946 - DNA, 905 bp, Homo sapiens
  misc_feature (1)...(905): n = A,T,C or G
gcgggtggccgcgcctctgggctgaagaatatgtttttttnngnncctccgtctataacccactgnttgactcctcatgccctacctgtctgcccactgccatgccattaagtcctgctggctaaactcgatctacaggtcttttgtctctaggacataactagaaatgccctcacacagcacatcagtctcttcagggtctgtttcctgcgggcctgcctcactctgaccttcgactaccccctcctcagcatactcttttctgaccttacagcatcaggcccctcctatttctgtgtctttgtacacactattcctttatacacactattcctttattcttccttcaaggtgattcctaaactggcagttgtcactcggggaccatccctagttttctctgtattgatgcattcacatttgcacataaaagcagaaatgtcagttttaaaacatgggatatttatatttaaaacttctctattccatgagaacattttacacacacaaaaagtgttaatggtgtcttgggaagtataggaatttgtgtacccatcattagcaccaactctcactctgaaattattttcatattccttatatgtaaaattttatatattttcttctgcctaacgtaagtgctaatgcaaaatctaaacctgacggtgatgggaaaaaatttaatgaattttcatatgagagctaaaattaatcttattaatcaatgtcattcctagaagcttgaaaggaagaatgcttagctttatttattctatttctgagacagagacttgctctgtaacccaggctggagtgtaacggcgtgatcttggctcattgcaacctctgacttctgggttaaagagattctaaggacttaccctgataactggaattgcagaatg

SEQ ID NO: 17947 - DNA, 835 bp, Homo sapiens
  misc_feature (1)...(835): n = A,T,C or G
tccgagctatggcatttncccncggacaatgatcaggctganaagtgatttcatttacattgcaaaggagacagaaaaacaaacagaaaacccagaggccacgacttcccgggagtgctccagagtgtgtgtattgctagtagaagctatgtgcacctccacaccccggaactatttttgaagctttgatgtagaaacgcacaatacctacagcgaccttaaatttctgtaaaacaaatatagcatgcattgatgcaattgccatatatttatagaattcaacaattgccttccaccaactttatcaaatatctgctgcatgggggcggtgctaggacagaaacataaacagctctgattggtccattatgcagacgaagcacatgcttcaaggaccaaaaaagcagagagaacaccgtgctcctgccttactggccaaatgatgcaacaagaaaattcagggaaagttaatttaagnttcaacatacagaatttttttgtccttggaagacacagctttaagttttagttgagttttgttttcatttttatttgggtacaggcctttgggatagtttcggatttgtgttccagaaaatttttacttcccccacactatggaaggaataccctttcctgacttagggaatgttgacttggccactgtgactatggcccgctagaaggtagccaggcatgatgccataaaggccacttgtggatttgcacaggtggccttggctttcctgcacttgccaccattgccttgagatagcatacccttgccctgcgtccaaggcagacacgaagaaacgctgagccaaatttgacctcc

SEQ ID NO: 17948 - DNA, 860 bp, Homo sapiens
  misc_feature (1)...(860): n = A,T,C or G
ccaacatcttttctttggnactatcctatataaaacaaaacatactgataccgacggagacaggaaacactgtgtagaagagggcagttccctggcaaaggcctcaccctcaagtccggatacctgcggtcctaaatgagaacaggcattcctgttttcacacccaaatgctgtcttttggcctgccacaccccctatcttgcacccatataaactctgaatcccaagcttcagaaacagaccagcaagccagcagaacagcagaaaacacagaacaacacagcagagaaagggagatgaggaagaacatctgaatgcagagaagagttcagctaggggcagctggagaggagtctggccgctgggcagcccgactctgagggaggatcgccttcccactccattccccctttgcagctcctcatccatccctctgaaagccacctccaccactcaataaaacctcgcattcatccttcgagtccatgtgtgccccaatttttccaggatgctggacaagagcttgggatacagaaagctgtcacactggccttctgccctttggaaaaggcagagggtccattgagctggttaacactcaagccatctgcaggcagcaaagctgaaagagttttgtaacacttggggttgaaggcaaccacacctagacactaccaaagggccagagcccaaagaactcatcccaccctctgtacccatctgtctgcatgctccccgtcccgcanaaggtttgagcagcagggcgaccaaactggcaaactacacccctgttacatgtnctgcgaggngaatatcaaggaactccccatttcatatgacatttatatatgctaaacatt

SEQ ID NO: 17949 - DNA, 1001 bp, Homo sapiens
  misc_feature (1)...(1001): n = A,T,C or G
gggggagttagggactgccggccgcgtcttttcnaaggngttacgggntttaacgcgcgtttacaacacacttatgtgccgaactgctctttggtgactcgtgcttcaaacgtcatgccccagtgcaacccaagagatggccatttgcacttgctttttaggcatctgacatcagcttcaagaaggctctccccatatgcattaagaatgcacagataacaagctaaagcgcacgaccctttcacaggtttctgttgggcaatggcgaccgccgggggacggacaggacaagaatctgtgtacaaatgtgtgtttcatcaggcaacacctggtgtaaaatgggcagagcctggcatttccacaagaggggactggaaggagcatgcctgcggagagggattctggcaccttggtaaggaggaacgtgggtgcggttgagttggaggtgggtaggtgtagtaaggccacaggagagcgggcgggcgtggcacggtggccgaaggctcgggggcgacgggagtgggcgaggggggcgcggcgtcttgtcagccggtcctcgcggaactccgcgcgcggcgctcggggagtacgggcgcagcgacggcggagagcggagaccttcctgagtgcgccgggagtgcgaacgacccncgagcgggcgacctgcggctgcgaccgccaccgttattgttcacaacgcccctcgtggcggcgcgcgcccccctcacctcctaccctgtttctcgctaccgccccacacccccgctcgccgcccccacccctccccaccacccctcgcccccctcaccaccctgcccccacgaatgggccccgacctctttttctcgcagctcccggttgtgccaccgcgacctcggcccctccaacacgccactaaccccacaaacgtttataccaaccccccaacccaccggcaattactcgcgcgctgtcgttcaaccccgcgtacccatgcgcgcccatatgacccccccccccgc

SEQ ID NO: 17950 - DNA, 209 bp, Homo sapiens
ggtgagccggcagacacctgttttaaaggttcggtgtgcactattagaatggtcccactcgattgtggcaccttgattggtcattccacctcaaactgggaaatatattattgttaccacccatcctggtattctgttatagaagagcaaactaaaacaccatgcaaagaaatgggaaaataggtcccatacacacaaaaaaaaaaaaa

SEQ ID NO: 17951 - DNA, 869 bp, Homo sapiens
tttcgatagtgcctttcacttagccctgcatgttgacacctccccacaacgtggaaactcttcacaaaaataccctgcacacctgctttcctgcctcttccaaaccaacagcctgcatcaactggaccttctttgaacgacatctttctatgtctgctcatgtaccctgataaactccttaatggacactgaattaaactctgaaaatggacactcacctagctatatgggtgcaagcagcatgcctttattctaaaggaagtgaaaagttaaaaaatacattgaggccaagtatggcagatcacatctgtaatcccagcactttgggaggcagacaggtgatttgtttgagctcaagagtttgagaccagctgggccacatggtgaaaccatgcctctaaaaacatgcacaaattagctgagcatgggagtgcatgcctgtagtcccatctacttgggaggcacagatgggaggatcagtctagccctggaggcacagattgtagtgagccaaggtagcaccactgtactccagcctggccatcagagtgagaccctgcctcaaagaacaaacgcaaggaatgccaacagctatggaaaaagaatcttacccccagctaagcacactaattagaactcccctaatccttttaataatttagggcacgacctgtccgaaggagattttttttcataaatggcggatgcctctatttctgtacccgcccaatggtaaatccccctaacccccatcttggtctattgagccaactcgaaacgttagcctcctgctggctgaggaacctgcaattttcaaccttaacttaacctcttctttcacattccctgcaaatttccaatacccaccc

SEQ ID NO: 17952 - DNA, 659 bp, Homo sapiens
tagctgggactacaggcacctgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctacaaacattttttgttagctttataatattttaaaatctcagaagttttcccatatctattcaataagcattttttagcagttttcttttattctttccaaagcattcagttttgtttaataaataaattagttattaaacaaaaattgttttatttttccatttatatttctccagtgtttgtgctgtcaatactgtaattgtttagtaaacttgggcacacacacatttaggaactagcgtgagacttttgagagatggcaaccccacaggtggggggtcatagctgccactgaggctgctggccctggcattctgtttgcctcagaccaaggtcctatgaattgggctttaaaagcttctattgtaaggaaatgtatcataatggtgcttctagtgggggcagaaatgaggagatggacttagcaaagtggacgtccctggccaagtccagtctgagtcaatagccagtgtgcgctgtgttccc

SEQ ID NO: 17953 - DNA, 193 bp, Homo sapiens
  misc_feature (1)...(193): n = A,T,C or G
ttccggttgtgaagctgtaattaacctgnaaacatggnagggagagcaggaagcctggggttcctcagctttaaactccatttggcagacaacatgaaatcatgcctgatttacaagatgcctataattccaacagaacaataaataaaatatatgacatgggaaggtgaagtaaataagaaaaaaaaaaaaa

SEQ ID NO: 17954 - DNA, 251 bp, Homo sapiens
ccatgccaggaacttccggtagcttctgagacagtctaagaaaagctggatcttagaaacatacagacttggattcaaattctaaccctggcacttcaccagctatgtgaccttgacagcctccattttctcacctgaaaaatggagataatctttaatagtgttattttatgtgtgtgcggatgatctgtttacctatttccagataaccagcacaaataatatcaactcaataggcaaaaaaaaaaaaa

SEQ ID NO: 17955 - DNA, 851 bp, Homo sapiens
  misc_feature (1)...(851): n = A,T,C or G
ccgtcgggtattcttaccgaacttcttcttggtggnacagcagataatttgttatgccgttgcatagttctaccaaacacagcacattggaataacaagatacagattcttagatacagactgtgaactcctcaaaacattagtgaccattctaaccaataatcttcaaattcagcagattctctgacatacatcagacactcaaggaataagaaataatgattaaaatagtaccagtaatgatatgtttaatggtcatcaaaatcccagaatggtaactcaagcttacctcctatatctggacgaagtttattgtcatagccttgaagcaatgaattcagaatttgtgtgatatctccttcatgaatttttggggccaagacccaggttttgttcaccgttaaatcctcatcatcttcatcatctgccttatcaacactaaataattcaaagaaaaaaatggatggtagaaggttcaatcaaatcatgtataaaagtatagtttaagtatgttacaattgagtaagaaagtaataatggcagacaaaaaggtattacactaacattacatttagtaagaccaatacatttgtcatacaaagtgccctgatataatactcaaaaaatgagaattctgtgcaagaaatacacaatattaaaataataaagtaaattttgaccactcccacaactgtcattaacattcataaaaattattccaccaaaatatgactggtgtccnctaaatttgtataacataaaatctgtgcacccatatgtggtgaccttaaaccatcacaaccaaaataaaaataaaagggtaagaattacaggaaaagatgtataattag

SEQ ID NO: 17956 - DNA, 426 bp, Homo sapiens
atatacagtacagtaattatttattcaccatactgtatataagagatgattacatgtgctataaagtacagtatcatttactgtactatatataatagatgattataatatacaattatgttactggtttacatactacactatatttgttattgttattttagcatgtactcctacttatctgatttgaagaaaggctaacagtaaaacagcctcaggcaagtccttcaggaagtattacaggaaaaggcactggtatcataggagatgacatgtccatgtgtgttattgcccctgaagaccttccagtcatatatgttgaggtggaggacagtgatattgatgatcttaacactgtgctggcctcagctaatgtgtgtgttttggtttttaacaaaagaggtttaaaaaggaaaaaaaaaaaaa

SEQ ID NO: 17957 - DNA, 864 bp, Homo sapiens
  misc_feature (1)...(864): n = A,T,C or G
tttccggganatacactccagtatatgacaagttttcagcttgacaaggcttgcattctgtgaggagaaatgaacaaacagcattaatgttgatgatgcaacatggaacaagtgctatgacagagattaaaaaacaagtgcttgttcatttactggaaagacagaagaccgattcagcctggaaagaaaaatccctgagaagatggtatggactaaacaaataaatgggattttaacaaataaagaataaaaattattttattttataaagggaggcacaataatctaatctgaatatgatttggatgtgagtaagggttgcaggaggtgagtaagggttgcaggagatgagggagggagtatgtagatatctggggtaaaagcatttctggctgagaagacagcaagtgcaaatgccctgagacaggatcagggcttttgaggaatcacaaaaaaacccaatgatcttggaatagaatgtgcaagccaaagtgggtccaagaccagatcagagtgatgggaagcggaggggggcagaatatgtagagcctgggatgtcattgtaagaacctgagcttttactctgagtaaaatatgaagtcattagaacttttgtaactaaaaaggggcagaactgtctctctcactgctgtgttgagaatagaatgaaaggatcaaggacataagtcggaagaccagtcatgagaccatggcggtattccaggtaaaacatgatgtgtttcagacaagggtggtggcaaaactacgtggattcttatattttgaatgtgggatccataaaaatgagttgatggattggaagctaccataaagggcccccagcaatgaccttgaattcttggc

SEQ ID NO: 17958 - DNA, 758 bp, Homo sapiens
  misc_feature (1)...(758): n = A,T,C or G
tttccgagtatggtttgcctggtctctttgnaacanttactcttgtcctcattgtagagatggcgatactaaggcagaatatgtttctcttgctcatcggaccaaagtttggaatcacgtctcatcttcgtgtattttgaaaatctaacaaatctagaagatggtgtgaatgtgcatatatttagacaatttaaaattttgtcaaggacatgaaagaaagacatgttttctaacaaaacagaaaaaaacaaaaataagaacagaatgcttttaacattgcttaaagaactacagaactatggtggcaaagtgagtatgtcatacaaggtaggctatgtaaatctatgtgtgataattgtgtactattcattgataggggatgtactttctacttaactcatgttctcctcctagataccttacctataggtacagaagtatctattatattggtttaggctgattctaagggatatttctcttaatgtaagctgaagcagagagaaactctattggcagatgcaagtgacttttttaacacaatgagttactgaaggatggattcttaagctatggaatattgctgaaatcaaagctgctataatgcagttatactttcataagtctgaatagaaaaaaaagtcacatcatgaaaagagaactcaatcaaatattggacttccacactatttatgtgtactatgtgtactatgtgttcttaataaatattctcataaatacctgcaaaaaaaaaaaaa

SEQ ID NO: 17959 - DNA, 830 bp, Homo sapiens
  misc_feature (1)...(830): n = A,T,C or G
gttccgagggcnctggtcgtcttggcacactctcccactatctcgcacaatgaatgacacacttggtagcactacatctgcttagctgacgcgaaccatactgagaacatactgcacccataagtaccaagtaaaaactctctccacactatggattcaacacttcacatgttgacgcatctgtccaatacgtaacgctgtactatttctcagcaataccaaaattcaaaatggcatttgacctacaagactagatacacaggtactgagctgtcacttgaagtgaccaggcaaaggggctgctgtaaatataactccaacagagatccgcaaacctgaattgacaaacacagtctacctatcacattcgactggtcttcattttaaaccagatcatcaccagcgttatagaaagctactaaagtataactcataaacattttctttatctcctggaaaacatgaaggcttgctttataaaaattatttaaattgtgtaaatttaacggatgaatggtagacacaattgtggattaaatatttatggggatagaggtacagttgatatgaccttattggggtcccaatatcgagacccccattatctcctaacctttaccttaaagtttatccccagcaataggacttttgtttctttaccattactacataaaaagtagttttagccccattttactgaccagaaaaaaaattttttagattacttcctaaatacaagaaaagcctttgtggcaccattaggggatcctgcgccccattcccttactgagggcaattcatgaactcgatcccttaatgatatgcccggt

SEQ ID NO: 17960 - DNA, 855 bp, Homo sapiens
  misc_feature (1)...(855): n = A,T,C or G
ttcggnagaaccacctagggccttcttcctactttacattctgccctgacatctgggtaatgctgccacgttccacttctaattgtgctgaagcttttactgaagaggtggaggtctaaattagggcagactctaacaaagcagattcgactgagagcaaagaacctgttgtgcgcagtgccatgttctgacagctgagagctcacatttggatggctgctttgtatccactggtcaacagattgatatggatacaatcacaatgcaaaaccagggagcaaagagcataagaaagactttggaaaacaaactctaaaaacaaacacatagatcccttgagactgggcaatcagggtcaccggggtgcaagtgctcatggaaggctgccccagcacaacagggtgatcctcgggaagaatatgcccttgccaaaggctggaaattggagctccccactgcagtggtctctgcaattccaacaccaagttggtgcagcatttactttcaaacactttgtgtactatacatattctgagctgcattttcgcacacaagtgctttgcataactatttttactcattcatgacttggaagattgttttattggtctatctagctaggtctagtttattcagtccaatatttcagaagattctgttgtgtccatggtaagaaaaagaaagcaacaacaacaaaaaatacagttaaacaaatgattcccgtggctattactattttcccaaagctaccactatcactgggtttaaatttaattagaaaattgctttcaaaacagttgctanaaaaaaaaaagagatttgagatattggctgaagaattcattttacttctgt

SEQ ID NO: 17961 - DNA, 447 bp, Homo sapiens
  misc_feature (1)...(447): n = A,T,C or G
ccagtcaatttctgnaactaaaaacacccagaactcatctgcttgaataaaatagtgctcaagnatgtcacattcttagaatgaactctgaataaaacctacattaaaaatcagaatgcatggattgcttcacctttgattattcacctgttaatagatgcagatatgaagtatcactgatcgaaggaggttccagtcaaatacgtgaagatgaagcaaatggacgttggcaatcctggttctcagaccttcagacttggactgggacttacaccattggctcctctgattctcaggccttcaaatttgcactggaaccacacccaacaccactggctttcctaggcttccagctggcagacagcagatcatgggacagcctccataatctagtgaccgaattcttcataataaatatctttctctgtatctgcaaaaaaaaaaaaa

SEQ ID NO: 17962 - DNA, 198 bp, Homo sapiens
  misc_feature (1)...(198): n = A,T,C or G
ccactataaaggtcccttctaaaatanaaactgnatgaaaactctgttatttcatttgcaaagcttattgaagcacatatttatgaaattagacatggagaagtgaacaaccaccacctgctcaaccaccacgagaattttttattatttcgagataaaagaaaataaattaatatgcatgtggtaaaaaaaaaaaaa

SEQ ID NO: 17963 - DNA, 336 bp, Homo sapiens
  misc_feature (1)...(336): n = A,T,C or G
ttccgatggttgttcgattcctgtgtngaatttgnaanaattcacattgaaaagagagagcttctgacagactgagtcccagattagctacatgggcattacctttccacaactaccgagcggactttatatcagtgagaaataaacttccattgtaatccactgagaatttttttactttaaccttgtgtcaacaaactagcatttacctttgctaatgcagacacaaatgtgtcttattttttattgttcaagttaccatatcttgtttggcaaaataataatcataacaataataataaaaaagtactggatttactttgaaaaaaaaaaaaa

SEQ ID NO: 17964 - DNA, 840 bp, Homo sapiens
  misc_feature (1)...(840): n = A,T,C or G
ggttcggggatatttncccatatctcatcttttccttccaaaaaaccaaatctagaaagcacctggatgcagcatggatcagctatatcctcatgctacatgattgatttaggcacttctactcatcgtattgtgtagacatgatacatctgttgtctgatgacaccattagaaagataaaaagaaaaaagaaatgttatgtgctgtatttcagccaatgtgtagagcgacacttttcaaacaatgcagataaaaaccaccaatcattttgtcccatgactgaacctaacaatctttgaaatactgcaactctctatcaactgatgacaaagccgtctgcttcataagtgaaggaacatctgcggcataaagatgcttcattacaatatgggctgcatattgcacaaatatcctggctcaggagctgggtagttccaaggttcaactcctggcccaggcattggctagctgggaaatcccaaacaaaggacttcacttctgtgagcattcatttctgtctctgaaaggagcactgcagcattttattgagcacttttgaagtttagaaaaaatatgtaaagcagtgagcttagttcttggaagatgagtctctcaataatttgttgggttttttgtttgtttgtttttcttcttgtcttctgcctcctccttctctttttccttatatttatattttattttagtagcatcagaagtatctatgttttagtagtaatagaaacagtgtaattagttgtaataatacttagttctatttcagaagtttctaagtaaaggtatttttttctcattctgttctagaaatccatacacctgcat

SEQ ID NO: 17965 - DNA, 1069 bp, Homo sapiens
  misc_feature (1)...(1069): n = A,T,C or G
gttttcggatgtgcctaatcgagtttcaagnaatgnaaaaaagctctcacttcccaccatgcaagtaccatgtcgcgccagggcttatgccagctacgtccagtctctcagcacatcgagcagcgaacatctactccaggaactgagtaagccatgcatcccgtgaggatcacatagtgatgagcatgctagacgcctggtcctgcatgccgagagatagaaacattacactatccgccccacgatagcgcgcgacgcgcacgcactcttcgccccggcgcgtttcgcgtaccacgcttcccgccagcgaccgggacagaacccccccccgcgtccnatcgtataaaaatacacgaggctgcggacacgcgaacaagaaatagaacagaaggagaaggagaaccaagacggtgtagcaatacggcgccgtttgttcgtgcgccctgtgtttgcttccacccccccctttacacaatagacccaaattcagccgaccgcgcagaaggtaaaaacgcagaaaaaccgccccatagaagagaacgacagcagcccctatttacttctactcagcgcggtacgcaacgtctccaagtcagtaccttgttaatacccagcggtcgatccctacgagtgcgcgtgacaccgcgcccgcacttgcccacagaacaaataaaacaaactgacgcaattcccccaagcgtaccccgaccccgcatcagcgcatgagcccgtgccctcaccacctgtagcagacccaccaaaggcaggagccaacacgccaacaccgcctctctggctatctccacgacgccaccccccgagccaccgggaaccaccagacgccccccgctcagcgaataagtgaaaaaacacgaaaaggcaccgaggagatgaaaagacaataaaagtnggaagacaacgacacaacacacaaccgctgctcccttacaacgcgtccgagcgacggttgtaccggaccacgccgcccagacacctggcttttgaagacgtgcacaccacacccgctgcgcgctcgcttcgccgcccgcaaaaacgacaacgccggcag

SEQ ID NO: 17966 - DNA, 696 bp, Homo sapiens
  misc_feature (1)...(696): n = A,T,C or G
tttttccgatgggnnagttccttncagtcctncaaagggaaggaaatcctggcatgtgctacaacccanatgaaccttgagaactcatgctcagtgaaataaaccagacccaaaacaacagatatcgtaggattccctttacataaggtaagaaaggccggtgagaagaagccatctgcttcaaaccacgactggaaacagcagagtggactgagaaattctcacgcttgtatttagctgtggtaacatcattctcccagagagcagcctaaatcaaccacagcgcttttcggagctgcagcatgacttatgaatgtggatattcacatattggagaacatatacttttaatattatctgcctgaacctgatgaacagatggcataaaccaaaatcagcttaccacaaataaatatacaaaatgaaaattagatggatgaaaactaaaatttgatgctttttatattaagtcgaaattagaaatagataagctcatttatgtagctagtaaattgaaagcagaacatccatcttgtgtaaaaagaaatactctgaaatggaaattaataccctagtggataaattctttgaagcacagttaccactagctagtctacattttgtctganaatgatgtttttactaaaatacacagtaaaacctctggataaagcatatcattgaaaaaaaaaaaaa

SEQ ID NO: 17967 - DNA, 217 bp, Homo sapiens
  misc_feature (1)...(217): n = A,T,C or G
tttccggggngatccacagctactgnacatgtgatagnacaatagcctgatgcagaagcaaataaaaaaatccagctgactcctatgaagccaggcatcacagagatgcacatggaccctagaacttaaagaacaataaaaactaaattaaattaaaaaattaaaaagagatttgcaaaaaataaacaacagtgcaatgtctctaaaaaaaaaaaaa

SEQ ID NO: 17968 - DNA, 561 bp, Homo sapiens
  misc_feature (1)...(561): n = A,T,C or G
ttctagctctgcacgacttcctccatggnatctcgagcccctcaaagtctccatgagggatggtgggagctgtatctccgtctcccaacctccagtggcagacagatggatagagctatataatcatcagtggaagtgtgtgatattctgtcttcacaaaccatcgtgcaaagcagaaccaacggcnnncttttgtctgnncttttagaaatgnctctgcaagcaaaatccctcccnnacctgtcaagggttatgggggnaatgannatatnngtatananaatgggcanntcgatgtcatngnntgtaccctnngtaanaanannacacttggtatnntgggcatgggtgcagnnaaggaaattaaacgcaaatcagttttttttaaaacagccaatggtgatattttaaatttgtacttgtggcaaccattaaatatatggttgcctcagcactgcttctaaaaacattttttattgaaatttttttaaaaaatcaaccaattaatggtttattattatttaccagtaaaattacctagtaaaatgaaaaaaaaaaaaa

SEQ ID NO: 17969 - DNA, 752 bp, Homo sapiens
  misc_feature (1)...(752): n = A,T,C or G
ggtccactacagaactnccaaaacaccancatcaccagtcaactatgagtccagagaatggatcaaatatactcctctgtgaagcccttgaacttggtttgctttgcctggaattatcttcattcaaatatccttgtttacattccttgattccattaaggtttatactcatattcatggcataaaaataaattataatccaatatcaacttttgaaagatccttccaagagaattgtcaaatccatatatgtattatgtatgtgtgggtgtgtgtgtgtgtgcgcgcgcgcgcgcgtgagcatgcgtgtgtgtgcgtgtgtatcagccagctagattgtcattacaggctacatatgcagtgtaactaatcaaagaaaaaaattaaaatattaaaatacttactttatatccttaacgatgatctagtttgatgataaataattaagaattttttaatgggaagtactcaaaagttaacattaagtggctgtatattttctctgtacattaacattgatatctcaaattattgattagcttgtttcagttgcaagccctgatatccataaaagttatctgtttaagaattatgaaactttgtttactaaatctattaattgctagggtctttggtgtgttataactatttgatcaatggctaaatgaaactcatatattcgtatctgcagattctttatatattagattaataaagtttaactgctgttctttatttcaaaaaaaaaaaaa

SEQ ID NO: 17970 - DNA, 366 bp, Homo sapiens
  misc_feature (1)...(366): n = A,T,C or G
ggtggtgcgccgccgggccggacgtaagtattggaaagaggttcgggtnactgaccgaaggcggttccgnaagaagcacagncgctgaacgccttccatggctctacagcccgcagcagcatcgcatcctcagccgggctgacctcgaatctccctccagagaggggtctccctatgtgcccaggctggtcaactcctaggttcaagccattctcctgcctctgcctcccaggtgctgaggagacagacgtgagccactgtgcccagccaataggtatttttttagttaccgatatgagtcatgcaaatgctttgcaggaataaattgatttaatcttcatagcaatgctatgatctaggtacaaa

SEQ ID NO: 17971 - DNA, 428 bp, Homo sapiens
tccagtatatcaacgaagaaagggaaaaggatagaacataaagaaaatcttcttgacagtaataaatataagaacatttttgaatattggacaagatgaccaatagaggttatggattagaggtcttagaaatctttttaaaataggagcaatgaccatctgtcttaaatggtttgtgtctttacctgcctggaggccaaacactgaatcattaccaaatgtatggttctattatcccagagattgatgtcattacctctgaagtttaatgccggggaatgggacaggcaattgaatagtgctgaatcgaagatttaagggttgaagagatgatgatacaatataagtgtagcatttaatttctctaaaactccagagaaaataattctataaaaataaaagtttgtggaagttcaaaaaaaaaaaaa

SEQ ID NO: 17972 - DNA, 393 bp, Homo sapiens
  misc_feature (1)...(393): n = A,T,C or G
tttccggcaatacaactcgtncttggcccaanctcacccagttcatatagaggaatatccctatgccagaataatggcctgaacatccttctccttacaatccaagaagtgagcacagaaggctgaagcctgaaccacatgaccccagtgccacatttcctctttctttcactgctctttagaattctgcattatcttcacttgtagccctctaaaataactggaaatttctctgggacctgaacaagtagtctcctagctacatgctgattttatcactaaaaagcaacagcatcttgatttcatggacattccattccaaatactgaaagtttcctttcacctgacagcacacttcaaataaagtatgtttctacaataaaaaaaaaaaaa

SEQ ID NO: 17973 - DNA, 444 bp, Homo sapiens
  misc_feature (1)...(444): n = A,T,C or G
ggggtccggctattaacccgataaagaaangaattgactctcacactgaaacatggagccagaaacctgaacatgcctttaagtgataaatgggacaaaaacctgccaaccaagctttctacatcccaggaaaaatgtccttcaacaatgaagataaaataaataccttttcagtgaacaaaagctgagagatgcaactaagaagacaatataagcaataaaacacaataccagtattattcaattaactcaaaataggttttagaaaagagcagcagaggaacaaaaacatgagggacaaatgtaaaatagacagcaagatggtaggtaaaattcaactacataaataatttcattatacgtaaatgaactgaacactacaattaaaaggaagtaattgtcagactgaataaataaagcaatactcaatgaaaaaaaaaaaaa

SEQ ID NO: 17974 - DNA, 255 bp, Homo sapiens
  misc_feature (1)...(255): n = A,T,C or G
ttcccgagcgnaggccatgtgtattagtncctgnaaanaagacttgtgagtcatttccaagctgcagtacctacaagcccatgggaagttcttcggtttctctttcctctgccatcacaactaaggaacctcagatgaaacctcttgggcccctgagtcactgcatggaagacaattgccttgtagaatcacaatggattttgtgtaaaagagaaataaataaagcattgttttgttaagccaaaaaaaaaaaaa

SEQ ID NO: 17975 - DNA, 446 bp, Homo sapiens
cattattcctgcgtacatcggattaaactgttgcaacattcagcacatttttatccagaaaatattgaaaacatatttaatgcaatattggagggattatagcattcagaaaagggaaagtctgactaatgcagcagctgcactgcattccagcacactcaagacattgccagcatttattagccagtcaagtctttgacaataaacaatctacagtccaggctcatgctctctagtggatagttgttggaactttgttttcatgacagcattaatagctcttgtttctgtaggttgcctattgttaactgcttaagtcatatcagaaagattttaatgaagctttaaatgtacttttaactgcattctagtagatggtatttttatgataatgatccactttgtaaaaagtaaataaatatataattaaaacaaaaaaaaaaaaa

SEQ ID NO: 17976 - DNA, 321 bp, Homo sapiens
  misc_feature (1)...(321): n = A,T,C or G
ttttctcaggcnatttnnaaataagtattcagncaacatncccnacaattaagaagttcctgcagcctgggagtcagaggaagccacccccgatacccactatgttgaacttgccaggaagatagtgctgctctaatggcagcaggttgcgtgatgacaaacatgatgatccagtcacagcaccagcatgtgctgtctgcagaggataatagaagcaaactgtagatcccaggagcaaagtgtctgaaaagaacaaaaccatgctgccattaacagcaacgctgattaaatgtagtataaaatcattcaaaaaaaaaaaaa

SEQ ID NO: 17977 - DNA, 779 bp, Homo sapiens
  misc_feature (1)...(779): n = A,T,C or G
ctccgggctgcttctatgtgtaacctgtctggnatagacctgtatcctgtacactctccagtacccagtgaatatgagcttctctgaactgactgaagaccacaagatgaaaactggaaactcgcagccttcatacaacaaggcatctggtatggaagcgttcagtgcgggcttctctggctgatacactcgccatggaccttgctatccctgagctgggaccctaatggatgtgcatgagtttgtctccaacttgtaaaaaatgtgcttttgcaagaatgagtgaatcacagactgaaagaatatatttacaatgcatacacctgacaaaggtttcacatccagaatatataaagatttcctagaaatgcgcaataaaaagacaactcaaaaaaatggcaaaagacttgaacaagcacttcacaagagatatgagaatgactattaaacacacaaaaagaagttccacagccttgataataggtaaaatgcaattttaaaccactgtaagataccattttatactcactagaatggctaaaatacgagagtctaacaattcccatgattggtaaggatatggagcaaatgggatctcagttcagtgctattgtaaaaccagtttaaattctggtttatgttaaactctgttcaaaatgatttgatgtgataaaatagttntggatattcattcatgcacttatccaacagttatatatttagagttcatggtgaataaaacaaagttaaagccttcaagaaccataaaaaaaaaaaaa

SEQ ID NO: 17978 - DNA, 322 bp, Homo sapiens
caaacctgggtgggaaagaagccttatcctaagtgagtaactcaaaatagtcaaatactgcatgttttcacaagtgagagctaaacaatgggtacacatggctatatggagtcgaaaaatagacatgggaagacaacaaaagataagaaaacagagactgaagactttatataaattgcccaatccacacagctgggatgtagcataaccaggattcagattatctaagaagacctcatgatctgaaaatctttataaatgtgcttcctccttgagacagatcattaaaagcagttattatgtttctataaaaaaaaaaaaa

SEQ ID NO: 17979 - DNA, 740 bp, Homo sapiens
  misc_feature (1)...(740): n = A,T,C or G
cggataaatggcacacttatttttgggaaaaactccaaaaaaaatttcacanaatgaagaagacttggtctgctactgattgtgtgaagggaagctgcctactgacagagaatgctgcactagaaccaaaggaaaaacttcaattgtatgaagtctataaagtgtttggatgtttttgttactctaactgatgcaggggttttttttaaacataggtttaatttattcatgtttaatttactccatttttatctttcagacttgatgtttttgctttgaaaaacgttttaaatttggctcaatgcttcagttcatgtatggcaaatgggaatgatatagtcactttcaaactggtagataaagaaccctctgttttttttacctcactagaagatccagcatttgaagggctagaataaaacccttcttccatgactaatagtattggatcaagggaactcaagtaagccaaattgctagtaatttcattaatcatggcaggttttcttttgaaatgtcttcattttctttaaatataagagcaaagtagaaagttttttttttaaatgatctgatgagcaaaataaggaatatatatncggtatgtagaacaaaacaaaagtgtttcagttggtttgccaacttcaagtttcaacatggtctccagatgaaaggacagaccatgagtaagaagattaaaatgtgtgctcattaaatggttctatacaaaaaaaaaaaaa

SEQ ID NO: 17980 - DNA, 605 bp, Homo sapiens
  misc_feature (1)...(605): n = A,T,C or G
ccactacagctgcatacctgnagcactcttctgagccttttgaaagtttctattaggatcatctgttcttggtgctggtttgttccaggaagagggacagctgcaacactatatccctgttcaacctgaggaccatctgactttaattgtaacacacagcttgatgtggctctggctatgagaagccgaagtatcgtctgtaataatctggaaaagcagaaacctgccaacagagggctgaaaacagggattgtgctgtctggctgcctgacgggctgcaggaaatatgattaatgagtaaggtataatgatatcaggaacccgattagcaccacaaaaaggtcacagatcaaagtagtatgcatttcatgagctgcaatcattgcataaaatctgtggaattgaagtggtaaaccaaaaagaggagggggatgaaactcttatgtgacaatatgctaaccaatacataagatacaatactaacaatttagtcacttgtagaaagttaaaaagaaattacaaaatgaatcaatatagactatattgtaaggaaactttgttcatcagaggtgtaaaataaatattttgaatgaaaaaaaaaaaaa

SEQ ID NO: 17981 - DNA, 589 bp, Homo sapiens
  misc_feature (1)...(589): n = A,T,C or G
ttttccgagtncctggtggggaaatagattagggnaacagctggnagtgacgctactgnanactttgnagnatgtcgggcactctacanatgccagggnaaatgtccaaaacattcatcattggggagctccatccagatgacagaccaaagttaaacaagcctccggnaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacaccggagaaaagaaaccattggtaactacttgcaacctgacagaaacctttacttgaaaacaatgaatttaatataactctttctttttcttccggcctttagaaccaaaccaaaagaactggcccttttgcgcttaaattttttcaagggggccttttaatccaccaccttaatttggaggtttccttatggggaaattactttattaataacctggacttttaaaaatatatttggccttttaagccaaaaaaaaaaaaa

SEQ ID NO: 17982 - DNA, 355 bp, Homo sapiens
caaaaactgagtttcaaaagttaagcaacttctccatggcactgacctggaaagatggagctgggattttaacacaggtagttggacaccaaaaacctacatttgtacaggaagacaagtgtgaaaatatatagtaaacatggacacttaattgtacaatggaaaagagaatgcaaatatttgctttaaacactttgaaaaactaaatgtaaaaaaagaaaaacaaatgatttaaaaaatgagaagagcaaaatgtctgattatatgtgacttgtgaccgcatacatgcaaaaatatgtgtacatatggacacccattggaaagataaaaccattgatttccaaaaaaaaaaaaa

SEQ ID NO: 17983 - DNA, 250 bp, Homo sapiens
  misc_feature (1)...(250): n = A,T,C or G
ccggtctcaggcaaggcaattcattcatataaactggaaattcctacatttttaattaaaaatacaaaatatttttaatgcanaattccggaaaagaagaagagaagaagaatagctttggtctgtcataaagtgaaatgggatcttgattgaatttttttctctcgacctctgaagacttggaagagggaaggtacctattggaaggattttgaataaagtttaattcctgacttcaaaaaaaaaaaaa

SEQ ID NO: 17984 - DNA, 856 bp, Homo sapiens
  misc_feature (1)...(856): n = A,T,C or G
gaatgggcaggctatttggcacagnatatgagttgtggatgaagagggaaaatttctcctactggcactgtgatgactagtgcaaacctacgctatctacaatgccttccctgtcttgcggctcattctttctgaagccagaacacttagagtgggtggggatagtagggagaaccaccatgctgcaatagcaaaccagctccagagaagggtcttcaaggggtgctaataatactttctgacaatgaatcttcactgtggggatataaattatatgcatcctaaacttgagtttgcatcaagtcaatataacaatcacaaatgattatttccctgcacttcatatcataaaatataacattttaataacaacaaaattaatgttaaaattaaactattttcctaattataatgttgcttcagaataaggagtacataatcttcaactagatgtgttatttcaagagtttttacttaattggtgaatctggtcctaatagaataggcaatttaattattccacagagacattctaactttagaaaggaaatcatatatattttaaacaccaatctaattagactttctgtatttcctcaaattagcctctgactgagaaagtgttatgtttcaaagattacaataatatatttaaaaaagtagggtgagcatcaaattagttcattaattttaaactctagtgctagagcattatttctactgttaacatgaatttgttaataacaagacgactatgattagtaagtctgtagatatgttctttagtaagatctgcttatgtaattttaaattcccaattaaacatgttgcctctggaaaaaaccccaggtggttg

SEQ ID NO: 17985 - DNA, 434 bp, Homo sapiens
  misc_feature (1)...(434): n = A,T,C or G
ggtctgggccaagacaggtttcgaaaaantatatgcccggnggtggtngaaaaactttttattaactccacgccacataaaccaataaatggtggaattccaagaacagcatatctaggaaaagaatttggaaaactaaatagtagcagcattcctctgggaagaaggcccgcaggagacgacaactggaaggatcagaaagctgcctgccaaccttttgtagaattacttcctgtagccatatgttgaatctggagcaaactaaagacagtgaaagtgcatttaatttttgatgacactgagctgtcagaaggactaatacaaaaaaaaaaaggagaagtgacgtatttgaaatctataaattgcatttcatgttcatttgtctactctaggaaaagcaaataaagtttcttcttccttcaaaaaaaaaaaaa

SEQ ID NO: 17986 - DNA, 1718 bp, Homo sapiens
  misc_feature (1)...(1718): n = A,T,C or G
agtgactggcggtggatgtncgcgaaagaagccccatgaaagcagaatgctcatctatccgcgctctccggtgtccgcacagaggcacatccaggtcaatatcgccattcagtctatatccacgcgagtcacgtaagggacatcacgaggttggtgctcgagccgtcacgatgccgcgcgcgcgaagaacgtgtgatggtgttacactgtgcagagagagcgagacacgcaccagtatacacggagcgaccgcaggtgacggacggtccactgagtagagacgtaacgtagatgacgatgcgagagagagatgaggtagagtgttaagaacgtaatgataagacgactcgccgcgcgcaacgagcggcgcgcgcacgagcggactcgcagtagtgacggtgagcagacgagccgagcgccggttaggtcagggcaggcgaaggtcgcgcccgcacgcggtatcgcgcaaggcccgcattctgtccgagcgcgtgcagcacatggggagtaaagagatgtacgagactcagagttagccgggagcgacgcgcacggcgtagagcgaacgaagtgtgaagtcgacgccagggaaaagagtcgaatatgtgggacggcgcgtatatgcgggagctgccgaggcgcgccggctatagtcggcgagagtaaccgtagacggcgagcggaagagcgccagaagttcgacgacgccaggcagagtcgggaggtccgtgacgtcagcacgaggaacgcaccgacaagtgagtaggtgagttagacgattcgggtcgacgacgccacagcntacgcntcagcgcacgcgagatagttagagacgccagtcgagccgctcgcgtgttagagatgccgcgcgccatcccacgcgacacgcgtacggtgagggtncgcgccacgcatgtgcgtagcgcgagtagcacgcacggcgagcttacgagtgttgagattagagctgtccagtatgcgcgccagtctgttccgtgatggccgtggacatataggcccgagctcatgtcgcagcgccgatttatgttgtcgcgctcaagccgcgccaactgagacacatggcgtgagcgcgtctcgtgtgtaaagntgacgtactcagacgtccacggaccggcgcacgcggtngagtgttgacacctggtcgcaagagtttctccgcaatagacccagtgagtccgagagttagaagtcgcgtagtccgcaacgacgtacgagtgagggctcagcagacagacacgcagcagtacaatataaccacgntagaggacganagctccaagccatatctncgcgccgacgcactcgccngtagtcgagtacgtggcgcgagtatcacacgcagcangcatgcgacgacctcgcgctacgactgagtaaaacaatactgcacccagcacgtatgtatgtgtcgcgtttcgacgcgcagaaagagagtnaccgagagatcgagtaatagnagncgncgggantatagtagtcacgatgtctgcatacagttgcaggcngcgacggtaagataaaaaaagatgacaagatacgatggccagccgtatcgatccgagctccacgacgagagactgattctttcgtcatgctacttctgcaccaccgcgcggccgcangagcgatgtgcgtgttaatgtccatcgcacgacgccagagtgtgaagagcancaccgctntagaganactagaat

SEQ ID NO: 17987 - DNA, 314 bp, Homo sapiens
  misc_feature (1)...(314): n = A,T,C or G
ggcggggccgccgccctggccgaaagataggtttttgnnngnngtttcggcttnaattcccttttaactacaanaaaactcanctgnaaaagactactggnaacttcctttactgggcatacggttttcagttaaccataatcctccccactccctgngatatttcccctctgctttcttcattgcctgactagctctacaggactccaacaaacccatcaccatagaaattaaacttcagaagacatcatgagaacaaaatacgtctccaaaccagagaataaaggatgttgcaatatgcaaaaaaaaaaaaa

SEQ ID NO: 17988 - DNA, 341 bp, Homo sapiens
  misc_feature (1)...(341): n = A,T,C or G
tggcccgcggggtttggtcttttgccccgcttttggctgttcatgaaacccngattcggggnaatacctgnagnccagnaaangacaactcttacatcttacctcaagtccagacattgaatctttggagagaatttattctgcaaagactaagtatacttatcctacagtagctactcttgtggaggtaaacaattgcgtcttgacctaaaaacaaaatcttggtaagaatgcaagatgtcagagtgttcagaagagagtgaaataggatttatactggctttttcaatgcagcgacttcgatatgactcaataaacaccagtctttaaaaaaaaaaaaa

SEQ ID NO: 17989 - DNA, 367 bp, Homo sapiens
  misc_feature (1)...(367): n = A,T,C or G
atccttggcttnagaaacagtatattttaaacanaaataaggtgaaggttacctgaaaaatacttctggataaaataaccagtttgacgtggaatttgagttacaattatgtcattcatgaacacatatacacactcgaacataatctcttctgtggtaacaagctgtgaaaaaagtgagaaggctaaaatctcaacctaaatatgaatcattttagcactacaattatttgcaagcactgaacatgtaatacccagatactcctgtaattaaaaggtgattctgaaaaagtcattggtaccatacatatctgttattctgtattccaagtattaaattttttattcaatgttgaaaaaaaaaaaaa

SEQ ID NO: 17990 - DNA, 801 bp, Homo sapiens
  misc_feature (1)...(801): n = A,T,C or G
tagtcgnggtaggnganctttgtttacccagnctggnatacaatcttggctcactgcactgcaacctctgcctctcaagctcaagcaattctcatccctcagacttccgagtagctgggattacaggagtgtgccaccatacctggctaatttttgtatttttagtagagatggggtttagccatgttgtccaggctggtcttgaactcctagcttcatgtgatctgcccacatcagcctcctaaagtgcttggatgacaggcttgagccaccatgcctggcctaagtttggctcattcttctaattgaccatcttggcaactggaagtttcacaatctagtaatctattttctgttaatgccacatgcttttaattgcaatagcattataataactcttgatatgaaatggtgttagtcttccaactttgttcttttacaaagcaattttgcatattctaagtcctataaacttgtacataaattttagaatgtatttttcaatttgtacaaaaattcttgttaggcttgtgattggaatccatagatgaatctgagccgaactgtccaaatatatattaacaatattaagtattttataatttttatgctataattttcttattttcaatgtaattggctactattagtatatatgtgtatggatgtatatacagaattctctataattatggatcctgcagtatggttaaacacaataattctagtagcttttgggggatttcataaaatttttctcataaaaaaaggtttatttttttttttccaaaaaaaaaaaaa

SEQ ID NO: 17991 - DNA, 381 bp, Homo sapiens
  misc_feature (1)...(381): n = A,T,C or G
gggtcggggcacaanatccttttttatgaggagggcatgctgtggtggcagattttgngagaatcaaaatttctacagtctctggatgaagacaacatgacaaaacaacctggggtttgctgctgcttgtgtttcctataattataaaccaattaaaatatgtaaactcagcatgagaggacgtaagatgagagcagttttaattggaagaaatgtcattgtctcagtgttgggataatggcttatgtctttatttttagtaagctgtcaaaataactatctcaaggctctactagagaaatagataagatatatatttggaaaacagtatggataaaataatacagaatatgtttcaaatataactgaaaaaaaaaaaaa

SEQ ID NO: 17992 - DNA, 846 bp, Homo sapiens
  misc_feature (1)...(846): n = A,T,C or G
gttgtggtggngatctttgtttctccagnctggnatacaatcttggctcactgcactgcaacctctgcctctcaagctcaagcaattctcatccctcagacttccgagtagctgggattacaggagtgtgccaccatacctggctaatttttgtatttttagtagagatggggtttagccatgttgtccaggctggtcttgaactcctagcttcatgtgatctgcccacatcagcctcctaaagtgcttggatgacaggcttgagccaccatgcctggcctaagtttggctcattcttctaattgaccatcttggcaactggaagtttcacaatctagtaatctattttctgttaatgccacatgcttttaattgcaatagcattataataactcttgatatgaaatggtgttagtcttccaactttgttcttttacaaagcaattttgcatattctaagtcctataaacttgtacataaattttagaatgtatttttcaatttgtacaaaaattcttgttaggcttgtgattggaatccatagatgaatctgagcagaactgtccaaatatatattaacaatatttaagtatttataatttttatgctataatttttctattttcaaagtatttggctactattagtatatatggtgttgtatgtatatacagaattctctataattatgtatcctgcaatatgggtaaacacattaattctagtagcttttgggtggatttcataaattttttcaataagaaaagtttaccttttttttttccacaaaaaaataaaaaattgggctctttgggctcaacgggggagctttgcggccgtttcctt

SEQ ID NO: 17993 - DNA, 732 bp, Homo sapiens
  misc_feature (1)...(732): n = A,T,C or G
aaacttagtntaacagccgacgtctgggctaacctctactacgcatcagnatcatccananagcttgttaaaacacanatttctgcgtcccaccctcagagtttgctgactgagaaggtctgggttggaccaaagaatctgcatttttaaaaagttccatggtctaggaccacactttgagaactgctgttccaaagaaccacctgctttatacttttttttctcttcggatcatataaatctgccttttaaaaaagcacctgttggatctatgaaactgatgcagccggtagtttctcattatggtctcattaccctttacgttgaaaaatacaaagccacttcaattgccatttcacagtacagcccatggcctggaacgggcacagctgccctctttaggttgaaaatatttggcaaataaggaatgctggcaagagaggctgcagttttgacacctacaccttgatttgggattcatttttctcactcaggatttggcaagcgtatgtcttctttaaagtgagactgnaaaatagctctgactcacaaacctagcttaaaacaccacaaagagtaaacaactatttccattactaattattattaaaatatgtttttgagtttttgcataacttgcctgtataatgagaactaagtatttacatgggaatttctactttactgtgggaataaatttacaggaacttaaaacctggaaaaaaaaaaaaa

SEQ ID NO: 17994 - DNA, 444 bp, Homo sapiens
  misc_feature (1)...(444): n = A,T,C or G
tttttggaggaaaaaatatgccatgtcagnagnaagccaacctnatttaaaacaacaggagnagacagcaactctgctccacatcattacttttgacaaatattcaggaagtcttaaagtatttagctcaaaaaaagacatctctgttatcttctgacttatcttctctcctgaggagttaaagcgaagatattggttatttatatgttgaggtgtactgatttggggctaagttacacacggactctcaagttcagcattaaaaaatgcagagattcacacatgaataaaaaaataagaaagtcaactgatttgtctaccaaccaaacacatcaaaatatcaagtataacaaaacgggaaaaaacatattcttaatacaaaaatgtatattgtgattttccttgatggaataaacttatttctgactactaaaaaaaaaaaaa

SEQ ID NO: 17995 - DNA, 904 bp, Homo sapiens
  misc_feature (1)...(904): n = A,T,C or G
ttgnggtgtnnaggaagccgaatttactgggaagctccggctgcactggtaattagctggtgcaagctacagatatccattatttagggtgcggcaagatttaaaatagccttgacattccagaaaaagattgactggcaaacgagtgtattactttgggagtggtgactttctctgggaaataattccatatgacagaagtatctgaataactctggcatatttttcatctagctccaaataggtttgaataaaatgtcatttcagaactttatcatggaaaatatttttattttggatgtctaccccgtatggtggttaattaaaaaacacttttgggaagtttccgaaaaaaacaaaaaaatgtgctccttggccctcagcgtggtaattttcgcggcccttctcctttttataggggggttattcatagacccccgcttactgacctcgctgcgccccggccttttcggtgtgggcgaatccggtttctcctttctccaaggggggtattccggtatcccaccgtattggggcggtcccctcgatataaacttttgccccaaaggccgtttcctggctttgaccctccaaaaggccgtgtagttgtagatttatcaatagaatgcgccgcccttttttgttattaagaaaactgactgtcatagtcttatgactcgcctccacctcccacggtctttattcaaacccaggtcgttcccaccctggaaagatcgtgcgatgcgctttttgctataaaaaccatgcccgtatataggtactaaatatcgcgccatatctccctttttgtatgccggtgctctttatccttacccccgccctctatgcctctcccctcctttttggaaggagctgggccctcctccatgctctcaagcatacc

SEQ ID NO: 17996 - DNA, 318 bp, Homo sapiens
  misc_feature (1)...(318): n = A,T,C or G
tttcggtgaggnataccagttctagggattatagagtgaggaaaaaggacagaatggcatattctttttaccaaaaaaagaatagcataggactccctgaggaatgaagcaatggagcactccagcaacataaagaaaaattcaaaataaagcatattaatagtctttgaaatatttttctacagaaatcatgactcaaagatatgttttattaaactcataactttccattatgctctaaaagaaaagatataatgataattaggtaaggtaataaagaaaataaaagaaccaattttatcatcaaaaaaaaaaaaa

SEQ ID NO: 17997 - DNA, 395 bp, Homo sapiens
  misc_feature (1)...(395): n = A,T,C or G
ggactcggggnaaacaagaccgccatccagggctnccncctgggcgctttattctgggnatatgggcacttatatcatggttttcttcaaaacttatggaattaagcatatgaagttcattttttagacttgatgatgaatgaagaatgcatgggaggactgcaaacttggataataatttatgtcattatatatttttaaaaatgtgtttctcttgtttttattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaaaaaaaacaaaaaaaaaaaaa

SEQ ID NO: 17998 - DNA, 450 bp, Homo sapiens
  misc_feature (1)...(450): n = A,T,C or G
aatgggttgcaaaactcttttcgaagnactncaaaaatcaattcacaatattttcttcaaccagcagtctttgaaacaagttgatttcacaaaagaacaaacagtctgaagcttccacatcctgactgcaatttctattgttagtaaaaactgaggattctcaagttaaaccatcttcatggcctactatgtgcaagttgctagacttctatctcatgccattggacacactgcttgagcagaggaagctttggatttgtttaacataggcacgaaaaccgatcctattataagcaatatctgtacacagggattaatcaatcaacaaacatttattagaatttcactgggtcttatgggatttatatatatatgtctatgtgaaaataatgtatatattatgcctatataaaaacaataaagttaaaaagccatggaaaaaaaaaaaaa

SEQ ID NO: 17999 - DNA, 543 bp, Homo sapiens
  misc_feature (1)...(543): n = A,T,C or G
ttcgaggtggcacggcgagtaagctctctcaccaaagccancccctcagccttggacttcctaaccaccanaactgccttgtaagagaacactgcctccttgaagactgccataaaccatgaggaatgtcttctaaatcagaatcatgtccacacaacaaagttttattaatagaaaaaaaaaatctttcaaaaaacaaatcaatagctggtttgccgattaactgcctagaatccctgatttcccacgtgagttcatattatgaatccaccagagaatcctttcaatacaactttggtcattgggaggcacagaaacagcattgcccaggtcctgccaccttctggccatgtgaccttgggtgagtccctccacctgtcctaacttattgtgcctcttcaggggaatttcactggtcatggaaatggaccagtttacagcgaatccacttaagacaaatcataaaattgcacactaaacagaagatgttcaactgggactccaacttaaaaataaaaccaaaatcttttaaaaaaaaaaaaa

SEQ ID NO: 18000 - DNA, 587 bp, Homo sapiens
  misc_feature (1)...(587): n = A,T,C or G
ttttggnggcgtcttccctgggnaaaaagcccctaacaaatcactcccatgaaggtggtaacaggcaaagagaaaatttatctgcaaatttgacagtagatctaagaagagatttagtaactgaatctacttgctgaaaccaggttttccgctgacaaggtttttgcctgacacagattctgcagacaagaacataataaaatatgaagaactgcttgtcagagtttctgccaatgctcacatgaaatatagaaaaaaaaatgactttttttttaaggggccttgtgatggtcgcttttggcatgtcagaaaaaacacctccctagccaagttctccaagccaaacaggtgttttcttttatgttagaggttgatttgttttttaatttttactgatagtggaaaacacgattagccaaaaggaggcgggtgggtaatgtcttaccctcagatttttgcaggcaaaggaatataaaaaaactggaaagccgaaggtatttcactcaagatcttatcttctgaataaaacaaaaacaccaacatctgttaatgattaaacaaatttaacttctcgaaaaaaaaaaaaa

SEQ ID NO: 18001 - DNA, 835 bp, Homo sapiens
  misc_feature (1)...(835): n = A,T,C or G
tgcaccagttttaggnggnagnaggagcagcagcagcaagagtagtaagaagaagaagaagaagaagaagaagaagaagaagaagaagaagaagaagaagaaaaagaagaagaggaagaggaagagggggagggggaggagagagaggaggaggaggaagaggaagaggaagaggattttattctgtgaaccatgtctacagtcaaaagcaaaatattatgttctgtccagatttaaagaggacaatttatatgcaaagtagtctcatttattccacatgcatttgagaaaagtgactgattatgcgatcaggagtagaacaccagacttgactgagtgtaacagcacgcaagggcattaaaatggacaaaatttcaaggacaatatacttaacttctcctatatatttatttatttaaaatttgcgtcacacttttagtgtgttcttaagcataacaccttgcctaatgctaagtaaagtttgggattaagttaaattttgatatgatattgcaccgctgatctacctaattttattttaaatgatattctttttgcttcccctttacatcttgagcgattttaattaatttttatttgatcaaaaacaattatttaattggtcctcttttgcctcatctggtggagcttttccgccccctttccttttgtgggggtttatttctttttccttcctcccttgtctcgcttgccctcgtgtctttcgccttccgctctcccgctttcttgcttccttccatggctgtttttttccctttttcctctcttttccggctttttcgcccgtctatcccttctctttccttattctccc

SEQ ID NO: 18002 - DNA, 903 bp, Homo sapiens
  misc_feature (1)...(903): n = A,T,C or G
tttgctcggnanagagaaccgagatgcgggggcanaggnanaacagtagnagtagnaagaagaagaagatgaagaagaagagaagaagaagaagaagaagaagaagaagaagaaaaagaagaagaggaagaggaagagggggagggggaggagagagaggaggaggaggaagaggaagaggaagaggaattttttctgtgaaccatgtctacagtcataatctttttttttgttctgtccagatttaaagaggacaatttatatgcaaagtagtctcattttttccacatgcatttgttaaaagtgactgattatgcgatctggagttgtactcccgacttgactgagtgttactccctgctctgtctttttattggtcaacatttcttggacactttacttaacttctcctttttttttattttttttcaattcgcgtaactcttttagtgtgttcttttgcttaataccttcccttctgcttctttttttttccgtttctttgtcattcttttctgcctttcctccgcctcttcttcctccttttctcttccctcctcttcctcttttttccccttttccctttccgtctttttttttcctttttccttttctccctcgcattataatttctcgtccttttttttcccccatcccctgtcctcctcttgccccttccctcccttgcgtgttttatctctcgatccctcattccttctcttcccttctctttttccctgctttttttcttttcgccttttttttccttcttttttctcccctctctcctctnttttccctcttttctctttttcntcccctcttttcactttttctcctctttttccccctcgctcgcttctttcccccttcctcccccccctctttttccctctctttctt

SEQ ID NO: 18003 - DNA, 320 bp, Homo sapiens
  misc_feature (1)...(320): n = A,T,C or G
ttttctgagggaaactgtcctgtttccgcacctccnaactccaaanatactctacaaggcagcacccctgcatggctcaggttcaaaatggagatatttaccttctacaaaattattgcttctggggcactttacagagtgggaaacatgttcacacccaggcggcccaagggccatgcctgctgctgagctacacggtgccacgtccagagagcctctccatctaggcttgctctccccccagagctagctgccttgtctgcagggaccagctattccccagaaagaaaaataaagttctaatcagaaaaaaaaaaaaa

SEQ ID NO: 18004 - DNA, 485 bp, Homo sapiens
  misc_feature (1)...(485): n = A,T,C or G
tttcgagactggnccacttaaanacaataagaanccaacaatcctgtaacatctcagcataaattaccccagccctcatcacttcttctagaactaaactttaaatatatcgaatttcattataattaaaagtctttcctgggtgatggtatcagttctttgtcatcgttattgacagtggtgaaatgcaaagtatccatgaagtattgctgctgtatgccgaacttgcagaaagcacatgtgacggagctgaaccagcttcaaggatcatcagttttgcttaaaagaacaactgaaagacagactagagttgttcatatggacattntcatgaaaatgaataanatgagcctgtcgatgttgcaattgataaaattcaagttttcaagtggaaattagaattttggaaaacttttatctgctaaaagttttccagtgagattggtagtaaaattaatgaatgtggtttttcaaaaaaaaaaaaa

SEQ ID NO: 18005 - DNA, 389 bp, Homo sapiens
gtcggtttggacttcctgttccttcttagtttagtccctatattttggaattcttgctgctattgtaaatgggatattcttcacaacttggcacacaatcagcattgttttgaaaaggggagagaagttggctgagtctctggagactcttggaatgaagagaaagtaagcatggagaggagtgctgtcttggacatgagaaagagacctaaagctgaatggaagaaggacctcttgaagttccttgccagcatttattgtattgcatagtttgtattctcttcttgttgcccataaaatgagttattaggaccaaattccaaacttctagatacatatattgtcatatattaaatgccgaaatctataataaaaatttagtgaagaaa

SEQ ID NO: 18006 - DNA, 334 bp, Homo sapiens
  misc_feature (1)...(334): n = A,T,C or G
gtttctgagtncatcaaattttcatgtattttacatgaaaatgactgcaagttaattaactccactggagactagagaagattaaccaagnanaaaatgaaaatatgctatgtacatagcacattgtattgtgataaacttatgaaatgacctaaagaaattttttgtttttagattttattactaattgatgtgtatatgtattctctaaaaaagtgcatagacagaacttagcaacacttcctctgggtttttacacataatatatatacaatatgtaaactgaattccctatcatgtttttgataaagccattctcccaaaaaaaaaaaaa

SEQ ID NO: 18007 - DNA, 779 bp, Homo sapiens
tccaccacccttaaagtatcaagtttccatttctagaaactgtccatttccacctgagcaaactgcaaaagtcagccccatctataccttcaactgagcataagcataaccaagcttatcaaagtccccaacagtcccaaccagccagcactcccctaacccctcccgggtaggaacctccctcagagcacacttccctgacctgacccttcttaaaagcctcaggctgtaagagaagtttgctcctgaccctgccggccagaagcctttctcaggtttactctcaaacccgactcagctgttgagctgctctctcgttttgtcttccttctcatctctccctgtgctctaccagtagataggaaaaatacgtacctttatcatacctttaatatcttccaagtttattattgtagcatattaagggagatacttttcttctgaaaaaattttttatagaattcagtaccctctcttcagttggaacctggcttttttttaaccttaaggccaccctgcaattctggaaattcctattcagtgaaaagaccagttatataatttggtaacccccccaccttatttggatttggagggctgccttcttttcgccagcatatgtccctaggcaaatatgttcttttttttccaacaagaatgtgcgtgaagaaaaggtcctgacacctctgcttttaaaaggtttaatttaaagcaaaccctttggtaggttggctgggcaacaaataaaccttaacaccacaaaaacaaaaagcccccgt

SEQ ID NO: 18008 - DNA, 958 bp, Homo sapiens
  misc_feature (1)...(958): n = A,T,C or G
aggcgccgtgaggggacggggggctccgggtgtttgcgacgggtttttccgagtgctgttctcagtactgtgngaccacccaaacaaaatgcacgcaattccgtctcataatgtgagagaccacagcaacttctacaatttcccttcattacatatggacactttaataaaagaaattatttttaagtgaaaaacttaagcttattcctcaggttctaaaatttcaatcaactatggaagtgaaaatttcctgatattttctatgcatatgaatttagtcccactctctttggtttatacaaaaggatcttggatcagcttgttaaatcacagccttagaaattaagaattaatgttccagattagagaactaataggggctcatattgggggtttatttcgggagcaaagccataaaggcatttggcacaaaactgcccactcagggctaacttctacaagcgaggaacccacctctaattcctattgaaccccatggttctttcgcctcccgcccggggaatcaatcttaactccctaaggcgagagtcctcacacgtgggcccccctccaaattctgaagccccgaaaccaacaacgtgtttttttcccctcgaagacaagaaaaactacacgggctcgctggcgccccacaggggggaagcacgctggaccccactcgccccggaggcggggccgaattggggggggaggccccacacttgcaccggttgcgccctgctcgctttatcctggcgtctaacggctatgtaactataaccacacccgggggatatacgcgtctttcccccgcacctcccgggtaggcgcgtggggaacgaccgcatgcggggtaacgagggccacgagacaacgtgtagtatagctctaaacagagccccgcgcggggtgcagccgtcgcgaagaaggcgcccgcacgccccagatgccctcgccc

SEQ ID NO: 18009 - DNA, 523 bp, Homo sapiens
ctatttcactagtaagacatactgatgaagagaccaagaataaatgtgtgtgtttaacagcagtatttttaaaaatctgtctgccagtcagcaactcagcatgtattactgagcatccatatgtaagattctactctgggttctgagctgacaccactaattcccatcttctatatccagtaatgttctagcaaatgggatttcatgagcattgtttgtatgaatttcaaagtggaaggagtggggagaaaaaaaaaacggagacattgccaaaggggttttcctatttgcagctaaatgaaagacaaatgagctagggtacaccttaagaggctaaaaaatttgctttcagttcaggatagtgacaatacttatattattcagatgatggatgtatcttgtagtaaactttaaaaagatcagaacattaagattatattaatgacatattccaaaaattaaaagaatatagtgttcattctatcaacatataaatattgttttcacaagaaaaaaaaaaaaa

SEQ ID NO: 18010 - DNA, 391 bp, Homo sapiens
cgatttcattctaaaaacaaagaactatgcagtatcttgctagtatacctgtatttttgaaattttaatgcactcaggatgctttgcaaaagatagagagaacctgacaaattttcacggtatcctattaaagcttgtgaatagaaacatatcaagaaaatgctaacttggttgcacatgcttcccagctttgttaattcattccacattcttattgatacagatggtaaattataacaagaaatgaattcatggattgagttagcaatttaatctccatggcaacatgcaaaaattgagaaagtcattaaatatagcatttatagttcggggaataatttagttatctggaaattattagcatgattataaagtgacctttacaacatga

SEQ ID NO: 18011 - DNA, 498 bp, Homo sapiens
  misc_feature (1)...(498): n = A,T,C or G
cactattgcactcttaaagaaatgtgatgcatggtgtgtcacaactgcgattagagaagtccaagggnaaaagagtacaacatgctgatcaaccttggcagtccccacatacagcatgattatattgtaatactgtttgattcaatcgtatgtttgatcagtttcaagagatgaatatcacctcacttcaaacaatatgatacagtctcattgtatggaattatggctgctgtcaatcagcatatggcataacccttaaagtgccatctttggggaatgtcataaaaatgattgcaacacttgcattaattagtaagtttttgcactaaaaccaagcaaaacctgtcaagacaatgtatcttctatatctctgttcatttttgttatcataaaatcatgtatataacccatacatgcatacactcagctgattagctgaacttgttagaacagccatgctaataaaaatattgtgtgagccccacaaaaaaaaaaaaa

SEQ ID NO: 18012 - DNA, 710 bp, Homo sapiens
  misc_feature (1)...(710): n = A,T,C or G
caacaaggccctgtggngattgggnggtggnagggnaactcaccacanaatcacatgaatgccataaaaatcacttgaatcccanaggtcaggaattcagagatacttgaagacacccaagcaccgggttggattcaaagagtcagaggaatgaatcccatttttcgcacttactgtggggctggaggaagttacttacaaaagagggcccttgtcactaaaataggaataagactgatgccatagaagattaagagttgccaataagatactatgtcagcacagtgcttggcacagaagatgcactcagaaaatggcactcttaagtacacagtggtacctagagaccactcgtccagcctgaagcctgaggattgttcaggatgtggaatgatgagcatcatgcagcagcaggctgcttggaagaaaggctcttttaacctgatctctgtgtctaagatcacgggattcactttggagcctcccaaactggaagaaacagttttgctcacagcggttttgtatttcctagttatcattatgtacacctggttattctttctctgctttcaaaatcttcagagatctttggtttcctgttcccaatgtggatcctttcatcctcataccatctgagaaagtgatttctttttaatgctctaagaaaatggcaggggcaataaaacaaaagaagcaataagaaaaaaana

SEQ ID NO: 18013 - DNA, 595 bp, Homo sapiens
  misc_feature (1)...(595): n = A,T,C or G
ttcgggtgcttccgccctcacttggnctcccattctacgttttgagactgggactggctctccttgttcctcaagcttgcagacagcctattgtgggatcttgtgatcgtactctctgtggcccaggctggagtgcactggtgccatctcggctcactgcaacctctgcctcccgagttcaagtgattctcctgcctcagcctcccgagtagctgggactacacgtgcctgccaccacgcctggctaatttttgtattttcagtagagacgggggtttcaccatattggcccggctggtctcgaactcttgaccttgtgatccacccacctcagcctcccaaagtgctgggattacaggcattagtcaccgtgcctggcccatatctattctttggtaaaatttttattcaattatttttcctattttagaattgagttgtttacacacatatacattgtattttcctctggatacagatatgtcttttgcaaatattttcttccagcctagacctcatcatttcagtttttaaataatgtgttttttttttttaaataaagctttgtattagtccatcttcaaaaaaaaaaaaa

SEQ ID NO: 18014 - DNA, 442 bp, Homo sapiens
  misc_feature (1)...(442): n = A,T,C or G
cttccgggnctggtgctngttggtngaaagcggtttaacacataccacttngatgatttagaagaatgggctagaggataaaaagtttgtgccctgtacatacatgtgtgaaagtaactagttccagttgactatatgcctatagctcaagggagcagcctggactggaaacacagttttgtgtcttctataaatataaaagccattaaaaagaatgcagtcttcttgggaaaagatgagtagggaggaaaggtaatttaaaataattatgtggtgttatgatactactaaaatactattgaatgttcatcaaacctaaatgttctcattgaaatattacctgtcttgtatttttagattgtgcttttcttaaattcaatggattataaatattcatttctttagaaaaataaatgtgatccattcttcaaaaaaaaaaaaa

SEQ ID NO: 18015 - DNA, 425 bp, Homo sapiens
  misc_feature (1)...(425): n = A,T,C or G
tttcgctgggatcttgctctgtcgcccagctggnatgcagtggcgtgatctcggctcattgaaagctctgcctcccgggttcacgccattctcctggctcagcctcccgagtagctgggactacaggcacccaccaccacacccggctaatttttttgcatttttagtagagacggggtttcaccgtgttagccaggatgggctcgatctcctgacctcctgatccgcctgccttggcctcccgaagggctgggattacaggtgtgagccaccgcgcccggcccaaattcttattttttcatttacttcgggccctcattcttatttttcatttaatttgatgtattagactattgctttcatatgcatttccctgattactaataaattcatatgtcttttttaaaaaaagaaaaaaaaaaaaa

SEQ ID NO: 18016 - DNA, 738 bp, Homo sapiens
  misc_feature (1)...(738): n = A,T,C or G
tttttccgagacacaaatcttctttctgttacctggctggnatgcagtgtcgtggttatggctcactgaagccttgaactcccgggctcaggtatcttttcagcagcacctcactctactggtaccaatttattgtattatgctaatgaagacatacccgagactgggcaatttacaaaagaaagaggtttaatggacttacagttccacatgggtggggaggcctcacagtcatggtggaaggcaaggaggagcacatcacatcttatgtagatggtggcaggcaaagagagagaactcgtggaggggaattcctctttataaaaccatcatatcttgtgagacttattcatgagaagagcttgagaaaaacttgcccccatgatttaattactgcccactgggttcctcccacaacaggagggaattcaagatgagatttggatgggtacacagccaaaccatatcattatgcctacttttttgtcatagactgtgtggaccacaaagtctgaaatatgtactatctgaacttttatagaatataaactttactgtattattaatagcagtacaaatatgagaaacttttctcctaattattctgttgaaaataaattgtggaaaaaaaacttgaaatgctcaaaaggcactaagacattcgtgagggtatttgtggataattaaaaaaaatgcttataacagacaaaaaaagaaaaaatgacctcgttggcctca

SEQ ID NO: 18017 - DNA, 812 bp, Homo sapiens
  misc_feature (1)...(812): n = A,T,C or G
tttccancaagncctgtggtgattgggggtggngggnactcaccacanaatcactgnatgccataaaaatcactgatcccanagtcagggattcagagtacttgaagacacccaacaccgggttggattcaaagagtcagaggatgaatcccatttttcgcacttactgtggggctggaggaagttacttacaaaagagggcccttgtcactaaaataggaataagactgatgccataggaagattaagagttgccaataagatactatgtcagcacagtgcttgggacagaagatgcactcataaaaggcactcttaagtacacaggggtacctagagaccactcgtccagcctgaagcctgaagattgttcacgatgtggaatgatgagcatcatgcagcagcaggctgcttggaagaaaggctcttttaacctgatctctgtgtctaagaacacgggatttactttggagcctccccaactggaagaaacagttttgctcacaccggttttgttttttcctagtttcattatgtacacctgggttttcttttctttggtttcaaaatcttcccaacataccctgggcttccttgcgccccaagggggaccctttcatccctctccccacttgagaaaggggatccccttttacaggccctcaacaaaatgggggggggggttcttaccccacaggagccgtttcgctatggatatctattttaatggttcccccccttggttttacgtcgcgggagcctccttttggtggcactttccctctttaagagaggggctaattccttaccac

SEQ ID NO: 18018 - DNA, 1582 bp, Homo sapiens
  misc_feature (1)...(1582): n = A,T,C or G
gctaccacccgcaatttggagcnccccctntactnncttcccccccaccccgcgcgcccgggcccccccacccgaggtgagaatgactcgctctcgcgaacactgtgaggctgnctgggatagttccgaggaactgatgtgtcggcagtgtgctcggcgggtgagtgcgctgacgtcagcactggatcctaacaggccgcccaccgtgcgccgccatcccccaagcgcactcacctgccgttcagccacatgtcctagatgtcgcgagccccgcgcggatcgctagcgatcggcgcaccacccgccccccgcttcgccgcgccttgctccatcgcgccgttgcggtcctcgatcccgcatcgacgcagcacgacctcttcgccccacgcccctcggtgtgtgtggcatgtgtagcctccctgcgttcctccgtgcgttctcggcgcgctggcgtcgtgaagactagtcggcccacccacgcggacaccgtcacccgccgccgctcgcccgtccttcccgacactccagccgtntccgtcccttacgctcagacgatatgtgtatctatgtgaggtggtcggtgcgctggcgcgtcgtcggaggcgnatgcgacctggccgcgcagcctccccgcgccggtccgccctcgcccgattccgagccctcatcgccgaatcgtcgcccctcacgcccgcgcacacgcgaacctcacgccggcgacgaccgcatacgtagagacgcgatacggtactgtcccagccgcagnctaagctttcacgcgccatccgcgtctagcggcccgcgcgtcctctaatttgctttccgctcgagtctctcaccctccgcgcccagctcgatggcgtacggacgccgtccgggcgcgccctacgcactacgtctcttccctccgatcgcggccgccggcccgcgaccgatcgtgtttcagaggtagtgattctcgcgcgctccgaccccgtgccacgtccggcacacgcacgcatccgcgattcgctccggccacgccgccccgccgagagcgcacatcccgcgctcgccatcgaccctgcccgcggctcagcnatcgcgcttgatcggtgatgtggcgacgagcggacacgtgcgcgtcgcgcgggccgcgttgcgttgtcgggatcccgactancacgagtgcggacactgtgtgttatcgcgcgcacacgcgncatacgcccttcntgcttcactgacgcactcgccacgtcaaccgacgttaccctntgtgtgtgcggctcacgtgagtcgagtcgctcaggcactcgcccctccaacctgcactcgccgctctgccgccaactcaccgactcgatccgcgagcgtgacgcgacggcaccggctggccgcgtgcgcgncgtgttaantgagtatcgcccgtgntcgatcacagcgtccgtgcaccacacctctccacgctcgccccgacgcactccgcaccactccgccgcatagctcacacgctcccacgcgccgcccgcgccgcccgcgcagcgcangtgacntcccgacggcgcntcgtctcgcacgacgcgtacgcactgtccaaccg

SEQ ID NO: 18019 - DNA, 423 bp, Homo sapiens
  misc_feature (1)...(423): n = A,T,C or G
ccgtatggcaaaacatggcacattaacaagaatattatagaaaactacattctgaggaaaccacgtttgttgtcttgcttcttgaggaagaaacctaaacattatctacctaaaagacggatcatccatcttgtcatccatctgcaaagatattttttgaaaacatttccactgacagcttactttattttgccaatccacttaaagagacagcaccaaagttgtttttaaaaaaatcaagttgctgcaactcaaagagcttggagaattttctagcctagtatctaaatagtttatttgattacaagatgccccatgcttgctatatttctaaagaactaattcataagcatatgtaatcttcccgtagcaataaaaatctaataaattttattatctacatatttgcnaaaaaaaaaaaaa

SEQ ID NO: 18020 - DNA, 621 bp, Homo sapiens
  misc_feature (1)...(621): n = A,T,C or G
cagggaaaggtgacattcaaggactagctgttatcttcaccaagnaagagctggcagtattggataaagcccagataaacctgtaccaagaacgtgatgctggaaaacttcaggaacttcatctcagtggggtcttgctctgtcacccaggtggctggagtacagtggcctgatcgtggctcgctgctgaagccttgaactgctgggctcaagtgatcctcctgcctcagcctcctgagtagttgggactacaggcatataccaccactttcagctaatgttttcttttaaaaatttacttgtagagatggggtcttgctttgttgcccaggttagttttattctggtttcaagcaatcctcctacctcagcttcccaaagtgcagggattacaagtgtgggccactgcactcagcccacaatgtcttttattttttcttcaaaaacaatgtccttttctgttttaattgacttataagtttcttcatttggatcatggtttattcctagtttttcttgcattatattttcctgccagttatagtttgtaaacagaacagccattcaagtgcaaataaaaccatccctgaagtgtcattttcttactgaaaaaaaaaaaaa

SEQ ID NO: 18021 - DNA, 858 bp, Homo sapiens
  misc_feature (1)...(858): n = A,T,C or G
tttccatgcttnccttgntttctaggnaaactggctagccatagcanaagatgaaacagaccccttcttttcaccataaacgagagtcaactcaagatggattaaagacttaaatgttaggctccaaactataaaaatcctagaagaaaacctaggaagtaccattctggacatgggccttggaagagatttcatgataaagtcaccaaaagcaattgcaacaaaaacaaaaattgacaaataggaccaagctaatctaaagatcttctgcactgtaaaaaaaataaaaataaaaataaaataaatcaacagaataaacagacaacgtacaaaatgagagaaaatattttcaaactatcctacaaaggtgtaatatccagaatctataagaaacttaaattaatgagcaaaaaatgaacaactttaataaaaagtgggcaaaaggacatgaacagtcacttctaaaaagaagacatacacgtggacaataggcatatgaaaaaatgctcatcatcacaaatcatcagagaaatgcaaatcaaaaccacaatgagatactacctcatactagtcagaatagttattgttaaaagtcaaaaaataacagatactggtgaggttgtagagaaaagagaacacttatacactgctgatgggaatgtaaactagttcaaccactgtgaagcaatttggagatttctcaaagagcttaaaacagaactacaattcaacccaacaatcccatccctgggtatatgccccaaaaaaataaatcattctgccataaagacacatgcccacctatgttcatggaagccctatttacaatagcacagaactaggatcaacgctaatgcg

SEQ ID NO: 18022 - DNA, 955 bp, Homo sapiens
  misc_feature (1)...(955): n = A,T,C or G
ggtgctttttgtccaagttccggngcgggcccgtctcttnnnnnggacgtccggagccacagtcccactttctgctcactttgggaactctgtgaagcagggtgcctcctttttgtccctccaatagacagttgggggacttggcctctggccgcctcaagttgggtcaccacctgctgggcctcatcctggttcatcgtgcatcaatgggagcgcacctgggttctgctgacatgtgagagcttcttcaccgaggggttcagaaaagtgtgctcatgggctgaatatctggattcatcatggagatgataaaaataagaactgagcccgtggcttggctcacccacttcctgagcctgcgcaggggacaagactatgctgcgtggccttcttacggctgtccccagggaagtggcctcattctctgaggctggcctgcccagcgcccccactctcctgtgctggacccatgccattccttagcctgagagcataactgcagactccaaaatgttgtgtgatatgcccaggaaccgaaggattactacgtgggggttggccgcgtcctgattggggccaaacaaagatatccgcctgtcatcagggctgccttggaggacagcgtgcactttagcggtgagtcgctacaaccctccgtattcttacaccttgagtacatactcacccacgccccctgctatgatcattggtgttggctaccacgccgctaccatgcttcccacagcgaacattatagtttgcctgtctattgtgaaccgtaatacgaggaccatacgtgtgcttttgggtccacatcccgctactgccgcagatggatattgagaggattgggtcttttgaagacctaacaccacggatttttttctggccccctcccaacgtggtttggttaaacattcaaaaccattcgcaagtaccgcgtgctcgcggcgac

SEQ ID NO: 18023 - DNA, 428 bp, Homo sapiens
  misc_feature (1)...(428): n = A,T,C or G
ggttccgagcaacctncacccaattctacccttattacttcatagcaatgaactgtccctggnatttattaagcatctcactagttccttttcttcagctgtatggcaccctgtcttcctgtacaccagaggctcctcagctgggtaaggtgagccaacgttaccaggagtatatgctgagaggccatttcaaagtctttcatagaaggctgtgcttgggcaagtagaacttttcatcatacagtcccagagatgtgaagttatcaaggtcagagaagaggaaaagagattcagagaaactgtgttctctagtctttcattcgggaacaaatggtgtcgtaccaaatggctgaaaagatcccaggcttactctgagaaacatctctctcttctgaattaaacttgcacagtggctaaaaaaaaaaaaa

SEQ ID NO: 18024 - DNA, 435 bp, Homo sapiens
  misc_feature (1)...(435): n = A,T,C or G
ttccgggagacccatgnaaccctgtgtggcagtgnaaagnagtgnaaccctggnaaagctgcagtcatcgggcttctctctccagaaggaaatctgtacctggagttgcaaagtcagagaaactatggagaaacagagccactaagttacatccactctgtcgaatatcctaatcctggacgtctaattatgtgaatcaactaatttccttcttcatcaggacatcaagtcaatccttggctgttttataccctaatatatagtgagatattttctttcaatgatgtaattcatatttgaacattttcactgtagcaaaaagaatctgtccagaattgttttaagaggaagatgatattcatgataaggagtgaattactagaacaagaaattataatttgataaataaaagttttcaaccgaaaaaaaaaaaaa

SEQ ID NO: 18025 - DNA, 252 bp, Homo sapiens
  misc_feature (1)...(252): n = A,T,C or G
cactaaaaaagattanaaaaattcccttcttgatgctgtttttgaagtgcctttagctcaaaagaatcctgatcccacagtggtctatttttggatggtatattctgcaaacaacaccccctttttgtctccaatctctccttaattactcctctaatacaaaacaatagattcttaatataatattaaaatgtttgcactactcacaaatacaaaatgctcaataaattttctttcacaaaaaaaaaaaaa

SEQ ID NO: 18026 - DNA, 383 bp, Homo sapiens
  misc_feature (1)...(383): n = A,T,C or G
gttccaacctttctctctctgccgcctgtgnaaaaaggagtgnntttgcttccccnttccaccatgnannntaggacttgctcagnaacaaggggaagaagatgactatgcagctgctcggtaacagcgtctagtcacactctgagatactgaggtcagcaagaacagaggatgcacactatgtcccatcttgcctttctgcccagaaagtctcagttactggaaaagcttcagaaatatttaccaaaaaatccatttgaaatcctgaaattctacttctcagaaaacagtattactcttgtctagaaataacattcaggcctcaaagtgctatactgtcattacttctaaaaataaactgagcaaatccaaaaaaaaaaaaa

SEQ ID NO: 18027 - DNA, 844 bp, Homo sapiens
  misc_feature (1)...(844): n = A,T,C or G
cataacttatctggnttcactgactgcaggggnaaagtttacttccanaaaatatgccaggagcaacttcttatttcctcatttctagcatgtacttttctgcaaatacgtcaacatgtctgaaatcaggatgtgaaaatgattcatatatttaatgcaatagtgtttttccccttaaatgctgttattaaattgatggggtaatcatacagcatcttaaaattgaagagctatatttttttttcagatgataaatgcctttgaaactttcaagttagccatttaaagggacgtgggtctagaaaataattttttttatttgttttcggagtttcactcttgttgtccaggctggggtgcaacggcatgatctcggctcaccgcaacctctgcctcccgggttcatgcgattctcctgcctcagcctcccgagtagctgggattacaggcatgcgccaccacaccaagctaattttgtatttttagtagagacagggtttctccatgttggtcaggctggtctcgaaccctcaacctcagatgacccgcctgcctcccaaagtgctaggattacaggntgtgagcctctgtgcctggcctagaaaataattcttaaatgcttctccaacatgtttctgacctgggctccacctttgatgtatgggttctctacccataatgccactgggatataagagcacagccaagacagccaatagcgtgggtcctttacctctngagattaaatcccttaagatcagctatggcctatgctgcagatccaacattccttgctggaatttgctacaacagaaccgaacccgtctgaagcaagtgttatttg

SEQ ID NO: 18028 - DNA, 564 bp, Homo sapiens
  misc_feature (1)...(564): n = A,T,C or G
ccaggcggnaagcaccatctgtggnaagtgtgtcgtggaaccaaaggcttgtccgcctcttttacctggatgagcaccggacacgcctccgatggcgaccctctagaagacgagaaggcaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatatcctttctagaactttattttcagctctctcttgctctctgtgtatgcgtgtgtgcatttgtgaagtaaggattagactatgttttaatttttcccataattttcctttctctttctttacccctcacaccgtcttctcccctcctgactctcactccaaataaatgaacgcatgaaantgcaaaaaaaaaaaaa

SEQ ID NO: 18029 - DNA, 381 bp, Homo sapiens
  misc_feature (1)...(381): n = A,T,C or G
ttcgatttctgctacttgttgggaatgcatctgnanaagganaaataggtatacagaagcaagggaatgctggcctagcatgaagatgggccacatcatgcccagctaccaaggggaagaacaggcttcatcacaagatctccaagcatccatgatttgacttgtatcatcttatacattcttactatgtattatgtgattttataggaaatataatataaatcaatatataacttcatattcatgttaatatatagctatgtctttatccaaactaaaatataaattatacctttagacattccaaaagatttaatagagttgggagaaaataaatagctaataaataaatactagtcttcattttcaaaaaaaaaaaaa

SEQ ID NO: 18030 - DNA, 443 bp, Homo sapiens
tttccggggagactttgctttaggtgtgagtcacctttgcctgcctcttaaaaatctgcttacatcattttcactgaagctcctctgtccaaagcaaaagcaagacaccttacctaaccaagtccaaggtcaatgaagcatggaattatactctgcctgaaccttgaagaagaagggaatgaatatttgctgaataggagtttaatccttcacagtgctgaagctcagagtggagaacattttcaacagcataactcagaagagttgtcttttatctgaaacttgttctaactataatgaagatgcctgagaaatcccaaattgtttttttttttcattgctcttcccaaaatatccttctttaatttttaatgagatcaaaaagcgttttgcattattaaccaataaaatccaagagtgtttttaaggcaaaaaaaaaaaaa

SEQ ID NO: 18031 - DNA, 1033 bp, Homo sapiens
  misc_feature (1)...(1033): n = A,T,C or G
gggggggcgactggccgcggggtggtttttaaaagntttcggagtggccttctnctttgttcttcttcaaatgnaagcctcttctgtgngcctnanatttggntacctgnnagatcctggnacagnatgntttncttnctnccttcttacaactgtncacacttgnaagaactaaactgtggaaggaaggaccctcgctttctaagcttgctcgcaaaaacactccctccttttttaaaaagtatttgttcctgggagcctggaattagaaccaaattttttttccgggcttttttctttttttaagtaccccttttatttggggaaatggtttttcaaaattttggggccccccccggggttttttccatcccacctttttttttttttttttnntttttttttttaccccccaaccctgggggtttttggggggaattttccccccttttgagggggccacaaaataaaataattttttcttcttaaaaancccccccccccttgtgggggccccccccctttttcttccctttataacccccccccccttttttttttaaaccacattatatattggggggttgttttcttttttttataaaaaacacccccgggggtgttttttttttttctcttcctccccanaaaaaaattttttgaaaaaaaaaaccccccccccccggggggggttttataaaaaaaacccctctctcccccccccaaaaaaaaataaaatatgggggggggggggttgttttttctcaaaaacaacaaaccacactcttttttttttgtgtggggaggggggagaaaagaataaaaaaaataaaaaatatagtgnttcgtttttttgtcctccccctccccnngggggagggggaggttaatttatccccnccccgccccctcctcctttttttttttgtggggggggggggggaagggaaaaaaaaataaaatatnnctccctctaccctaacttacccncccccttctncnnncgnngngngggtcgaggggtggggggggg

SEQ ID NO: 18032 - DNA, 804 bp, Homo sapiens
  misc_feature (1)...(804): n = A,T,C or G
cggttaatatttgggggaacctcccactaanacttcaaaaatgcaaccttatccactgaacccagccttgcctcaagcaggctgattgacccatgaatggacagacacagtcatgatggggccacgcataagcaggagaggaaaatggctcgtggaagactcaagcagggacaggaccagtataccagcccacaccccctccataccctagcctggagcctggaacctggcatgttgttggtcctcagaatggatggaacataccagaaagcctctatgtcagacactccagtctggatgttacacggtttgaaaccccaaagaaaggaaatcagattggaagcccctgtgggcagggagctgtttcagagcaccaaacacatggccttctgcataagctatgcccagaggacccatggaattagatgtgctaccctctttcttaggtgacagcacccattctaccatttaatgtcttcattgcagagtgtgtgtggggcccaaggaatctcttgagaaggtagaaaagctggcagttctgatggctcaattacacttgaacatttaggtaccatcactctggacatgactggagcgtgtaaatttgtggcccactggctcactacagaacttttgtgacatcgcttctttccccatggtcctgtcttaccccttcctttattttattcaacttagcactgatggccgtagcagggcctctagaattagtcataatataaaaggggaaaggggaaatctggactttttttctcctcatctttccaccattttttatttccttgg

SEQ ID NO: 18033 - DNA, 401 bp, Homo sapiens
  misc_feature (1)...(401): n = A,T,C or G
ggtgcgacaaaaaccctcctttcacccagctggnatgcatggtacaatcgcagctcacggcaaccttcgccccccaaattcaagcgattctcctgcctcagcctcccgagtagctggaattacagtcacatgccaccacgcccggctaattttttgtatctttagtagagacggggtttcaccacgttggccaggctggtctcaaactcatgacctcgtgatctgcccacctcggcctcccaaagtgctgaaactacaggtgtgagccaccgcatccagctattgtctcctttttattctttatataaactgaaacatacacaatgttttgctgtatgactgacttccttaactcaatattatgtattaaaatatatgtgaaagcttgaaaaaaaaaaaaa

SEQ ID NO: 18034 - DNA, 879 bp, Homo sapiens
ccaggtcgatgtcagcacctgtgcagcttatttatgtacacataccaatggtgccgatataacaatagaacataacttgccgaatgggaagggtgaggccacttgttctgattgtgcaacacattggagttttaccgtgcttcccaggctggtcttgtagctgttgaggctaaccgcatccacgtacctcagctcccaagagctgaaatacaggcatgatccaccgcacctggcctcatttgtaattcttaacatccattatacttacttcttttcccttaatttagttttattattactctacatagtggtagttttggtccttcttttgaggaactgtcatatctttcatttataaggggacttcactacttctctaattgctataataaatattattcacatcctagattatcttacattatctttagtctttttatcagcggttacagagcttccgatgttttgtctgagctctgtggtaatttttatatttgatttccctaactgactgctttccatatttgggctttaaattaggcgttccatgatagtatggcatctctgaactacatgatcatgatttgacactcaaagaaatatgacctcataccctcatggttattgaataccgcctttatttcatacttagcactttccttatggctctcactagaaaaaaaacagaatgtttccggtgggacttagccgctgtatctctcctggggaattgcctttgatttggcggtaaattcaccgagcctggccttactgacttcggtgcggttgggtccgttccgactggggcgagaggggatcaaactccctcatagggcggtgatcccggtgctcccatgcagtgagggtataacttgtgga

SEQ ID NO: 18035 - DNA, 665 bp, Homo sapiens
ttccggcattttccctgaaacttattatcctcataacatctgagagaataaagagaaagaaactgagaaatggaaagtttaggtaacttatacagattgcacaaccaatggagtttcgccatgcttcccaggctgatcttgaactcttgggctcaagtgatccactcacctcagtctcccaaagtgctgagattacaggcatgagccaccgcacctggccacattaataattcttaacatccattatacttacttcttttcccttaatttagttttattattctctacatagtgttagttttggtacttcttttcaggaactgtcatatctttcatagataattttacttcactacttctctaattgctataataaatattattcacatcctagattatcttacattatctttagtctttttatcagcggttagagagcttcggatgttttttctgagttctgtggtattttttatctttgttttccctaactgactgctttcgatttttggtatttaaattatttgttccatgattttatggtatttctgaatttcatgattatgtttgaaactcaaagaattctgatctcatatttttatcttattgatttctgcatttattttataaatacacttttcttatgtctctcaaaaaaaaaaaaa

SEQ ID NO: 18036 - DNA, 740 bp, Homo sapiens
  misc_feature (1)...(740): n = A,T,C or G
tttcagaggccttgctgtgtcatccagctggnatgcagtggtgccatcacagctcactgtagccctgaactcctgggctcaagcaatcctcccgcctcagtctactgagtagctgggactacagctgcgagccaccaggaatggctgatctttccgtagagatcgggatcttgcttcgtcactcaggctggtcttgaactcctggcctcaagcaatcctcctacctcagcctccccaagtttgggattacagggatgagccagtatgcctggccctttctgtccttttctgaattttaagtttgtacctactcttctctcttgatgctagctaatggaaatctgatatttagacacttctaattgctgttttcttaaaataaaaaaaaaccagcaatatcaaaaggggaaaatgtcccctcttccctaaagctgcagaaaagcaaatagaattctattctatatcataaaactgggtttaaaaatattatttcaagtaaaatagtcttcctggacgcctggatttcagtgttgctatattctgtgaaaaataacgtaagtttaaagtctataattctgattagttgtctgaataatttgttgtcttgttaataatatttaaaataacattctgattcctgaaagttgcctttgcaaatttatttgttaaactgagaaaaaaagattcatggcacaacccctttcttgcaaatatatggtcacacacgaaaaaaaaaaaaa

SEQ ID NO: 18037 - DNA, 733 bp, Homo sapiens
  misc_feature (1)...(733): n = A,T,C or G
tttccggganaactgcctactcatgttgcaaggatactcagcctgtggagagcccacttgggaaaacgaggcctcctattgagggcgcgcaccaacttgccagccacaagagtgaacccccttcaaagcagatcctccagctccagccaagcattcagatgactgcagacctggctgacttcttgattaccacctcaagagagaccccacatcagaaatacccagctaagccactctcaaattcccaacccacagaaactgtgaggataatacatgtttattgttgttttaagccaccaagttttaaggtaatttgttacacacaatcaataactaatccagagggtatttctcatcccaatgctgcttcctcaaggaagaaatggtccgatatcaagaccaagacaactaaaactgtcatattcttgaccaagcaacttctgttataagaatctatcttatacaaatatatttaaaatgtaaacacacacacaaatgtgcaaaatgcttgtataaatgtgttcattacagcatcctctgtaatagtaaaaacagaaagcaattaacgttttcattaatagagctcaattatataaactatggagaaaatggaataattctatgtaagcgctaaaaattgaattaataataaaaaataaaattctatgtaagcattaaaaaaattgaaataataatgaaaaaataaaattcctgctctccaaaaaaaaaaaaa

SEQ ID NO: 18038 - DNA, 837 bp, Homo sapiens
  misc_feature (1)...(837): n = A,T,C or G
ccaggccaacaacaaaggtatattttcatccgcctccatttctctcatctatgataatgattcctggactcactgctatatatacagatccagtaccttggattctactacagatgccgatagttctctatgctcttcctctggtttctatagtgaatgatggtttttagagttatactctttcttatattttcaggattatcatttacttctttgttttgtagtatttttaagcataaacacaatcctgtgctctaaagacttagtgttttctaggagaccaataaataaaagcctttggttttatttacaatttaattgagtgattgttgggtttaaataactaaagtaagaaggcattaataaacataatttccattccaatatattttactcctagaatttttcttgctatattttctcaaatccatccatataagcccatcaccacaatgatccagcccaccattacaaacccacctagactcaaacattttctttccatagaaaatgttgtttcattgagcacgtgcttcttacagcaccaaataatccgactcttcctaactcctgattcctattacctactttattctatctccaatacttctaccagtttttcaaatatgccatgcagtgttattcctttggaccaggatatttctcttgtttaaatatttttccccctcctcccacttttcctcacaatatacacattgcctagccaactactcatatcttacataaaaagatattttcagtgntctgtgcttttcttgcattgctangaaaaataaaatgctttccctatttaaattcctataaggcttgtggata

SEQ ID NO: 18039 - DNA, 357 bp, Homo sapiens
  misc_feature (1)...(357): n = A,T,C or G
caggtccccagncatcaggnatcaccttttctgggncactcaccagcacagcctcactgcactcttattcctccaggactttctccaagggaacttgtcacctgcccttcggccctgcactattaggagagtaattcagtcatccagcctaattttcttattttatcacggcatcctgtaaactgaaggctctccagctacaagaatgtatcctcagagagcaatgagggctacaaccaacaatcattctgttacataaacaaaaaattctttattaaactaccagtactgacatttccccccaaaccatctttgccttataaataaatcaaaatgtaaaatggaaaaaaaaaaaaa

SEQ ID NO: 18040 - DNA, 489 bp, Homo sapiens
  misc_feature (1)...(489): n = A,T,C or G
ttccactaaaagtactatttnatanaanagacgttcctgaagacttccgtgagaacagatgtggaggtggaagacagtgatattgatgatcccgtccctggattcaacatgacttatttgaaagtatccagttaactcatttacagatgaaaatgtggatgatgataaagaaaccactcaattcaaagagaaagttttcaagtacccagttcactttgttcctgaatatatacagcagttagcttaataaataaagaatcattgcttttttatctgggacatttttctgagtcatgggtacaaagccacataaacgtagataataacagaaatagtctattttctttcatgttaaaatcactagtctccccacacaatgtacctataattaattgttattattaatatacttcgccaacattatctgtttagaaaaacattgtgaatctgtgtaaaaaaagattgtctttggccctaaaaaaaaaaaaa

SEQ ID NO: 18041 - DNA, 869 bp, Homo sapiens
  misc_feature (1)...(869): n = A,T,C or G
ttttcggactgctgtttgcttgtgatctctttgggaaaaatatataagcgttccttattctcctggaacagcaaactcaggacaggatacacagcatgctaagagaacaagacaaactccatcttggctctttcactggcagcctcttcctcaaggacttaacttgtgcaagctgactcccagcacatccaagaatgcaattaacggataagatactgtggcgagctatatccgcagtgcccaagaattcgtctgattgataacgcccaaagccctgtgtctatcaccttgtaatagtcttaaagcccctgcacctggaactgtttactttcctgtaaccatttatccttttacctttttgactacttaacttctgtaaaattgttttaactagaccccccgccccccttcctaaaccaagatgtaaaagttaatcaagcccctttcttggggccaaattttgagcgttagccgtctctcggtcgctggctaataaaggacttttaattcaaaaaaaacaaacaagccaccaacgacaaaaacgcaacaacaagctcacccaacagaaaaaaaaaaagccgaacattcccccaatagaagaaanctgggctcccgttgccctaacgggagagtttttggggcctcttccttttgggggggggtatcaagaaacctcctgcaatggaccagggggcctaacgccccccagggggcggagagcggtattaactcataccaaagggcggaacacggggctaaccccccgttcccgggtaagacccccgggaaaaacacctccagaacaagaggcccgtaaaaagcgccccgtatccgtacaagcggcccgcctcggggcgctcctcctaaag

SEQ ID NO: 18042 - DNA, 825 bp, Homo sapiens
tttccgagtaaatgctactgtattgcctcccctccctaatgtgaacctttgtaaacataggggcttggtcaaggcatcttccagctacaagaggactgaaaagtggaggccacacttagaaagcagatgggaggaatgtaaaaagagaatccaagctattgtattcagaccttaatcaagcaatattagccacacagactcaggatactgaattgggccacacaagaaaatccagaagtagaagatacagttgcctctgtcttcccagagtttatgttcaagtggaaaaggaaaagaataggattactcacaccgggggaagcagctggcaagctctgagcagccttatgaaagacaagaaactgaaaccatcagtcccacaccccatgaggaacagaagtctggcaacactcatgtgagtgagcttaaaattggactcttcaaccttgaccaaattttaagatgtctgatgcgatggtctggctgaaacattaactgcagcctcccagacccaccctaaaagctatcccaacatatttattctaatcaactctttgtgtctcgctgatcctgcatccttcctgggtatctctacagcaatgcaacaaccctgacgtgcaattaactaacgactactaaccctcaccacttttacaaactcggctcatggctccttcctaccccctcatagatcgcaactgttttttacttccccccagctccccctgccccgtccccgcgccctcactgttagatcccgcaacaacctacacaggatggtccctcatacctcgttcccgtcacgccgtgcgccctcctctgcct

SEQ ID NO: 18043 - DNA, 851 bp, Homo sapiens
  misc_feature (1)...(851): n = A,T,C or G
ttccgtnattcgtacctggatagcaagataccacgatttgcatctactgtataatatgtactatggctttgcaggaaggtgctggcatctgcttctgatgaggccttgggaagcttacaaacatgacagaagttgaaatgagagcccacacatcacatggcaagagcaggatcaagagaaagaggaggtggtgccacacacttttaaacaaccagatcgcaggagaactcactcactataatgaggatagcaccaagcaattcatgagggatgaggcatctgcccccatgacccaaacacttcctaccaggccacacctccaacactggggattacatttcaacatgagatttggagaggacaaacatccaaactatatcagaaatcttcttgcaaaggtagtctataaagatataacatttatgctattatataaattgaataaaatatttaccaattgataagattttcaattaattttaaccctttatctaataatggaaataaattatttcattaacttttttgtttacttttctttttattactttgaaattgcccttatgcattttattcatgtctgtggcagcgtgttctagattttaaatctctacgataggcttagttttgcttcatctcttgaatcaagcaaagatacctggggaaataatataaggctggtgataaacaaagcttttatttaaaaacctttatgttcatgcatctgggttgtgacaacatgaattcatatgcctcggagccgaggaatcccccgaaggccaccacacgaggttaaaccatcacaatagtttggatctacccggcgggcacgtatccacacatgggattgg

SEQ ID NO: 18044 - DNA, 389 bp, Homo sapiens
  misc_feature (1)...(389): n = A,T,C or G
gttttccggggtggattatctaggcaantatgtngcgcatnancagcaacagagaatactccttgtgacgaaatgtgggaacgagcagtactgtcactactgctcttattcatgactgtccatattgcctttgatgatatctctgctttaagatgagtttgccccatgcatcaccaattgtcttttgatatcaccctgattggaagactgggctaatccatatgtcactatgaaacttcaggcctttctgtttgacaagtagcaagcctgacagccatctattgaaaatgcatttcagacagcaatctattgacaatgcattttaggctatcattgttccaacctaatttactcttaataaaatgactttgaagacaaaaaaaaaaaaa

SEQ ID NO: 18045 - DNA, 308 bp, Homo sapiens
  misc_feature (1)...(308): n = A,T,C or G
tttccggtnagaaatgcacactccacccatgtgactacttcaaaagttgttgttatggatcagagacgagtatgaagtcctagggaaaactgcaaagcattgtgtgagcatttctcaaatacttttccactgactcctaagatcctacaaaatggcaatgggtgttctgtggggaaattatgggttccacaatcctcccatccactcaaaaaaaaagtaggaaatcctgcataccttatatgcttcgttgagcttcacaggacctatttgcatattaaagtcattcagtgttttcaaaaaaaaaaaaa

SEQ ID NO: 18046 - DNA, 846 bp, Homo sapiens
  misc_feature (1)...(846): n = A,T,C or G
ttccagtnaactaagcatatccggcatagtgttgaaaagaagtggtngaagnaggacatacttgcctttttcttgatttcagaaggaaagcttctaatttctcactattaggtttttgcagttgttgttatttaaacctcaatctaaaaatctagtttaagaagtgggaatgtttgtgatacacgtgaataaaccaaggggaagaactcagaagttacatcatccatgaagggtgaaaatgtgatgaactttcactgctccaaagcactatagatctcattctatcatcccagctggagtgcagtggcatgagttcggctaactgcagtcttgacctcctgggctccagtgatcctccgacttcagcctcctgagtagctgggactacaggcacccaccaccacgcccggatctattattcctgctgagagaatctactaaagaagaatttttcatagtgacagcaactctaggcttgctgtgaataatcacaatgtcataaaaatcattctttttattgcaaacttgctgccagaagcatggaaaaatattcagaccgagagaactttcatccttttctgcaacggctttcttttaactttcatggccatttgcagaaagtgaatcgcataccaatttattcacaaagcatttaactagagcctttatttgcacacaaatatttgtttcgctcatataaaacaatgaactataagctccaatatttaaatcggccatacattatctttttttcctggaagcatttccgacctcctcctaaaatcttttggaacaaataatagatttctgggttaagggccttacattgcgtatagaattctcctt

SEQ ID NO: 18047 - DNA, 860 bp, Homo sapiens
cgggtcataagcgacagtaacacaagcagcagcaacgtttgatggaagaaaagaaagaaaagcaggaagaaaagaaaaagaaggaaggtgctcagaaaaggctgctgatcaaaaaaccaaagattggtttctgatactaaattggcctctagagttgggcagaaagactcatcgctacaggttgtctacatgcctcagtcattgcccttctatgtgtgtagttacttgtaaatagtaatatcagaaaatatgcactttcaaatagaatcacattttatctagcttttagcataaccaaagattacattaataaatgaactaaatattaatcacattttgctacctagagatggcttgttaattcattaattaacttaaaccgtttattaatacctgctagatggcaaagaacacgttccttggttcaaaaaaagaaactaccgaacctgggttcctcctttaggtggaaggcggaaagaagggacaacccctctcccatcttgacctgtccctgccccactaacgacacaggccacacgcgcccttctccgtccgtcgcatctcgtatgccccgcgaaagaccggcccatgacgtttaccagggcccaccccctacccgatcccatctcctacgcacttctcattaccccctccattaatcgttcaccccggcgtacacccgcgcgcgccgccccactacgttcacctcgcatctcattcctcgaacactccgcattcgacctataccactccccacgtctcatgctagactcctgttcgcgtcgtccatcgatccaccggggtgaccttcacctcactgaccgtcgccccgcgcgacgttaacgcaccacaactgtact

SEQ ID NO: 18048 - DNA, 830 bp, Homo sapiens
  misc_feature (1)...(830): n = A,T,C or G
tttccaggaatatggactggccacaacaaaacttggctcccgtntaagggaaaaaggaaaaactgcatacacantttaagccgaaaactcattaccagaagaaaattagaagcgatgagaactgcaaatccttctttattgcttctctaattttttcaaaacaaaacttaactactgtaacgaaactattcagggaatagttttatgattaaagaaaaaaaagtgttgcgcatttactttatcttagtcctatatcaagcagacacagtaagagagagaaaacaaaggcatctgtgaaatgaacttttttcttattctctaaatggctagatgttccttttgtaaaagtaagatttgaatttaccttttcatcccaatctcccagtccctttcaccaactcttcttttcctgcaaaggcactagttctaaaataagtcaatgaatttttctgctgccattcttttaatttatgtctaaaaagttctgggaaacaatatatggaaagaaatttaattgctagtgaacagaaatgaaaattataaatggtacactttataatatattgcttaaaaaagggaattttctaaaaacggggtcaaaaaaaagcccccaacttttcttatccctatttcccaccctcttttaaaaaaagatgttaaattgtgagggtcttcggcgccaccctcactactttttacaaacaagtgcattccctcccaaataaaacacacccgcctctttttaaagctttccgcagagaccggcaccaccccacccgggagcatggcgttccaccctttatctttaaaactttattcacactcaaaag

SEQ ID NO: 18049 - DNA, 846 bp, Homo sapiens
  misc_feature (1)...(846): n = A,T,C or G
cgctatgtactggnatcaaaactttgctccacataaaaggaagagacacttgatgaagaaagcagttccatggataatccaagagagctatttaccatccaagttaccttttcttcattaaccgaattttttaaaagataaatctcagatgggtacataaaccaaagacaattgctgcctcgtgttacctagacaaagcggaggggcaagaaacaagtcccacgttttcactttcacttttcatttaagtatttggcaagttggttcactggtgaagactcagagagaaatataaggaagaaacaaagtggtctataaaaatattgtcacttcatcatctcaaaatatttcctgcaacctctgcaactctctgaggaagcaagtcaattctactagtttcccaggcatgaggcatgctgcatgaaaaatctctacccaagtaaagaaaatggcccattggttcacatattcatgtgataaattgcactgttaatatgaatattaaactttagatagatagatacagatacagatagacggataacatctctctttacataaaacacacttgacattgcgtattatcatgtaactcctctccaattttagattacactatcgtattatagtggtgaataatttttaagtcaaatagaaaaatacctgaatctgccccacatctatattaagcaaatgatcattccatggagggaaaagtaccaacgcctggaatgcctttggcagaccgagagtctcattggtgggtagctcgctccccggctggcattgcggggaaaaatgacactaagagtggccggtcgcgtgtgaacaaaacaaaaggcacag

SEQ ID NO: 18050 - DNA, 844 bp, Homo sapiens
cgctatcttaaaaatctaccagctgggcacatggctcatgcctgtaatcccagcactttgggaggccaagcgggtggattgcctgagttcaggagttagagactagtctagccaacatggtgaaaccctctctactaaaaatattttaaaaactagccaggtgtggtgacgtgcacctgtaatcccagctactcgggaggctgaggcaggggaactgcttgaaccagggaggcggagcttgcagtgagccgagaccacgccactgtactccagcctgggctacagagcaagactccgtctcaaaacaacaacaacaacaacaacaacaacaagaattctaccagtacaccggtaaagaaattcaattgtaatttttttgtagcaacaagaatactcaaagaaattcaattctgtaagtcagaaaattaaagtatcttaaatactttgttataattcatacaacttaagcatatatccctaaatattatggtttagttttacctttatctataaaggaataaccctgtatgcattttatttttggcgtgcatttggatttttgcttaacatcatattgtcagactcatcttatgttcttgcaagtaaaggcagcttattcattttcatataggtttggctctgcgtccccacccaaatgtcatcttgtagctcccctaattcccatgtgttgtgggacagaccccgggggagatgactgaatcatgggtgccggtctttcctgggctgctcttgcgacagggaatagggctttatgagcaccgacggttctaaaaacggcagttctcttggtgttgccatcgggcaccccattcacaggtgactg

SEQ ID NO: 18051 - DNA, 633 bp, Homo sapiens
  misc_feature (1)...(633): n = A,T,C or G
ttccgtggnagtttagctgaccctgccagtcaccaatcagggacattctactgttggagagaaagacagatgctgacagccctcttcagacctgcactgccccatcatggtcaacatcatagaatgaaatatctaacagcatgtctgctgcaagacagtagaggaaatgtctaacatagaaaaaggcctggatcgacggcttgaggtcaaacgtgtgagaaaatgtggcataactaaatactctttcccaaagtgtttttctagtttagctcctcccacattttccagggctcctctgactcgaaaaattaatttgaccaatctagaattagaaaatagtaccttatttcagtaaagaacacgttgatcccagaagtaaatgaacgtatttattattaatttacaatgaaatatgctgacagccaacccctttccctctaaaagaaaaacatattgctccgcaacctgccccagacctgtccaacttatagaaatatctgaagtgataataattgttactggttttagggtagaaacttagccctaatgagagagatttttattattttattaacatttcatatgacaaacaataaagttccttttgatttggatttagcaaaaaaaaaaaaa

SEQ ID NO: 18052 - DNA, 349 bp, Homo sapiens
  misc_feature (1)...(349): n = A,T,C or G
ttccatgtcttggaattatggcatcanaaannatctctttgcgaagtggacagcagactgcactctgtcttttcatgctgtcatattcctttgttgatatctctgttttaagatgagtttgccccatgcatcaccaattgtcttttgttttcaccctgtagggaagactgggctaatccatatgtcactatgaaacttcaggcctctctgtttgacaggtagcaagcctgacagcaatctattgaaaatgcattttagacagcaatctattgaaaatgcattttaggcaatcatttttccagtctaatttactcttaataaaatgactttgaagacaaaaaaaaaaaaa

SEQ ID NO: 18053 - DNA, 317 bp, Homo sapiens
tttccgagctttggtatcagcatgagctggcctcttaaatgattagggaggattccctctttttctattgattggaaagtttcagaagatggtacgagctcctccttgtgtgtctggtagaattcagctgtgaatccgtcttgtcctggacttttttttggtcatcaaattttcaagaattttacatgaaaaatgactgcaagttaattaactccactggagactagagaagattaaccaagagaaaatgaaaatatgccatgtacatagcacattgtattgtgataaacttatgaaatgacccaaaaaaaaaaaaa

SEQ ID NO: 18054 - DNA, 505 bp, Homo sapiens
  misc_feature (1)...(505): n = A,T,C or G
tttccgaggagcacacctgnacgctattaaaataacctggacaaaacaaattttactgcagagaactggtcctctaaaaaaatccacacaagagaagaacaatccggatctcagaaatcacagaaatcaagacaccactatagtatattgccagcaattattcggcacttccttaatatgcattatttcccaatgcccattacccacatttgcagaagaaaatctgctagaatttgcaaaatccagcttggatcatgtatcttgctcctgctgtaattattcatggctgggctggaggttgggtcataaaagacacctcactactcttgttcaacccttgtgatcttttgactggagactatgttgaagaaggggttgccactgtaggctgaggaaacagccccaaagaattttcaagcataattcccattttgctgttgccaaatttgtgtccatgtttgtattaattctggttgtctatagtctcaatataaaaaaaaaaaaa

SEQ ID NO: 18055 - DNA, 419 bp, Homo sapiens
  misc_feature (1)...(419): n = A,T,C or G
ccacgatatttgctgatgtggnaaaacgcctcatggtgtgnnaagtgaaaaacgcagaacacgaaactgtacttatggcaggacacaaatccaggagccattccttctgcctgggaggagggagtgatgaagaccagaggaatcccagaggagaagccatctgagatcgggaggaggagaaatggaacatcaggcggaggaaacagcccagacaatcgcactgggacgtgaaaacccttgggctgcatgcggggagaaaaccagaattggggatggttagggttttggagggaaacacagggacatgtgaccaaaaataataataactactgttacttattgaggactttctatgtactagaataagaaaatcatgatagctaagactgataaaacgctaagtgtcaaaaaaaaaaaaa

SEQ ID NO: 18056 - DNA, 313 bp, Homo sapiens
  misc_feature (1)...(313): n = A,T,C or G
ggcgagtccccctgaccccccgttnnnggtnnccaaaccaaaaattaaaaaatcccccgggaaaaaaggccccggggccaaaaagcgggggtattcccccacgtataaaaacaaaatctctagaatggttggagaaaggaaaaaggcgccgggcctcctcctccaagagggaggaggggaccccgcccaggcgacagaaagggaccacaagcccttctttctttaagggggagagggagagaccccgctgggagggggggagggagaaaaccgcgcggagccaaaaaaaaaaaggagttgaaaaaaaaaaaaa

SEQ ID NO: 18057 - DNA, 322 bp, Homo sapiens
  misc_feature (1)...(322): n = A,T,C or G
tttccgagccccgcccgtngnacatncancacgcacttcctcccctctgagaccataaaagcttgggactcagccagacctaaagagagactggaggccagctgcaaagaggtgctatctaccctagggtctcctctctgctaggagctgaacactccttaggatgacctgcccagcggagaggagctaccctttctgctaagagctgaacactcgttgggacaccgttgggacaccagagaggggttgcccactgcgggtctcctgtgagctgtttgttactcaataaagctcctctttgtcttgctcaaaaaaaaaaaaa

SEQ ID NO: 18058 - DNA, 1595 bp, Homo sapiens
  misc_feature (1)...(1595): n = A,T,C or G
ttgtttttgatgatttggtgtatttgaggnnngggagggggggggtgtntaggaggngtgtgtgggctttgttgtgttattatgtgtgtaatagtttacctatagtgttagaagcaagagcataaaaagataaataaataaaaaaatatatatttcacctgcctctactatccctcctctccccttttttattttnntcttctctcttttcctcttttattatttgtccagttactacgtagttagttatgtatgttggcttagtggtggatgtgcataggtctacatactnttatttagttagctactctcgcattatattttgttagtgctataatatagtattgaaaatatatttttattcttttattgtgttatatatattttgcgtaaatagcatcaagaaaagtagattctaaataatcggatcaataagagaaaaataggcaaagaacgggggaacttgtgagaatgagggcgttgtgaggcgaggggggcgacataaagtgaggggggggagagagagaacgcacgaatatgggaagcatacaggggtacaggaggggcancatataactatcacattttgttaagacccnggacatttgtggacccgaactctgccanctccatatcagtttatttaatttatatgggtgtgccctccgcaaaggggcggagaatnnggttanttcttggngcgcccccganngaagtggntttaatnncnncccctcaaggcnctcctcggntnctcnnnttggntagnacacnaaacacacnncnctcgngaaggagaaantctncnctcnntggggngnggntntnggagataaattttatggttntgtggtagaantatngngngnnggngtnnccccacatacacactaaggtgaancctcgtcgcgcggannnggccttggnctcccacaaaaacatcgggngngcncctatatanaaacactctctctgtataccgncgggggatgactctcgctcnagttcgctctctctcaagagagagataagataatattctcccgaaggaggagagacgtctgtatatatatatntgtcttcttgtcccacacttcttgggggacctcttctcttcacaaagaaaaacactttctctctttctctctgtgtgggagaaaattaaaaagaacacctctgtctggtgganggaagtatatattataaacacaaagagagggtgggtgtgtggtggttgtgtggagcanacacctcacaacacnccacaagagtaggggtagacccagaaaaaganagagtagagacatgatatttactttctttttgtggggggaattatattcttgttttctttgctggtaggggtagcgcgagagaggaaaatacaaaacaggcgcgtgggtattgtaaaatccactcccctcattatatttggtttttggttgggggntgtttaaataggagacgcagccaaggtgtgggttctatttcttgtctaatgataaaaaacaatatatctcctttctttagtatacaaaacccctttgtctatattctgcggtgacatataacccgctccgatacatcagtctgct

SEQ ID NO: 18059 - DNA, 464 bp, Homo sapiens
  misc_feature (1)...(464): n = A,T,C or G
ccacgatcctgctcttcacccagctggnatggnatggcacaatctcggctcactgcatcctccgcctcccaaattcaagctattctcctgcctcagcctcctgagtagctgggattacaggcttgcaccaccacgccagctaatttttgtatttttagtagagacagcgttccaccatgttggtcaggcaggtctcgaactcctaacctcgtgatccgcctgcctctgcctcccaaagtgctggattacaggcgtgagccaccatacccagctaatattatttcaaatgctatagttctatttagctaatgaaatactaactgcctttttaaatgtatataaaagcaaaatatttggcattatatataataaagttttcaacgtattcttataggaaaaaaaaagacacactatgttacctggactacaaagccaaataaaataattaattgagtgaaattcaa

SEQ ID NO: 18060 - DNA, 1368 bp, Homo sapiens
  misc_feature (1)...(1368): n = A,T,C or G
ggtttgggtgggtaacacttaccccccctatttttgcaaaaaggttttttcagagaagagataaccctatgtacccgtctgtgttgataactcgtgcgatgcactaagagccgcgcgccgaactatctgattgtgagcacacaactcaactaactggacgtgatcgtatctaggtatgcgctagatgtcgtattctcgatatcggatcgtatttcacaggcgatacgcgctatggtacccaacctagtcgaaggcaatgtgcgcctgaggggctgatgtgtggccgcccctctgcggtccgcgcgctttgcgtgttcgatcgtctgcgacctgactggacgcgtgcgtttgctaatgcgctatacattcactttcacttacatttcctccttccgtcttttggaactcttgcctctagctatttttgttgacatgtaccgtccccttgccatatgatttattgtcgtattgtgtattcttataaacgtaganattagatattcctattcgtattcgctctgccgctgcgattcggttcccgtctgtttcgtcgcccgccctatctccccccgccttttcccccctcgttacgtgtttttttttgctatcatctcgctccgcttgtgccgttccctcgttcacccgtgctgcccgttgcatcttgaagaccggtcgacgcatttgtgttctacctctcccactggccatatccgtctacagcaccgttcctcctgcctcctcgcgtcacttcccccttctcccaccccgtcactgtcgtagcgctcgtggcgcgggtgtgcccctactatcgcgatagttgtgaaacatttgccgtacactgtttctgtatatgtgtgatattgcttgctaatagtcccagcacatatccgctaaatattagcccacgacctcctcttcgtgctgatggatatttctttctccgcgtagtttacctgtcatactttgagtatctatacatattctcttcctcacatatcttcattttttcacttcaactcgtttcttatcctttgttcacttgaagtacccggccgagcaaggtttgctcctattgtataccgcgcaggtctagagtaatcaactcactgcctgcgctccagattgtaccacacattttaattcattacgtgcatnccatctccatacactcaaattgtaccaccaaaatatttactgatatgagcaggtccccgtctgtcttcccatacgcctcgctcgatactttcctcctacctatattctccttattacaagtcgctcaaaccagaccgatcgcggtatttattcttactttgtacactctctcactcaccacatactctcctactctgtaattatcttcaaatg

SEQ ID NO: 18061 - DNA, 987 bp, Homo sapiens
  misc_feature (1)...(987): n = A,T,C or G
ttccagnaggacatgtcgttgtgtgatccgtgnaagccaaagccccccgacttcctttacccctgctacgatggaggggctgttgaaaacgagattaagaaggtgaccccacaagattactatgtgaacaccctttgcccctggttgcctcaaagaaagcgagctggtaattgatactgacaacacaaattcatggagcttcaaattttcaccccctgtgtgtggtgatgctccaaccatggaggccagttttctatgaaaaactcacacgacagatttcttgaacatatataccggtctttgctttttgatattttaactggggctactggggcctagtgacaaggaccttaatgcaattcgccttaaccttaaaaaagagggggggaacttcaatgggagcctcagctggacgggaacttctgtgggggccgcgggttccccttttcaggttgggaggggtgtaatagtgaaactagtacccttcacnttcaactggacctgcgcattgcccgttcgtttcgacacgaatttgagggggaataccggcatgcaaaatcaactttgggaaggccggaaaggcccgggtataacgcccacaaatacgggggaataagggcccgggaaagaacgaggtgtatacacaatagggcctgcacgaccgccccggagagacccgtaaaacaaagagacccggctggctctagggggtttttaggcgagtagagaatccccgcccccggtctgtataagcctattccaaaagcggcttccccctctaggaaaagaagcggtggggaacaccccttacggggactataaacctagacgcctgtccgggttaccccctggggcagggctctccttcactcttgcgcggtaaacacgggtgcgccgacctccttgcccaatatacccccgggatacccagggacccccttattttccccttctagggaaaacccgcctccctttttcggaatgctt

SEQ ID NO: 18062 - DNA, 306 bp, Homo sapiens
  misc_feature (1)...(306): n = A,T,C or G
tttcgatgcacacctgnactcgtaatactcaatactatcttctgatgaagacanaaaagactgctcttcttcccanaatgagaatcaacattccataggaataatatttcagaagctagacatgctttcaagttgtcagtagattttacaatggccatacaggaacatcaaaatctgataaaacctaaaaaacaaaacattaatatatctggagccttataattttttattttttgcaattgtcttctaatgtatactgtctactatacttattaaatgctagactaactctgaaaaaaaaaaaaa

SEQ ID NO: 18063 - DNA, 1468 bp, Homo sapiens
  misc_feature (1)...(1468): n = A,T,C or G
gtttcaacagcntcgcngattctcagctccccacgcgctcccagggtctcactgggtattttntatgcacttatttaccttagatttttgtcttgtttggttcgtaggtgtctggtatgttgggaagtgtgtagtagtctagtgtgtgttagcgatcggggcggggcagcataaacttatatattatttaacaacctcagtcctaatattcgcggcgtttggtatctttnccgtttttccccggcttctattgtacccacccacgtcacncactacacgcttctttagattcgcatcggagagcagagaggaagcggatagaagcagccagtagtgaagcgagctacgatgtgtagacgattgggccgcttttttgtgccgcgcgcgcacccccatccacngttcatattacgtactagtcgattgcatctctctatgtttgtgacctcaggtaagagtgagatttacgtgttcgttcagccatgcgtcccgctctcgttgcgttgaacgctctctgaatcagtgcggtcgaaggtatcggagaggncgacggcgagagcaggcggnagcaaagacgtccgaacgcgatatgtaacgagaaggaggagtagtagcgtaggtggagtcgtggatcggtggtctagcgattagtgccctgtgagtgagacgatggagagtgcgcaaataggtcgtgaggtcgatcganncaacgtccgaccgcctccctctgcccgcatgagttgatcctcgcaganttactgacgtctacgacgacacgctatttctgtggcgctccgaggcggcacggctacgcgttcgccgccgcgcgagcgagcgggcgtgagcacgncagtacagctctcgtaatatacagtatcccggtacagctcagtcacatgtcacacgtctaataagtttatagagacgtagcagcacaaggagagatcgtagagcttggtatgcacacctgcgcgcgagtgagcgacggtgcaacgtcgtgttgaacggtttgcgtttctagctcgtgtcaccggatcggtgtatggttgtgtgcggtgcggcgctcttagggatgaatcgttgtaaatctaaagacgacacgcgagacggcaccgcgctctcgcgtattcgggtatttgcgccgccgctgatctgtgctgcagggcgctatacgtggtttatatctgctgggcattcgtattgctcagttcgatagttgaacgacgcgcgcacggattgcgcgttctgtacaatgaagctctggacgcggtcccgcgcccggctgtttgcacggtcgcgtcgnccgtccgtcattattgtgatgcgtggcggcggttatagggtgcngtcggtggccggcgaccgcgcgtagtagggatcatacagaggaggctcgacgcgtatattttgctaacggtacgcgaaagcgggtgcgtacggactaagttcagattactactataccgcg

SEQ ID NO: 18064 - DNA, 317 bp, Homo sapiens
  misc_feature (1)...(317): n = A,T,C or G
ttccagggaggacattatccgctgcttggnaccgtgnatgcggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaagtgctaatttattttgaaattatgtctttcaaccgtaagaaccctaaatatataaaatagttttgatgctaaaaaaaaaaaaa

SEQ ID NO: 18065 - DNA, 2057 bp, Homo sapiens
  misc_feature (1)...(2057): n = A,T,C or G
cctccaaagcagatagaacaagaaaaagagtcctatagagaaaangggccctgcntgttttaaggnnannncaaaaatttttttgaggggnggngggggggggggcacgaaagngnnngggnggnngaggaaggnngggagggggaggagannnnaggagggnnnggggggnnggccacaggggcgggcccacccgcccgngcggcccccnccaaccaggaagaaacgcggcgcggggggcccgccgaccgccgcnncccggagggcgaggaggcggnngcgggagncgccncggaagggcgncgcggagccgccgcgcgcgcgtggcgcgggcggnnnncgacccaaagccggatgagccggngnnnnnnggggcgcgcgggcccgcggggacgacggcgcgccgcaggcgcaggcggggcggtgacgctcgcaccaacgccgcaccgcatccagtcagatgttcgttttctttagttcataatcgctccctaacactcatatattcgcaaaccgatgtctgtgtctgtctcctgtgtcctttgcccctggcagccgggtggcgatcgtatgtcggtcagagtggaagcgaatatgttgacagtgcactataagcgcacgcgccgccgtggggttcctcttatagttgttatattcgccntagtcgcatagaagcggccgcaggcgaggtnagggaggtggagtggtgagcgtgtagcgtgggttctgtgtcgtgtagcctncgtacgctcgcactcacgtcttcttcctgtggcgctgtgtacatggtcgacttctatactcacctatatagtactattgnggcagtcttatgacggtgnacgaacgtagtatagagtggcgacggtcgtgtcatgcgcagtccgttgctcgcgtgtgatctctcgtcgcgctgcgntgngcggtcgtgtgtgacntgtncagtanatntacgtatgtcacgcttgtgtcgtgcgtgtagcgtgatgcgcattgtatatgtgtagatgagtagtcgtatcgatctccgancgcatgcatgtcaatagtagntcagcggtagcgtntgcggttacggtgcttgagngtgtagtctacagcatataataatcangtttngactagaagtgcnaataatctaatgntatntgcgactnctctcgtacatctngtaagtgctntantcgagacgtttcagtgctgtctcggactaataggcgatagntgtangtcgtaagtcacgtatgtcatagtngttcagccctgctagagcggtttatattgaataatgttttggatacgaaatcacatgttantctggcgccntctgcttgtctgtgtgtgtcgtgtgtttatagatgtttatanactgtgcgtgacgtctgtgtcnagcagcacctntgtgctagatctcactatgactatatnatntcgtgatgcgagctgngaancacgaatgtcgtncgncgactgtcgtgacancagtgactatttgctcgantgtatgtttgtgtgtctcngcggcgggtgntgtcgtcgattatagtgctacagtggtactatgttttcnatnnagcagtgagcgntccgagtgtgtactnancangaggataagnatgtagatcgtgcaanancanatcttttataanatacatctnagactatgnncgtttnatcaantantgcnagntgcgctataattacatcgacngtcatagtgatgcgtcatttgtatacgtctagcgtcntactatnatgttctacttctgtctatcaatgcanntacgtcgaatattnctgatttnatcgtcantcgatcatgtggatgngtgattcgacncgncgatacaangcatctagtcgtcgtgtangnaggngtagtanctgctgaagncgagtcgagncgttggcagttagtagcagtatgatgatgtgtantntcagtcattagntantantggancnannngatagtacgatagcaacgtanngttcgatntacttactgactgatncangatatntgtacngtaatcagtatgactcacnnangacga

SEQ ID NO: 18066 - DNA, 730 bp, Homo sapiens
  misc_feature (1)...(730): n = A,T,C or G
ggggagcccggcctggactgacggaattttgttctttttnnngncatacctcgttnattgaaaccngatttcgtggataacagcactgggaaccagttagcagaagaaaaagtaaanaatataaagcgaaaaaaaatgaagagtcatatgattaccaacttttcctttttcatataaattgagtgtatatgggtctggaacaacctgaatttccatcgagtcctggctaacctcattatgtcctatgaatatttttgactaatcccactttacattaatctgtattgtgaatgtggatattgaattatatttctttgtaatcccattatccaaaatccagttcagagactattagttaccaatgttcactgtgaaggaaaaaaaaaaaagctcagaggataaacatgtgatatggtttggctgtgtccccacccaaatatcatcttgaattgtagctcccataattcccacgtgttgtgggagggacccggtgggagataattgtatcatgggggtggntcccccatactattctcatantagtgaataagtctcacaaaatctgatggttttatgagggaaaacccctttcacctggttctcattctctcatctggactgtcgncatgtaagacatgcctttcaccttctccaccatgactgtgaggcctccccagccacgcggaactgggagcccattaaacctctttcacttataaaaaaaaaaaaa

SEQ ID NO: 18067 - DNA, 1830 bp, Homo sapiens
  misc_feature (1)...(1830): n = A,T,C or G
ctctcctaggggccttcaggtgccctaggncntcggatgttaatgatggggcataagaggggtttttatatatttttctcgngagcattcccnnngnctcnctcncnctccgtatacggaggcaaacccgcgngtggntgntgnngtttngtccacgnccngcgggacgcnttcnntccccgcggtcgtggctnncctccgcctcgactctccctatttttctttcgctcgtatgcggctcgtttcgcagatgccggtgtgccgttcatgttttacggtagnagtgtggtcgtgcatgacggaggagcntaaccgtctctgcntgctgttcatgtttactctcactgtccgacttatttctcctctccgcgatctgattcccgccgccctccncnatgtttctacttgcttttaatnttagctcgcgttttttagcgtgccnttgcgagcgcaggtgctcacgtttncatttagtcatttgcgtgtggtctggtttgtcgagcgcagtctcaccggtngtattacgtgtcacacccgacgcgcttgcacggtcagggcggacggcagcgtagagtgagacagcgccctctgaaaggcgatcgctatcgtgtctgttcgaccgcgggcgcggtcggggcaccttnattccatntgacagtatccgaagcgccttacctcccgcgcaagtattacgcgcatatataacgaaacgattcattaagttatagtaaaanaatccggcgaacgacaacgtacgaacgacaatattntgagntattaaaatatatagtaagtacgttcaccacacatacaacgccgcgaccccacgacacacccacaacgcacacgtctaacacaaaanaatatgnctcctgcgacggcgtacacagaatatactgcgaacactccaagtcgcattaatcacgacgttgcggtagacggagtgagaaacgacgtctcatacgcgaacagacggtgaggacgagttagtnagtcttgtgcagaggttgagatgctgggtgacgctctagtgtagtgtatgatcgtgccgtattctatcgagatatgagaggagcttgctagttcnacgaagtacgatggccagctttacgtagtgcgacgagtgtgatgcgaacatgcagtacgacgcagcgcgtcatccggatacgtcgctcgcatcgcgctacttcgtgggtctctacggacctgcggattatgcacgttcgagcaatagtgtacatatatatatacgatcgagtattagtaggacntatttagcttctgataggaaggacgtaggagacacagcggcggcagagagatcgtgcgcgacacgtgcgccatattatcgctgttttggagcgcccacggcgcgactcatcgtagtgcgttagactctatctattgagaatatatgtttcactgtgatacaatgtatcacgcttataagagagctgatntatcactatcantcagncgaacggcgacgaacgaggagaacagagatatacaganatagcatgatatcatncagtacactgacacgagacggagagagtatacacgacacatactcagtcgttatccgtngnggacgttctcttcgcattgccgctctcaantccgctgttngatnctgaatgngtcgtaatggctggatntggtcatcgcgtctgtatgcgcgacgtcgtgtgtctgttggcagcgtgcgaggntgacgnactacgcagtcgacgacgtgactnatgacatactgtattgcgccggcggcgtgtatagtcatagntgtgctaatgatcgcacattantattctnttcatgcttcctcgc

SEQ ID NO: 18068 - DNA, 633 bp, Homo sapiens
  misc_feature (1)...(633): n = A,T,C or G
caactcgggtgnaacagcagnatgccatctgcaaaccagnagtgagccctcaccanacaccaaatcagctggcacctcaatcttgaactttgcagcctttagaattctgaaaaaaaatacatgtttgttgggtaagacactgaatctacagtattttcttatagcagtctgagctatgacagtgggtgagtggaaatcctctacagtcctttagcatcttccatcagtattggccctgtggtcttacccttcttgtttcatgcaatgccctgtttcccctattagagagcaagtttgttgagggcaggcaccatattttaaaacatctgtacctgactcagttcttacaggtagtaggctctcaaaaaataaatggtggttaaatttttaaagttgagttattatctatatatctcccatactttaatttactttctcaatctttttagcatcttgatgaggtacaaagtatatagagtttggaagttggagggtgtgccttttgggaaattttatatattaaacatggttccttcatatatataaatgctgattatacatagcatcctggccacctttaaaagatattaagaaataaactttttgttttgaaaattaacaaaaaaaaaaaaa

SEQ ID NO: 18069 - DNA, 1235 bp, Homo sapiens
  misc_feature (1)...(1235): n = A,T,C or G
cgcggcaagatgagggtccgtntggngggtacgccccaggctaggagtntttaggaaaaagggnctggtgtgttaaanacnacaaagatttttaaaaaancccccnncnnnccnnccnnnnnnncnnnnnnaannnnnnnancccccccccccaccaccancnncacacacnncaacacccnnccccaacccnncanacnnaaggcnaggcccnnccacaaccnnnncnnnnncnncccccnccccccccannnnaaggcgcccnnnnggnggcagagcgaaaacccaccagagcgcgcacagcncgncacnngagggnagaacggaagggcgggccgtgngcggcaggggaacgcacgagaccctccggccgccgtgcgaggaggggaagacggaaggggcgcgcggtggtggtgtggattttacctgtattgatctttcaccgtggggcgcgggggacggcccgatgggcgcggcaagtcgtacagagtgcgcgaggcgtgaggaggcgaagttatgaagcgttggggatgggtagaatgttatggaaggcgggggcggaccttctccacgtgttgaacgatacagactctgtggagaagcggcggaattgtggcgttcggcagataagtagagttgggcggcataagtgagggtgttcgatgtcggaggtttagatcacaggtgtgtgtggtgggttggaggagagtgtcaggctcggcgcgttcacggtagaggtgaggcaagttaagagtccacgctcaggtgacatgagtaagcgtagagaggaggctagggttgagtagagaggatcatgctcaactatggttacaacgcttcatataaagaatcatcctgtcgcgtagtttggagcgtgggataagcttaggactcacaatgctgtgcggtcctcggtgttcacctattcaagttatagaggcacgttctgttaccatatgttgcaaattgcccacgctaagacacggaatactcgcataatgtcgtagggctggatagccgcgggggtgctgggtgggtagactgaactcggataatgacataacgcgggatccagtttaagtatcccaaatagtgcgaagttgcttgggatagaacaattatatcgattgagaagacgccacaacacgcggnacagaagcattagagcctacagcacaaatgtacactgcggaggcgtggcacaagagttataaactctaaattgtcaattaaaa

SEQ ID NO: 18070 - DNA, 533 bp, Homo sapiens
  misc_feature (1)...(533): n = A,T,C or G
ggaattttttttttttgggtacattggttataaacctccttaaactattgggaactctcatctccagatctgccaaacanaggggcttctgggtgggacaagctccatagtggaaagagtgcctgaagctttgtggcgttctctgcaggcaagattgcaagatggaagtaagaaccaaacctcctgattccacagtacagaagtttctccactgaaggatccttctataattaaaagcatctggtgttttttgaaggagcttctcaaagctgctttattttatcacctatctttaaatttcatacataaaatggtagtatgcaaaagccagatgacatgattctacatcacacggtttcattttgtttttgctgccccattatttgaacactctactggattgctagagaaatataatctcatcaaaataatttgcagcaaactttaattttaatatatctgtttcaatgcaatatttcattcttgctatagatattaaacattctttataatacactgcaaaaaaaaaaaaa

SEQ ID NO: 18071 - DNA, 204 bp, Homo sapiens
  misc_feature (1)...(204): n = A,T,C or G
gttccgggagtactgtctctttcccttncnagnaagnaattcaggaactcagaaacctgtaaaaaaacaaataaataattaaaagtaaactcaaaggctgctagaagaaaaatgttgcttttcaaagaaattaaatatgatattgatgtattttattcttcattgtctaaataaaagtcaatcttatttctaaaaaaaaaaaaa

SEQ ID NO: 18072 - DNA, 1854 bp, Homo sapiens
  misc_feature (1)...(1854): n = A,T,C or G
tgtacgtagggtgttgggctcctctgcttccccctcctccctcttcctctccctatcttctctttcaatctctcttcttcagaccactcttatnctcgctaggcgtctcttcacgctgtgccgtggtcaggtggaatgtgtaggngtatgaatatntggcctcttttgtcgtgctgctcgtagacttgnttcgacgataattggtagttcgcggncgtgcgacnaacacgtgcgtacgcacacagtgatacgaccagtactctcatcancagtcgcgacatgtgtttactctcgtgtacgatatggatcgagggtacgagcagtgtaggattacgaggcatcgtatctcgtccacacgatcacgtactgctctatacgccatattctcctctcagntatgacagatgttntcncgcgatccgcgctggttgttctcgtccgcgagtcgagtagcggatagcatgtcantacgagcggcgcacgctaccgaccttaccgcgctatatcacgncaccagcatcgtcattgttctatctgtctcttttctatcagtagtctgactatctatatatatatcgacgttagttcgcatcagntatcgtacgtctgntcgcgtcgtatatagngcggtctgtctagtgatgatgacagatcgggatacgtcgcgccgagcttatgactgttgatgtatcagacgtgagatctgtagagttggttctgtcatgtctgtncgtacgacgcgtagtctatacgcgcggtcgtacgccgatacgactagatgtgcgtatgcgngcgattaagcctcgtttatgtgtttgatcacacgcgtcacgaaccacttggttcgttatcgtgtaatcgtatcantcattaatatacgttccnatatgagtctcgtctcctattattatacacatgcagtagagtgcaatnattaattgtcgatattcgtattgtccnantctcgaagcacgcgacgcgcggacgatncgcggagcagcgctacggcacgctgatagagagcagtctgtgtagcgctgcacgangcctngatagcgcgaagtattcgccacatatctcagcgagcactgtcgactaatggatagaactcgtagtacggaatantgagtaccgtcagtgaagcgcgcatgcgatgtctagaggccgttnttagctaccncagactgacactctcatcgnacnagacgtcctgcccgcctctctcggtcgcantcgcggtcctcctctctagtcgtgctgtccgtcgccttcgtgtgtatgngtgcgcgcgtgaccgtatcgactcaangacgcagcgatacgangctcaggagcgttgtatatatcctcactcggtgtgtcggcgtctgacggcgtatgtctctgctcgtcgcaggagcagcacaccttacggtccgcgcgttctgtaattcactcaagctccatcgcgatcattatggatatatataagactagggcgagtcatattcagatgacagcggtacgtattatatgatacatctattattatgtgtcatgtcgcnacgcgtcataatgcgcgcgagagtatcatattntgcggncagattagcgcgacgtcacgcagatgtttgctnacaattgtctgattcttgctgcgcnccncggcgtctgcagatatcagctctcacgcgtgttcccgcctcactattatcataacggatccgatcacggtactgcattgtagccgtctgaacgcgcacgactatatagggtagcggttcgtcacccggtcccgacactatgaacgatcggtatgaacgtacagcgagcgcagacgatgtgagtcagagcgcgtaatatacacttctctgt

SEQ ID NO: 18073 - DNA, 429 bp, Homo sapiens
  misc_feature (1)...(429): n = A,T,C or G
ttttcggctagggcccaccattctanaggnaatgagtgactagtctgtaaaaagggtgttgaaatagaagtgtcaccacccaactgttcagagattccgagtccagccatccccagcaggccagcaaaatcagactgtggacacttggatgattgtcaactcctagacctaagacaagtcactgacctctctgagcctcaagttgctgttctcacaagaaagcagagctgacaacatgataaaaatgagagtccccttcttggaaaagcagggggaaattatcattcaaagtactattaataaaatataaaactatttcctttctgtcagtctctcttttgacttgtcatgctgttttaaattttttatttaatataaatataagtaaggcataataaatattttaaatcatcagtaaaaaaaaaaaaa

SEQ ID NO: 18074 - DNA, 531 bp, Homo sapiens
  misc_feature (1)...(531): n = A,T,C or G
ttccggcttttttntttggntagttaaaanctnctgcaatggnaatgcctgcnacaacttaattagaatnctgcagaacagtncctgnaanaacaaatctggtactttcttggnagcgaatggaactcacatttatagagcttgnggacttggaaaatacatgggattactcatacattctcatggtttctgccaataatcaaatattcattaataaaaatgtatacttttcatgaattttatgtgggtcatacttatagattttgctcacatttattaaagttgatagatagatagataatatatataatagcactgtacatttgcagattttttgtttttttcttttagaattttcctttttctctgggatttaattttatacgctctgttttatcaaaatcttaattgccctaattcactatctatagaattaaaaaataaatgcaatggtattctgtgttttcaaattttgggtataattttgctaaaaattaaactaaatgtaaagggcgaccaaaaaaaaaaaaa

SEQ ID NO: 18075 - DNA, 857 bp, Homo sapiens
  misc_feature (1)...(857): n = A,T,C or G
tttccggtggaaaaaatgngagtgcagtgaaatcaacatcacagagnacaatgagacaggacgtctgctcctctttctctatgagactatgtgtctggaacttcactggggactccgtccagaatgttcttcatttgcacgtctgatccccctccagaatctatacctgaagagaggcactttatctcacacatctctttaactcttgcagttataagtagagtatctcacatgcagtgagcactcagcacttatctgtgagctgaacaaacaaggaagctgtgatggatgaggaatcctgctgtgcacagactgatggagtcatgaaagattgggtagatgtggtgccaatataccatcgaccattaaatgatcctaaataacttcaaaaatgtaagcgctattcaaaaacattttatgtgatgtaggtaaaaaaccattttgtataatttaaaaactttttaaaacaatcaaatcacaacagtattatagttttttgtgttaatttgtgttaccgaaggcttatcttttgagggtttgaagtcgaactctggagagtttttcataacaggtacaacaaataaaacggctttacctgagtttctcaaaaaagagaactaaaatatcgcactaaaacaaggccctactcactaaaacaaaaaaaaaacggcctcaccggcccccccggcggaactttatccgcgctaacccttcaatgtgggcccaacctaacactcactcacccacctcacccanatctgcttatttattatacccaccgattcctttccccccccccccgacccttcgccctcccacctattctttcgcccaccactcccccagcccttccatga

SEQ ID NO: 18076 - DNA, 915 bp, Homo sapiens
  misc_feature (1)...(915): n = A,T,C or G
ggcggggcccgccccggggacgacgggtattcgttttttacccgaattttccgagngctgctggcganatggtngcgtacttggctcactgcacctccgcttcccagcccaacaatctttagccctcagcctcttgagtagctggaactacaggtgcaagtcatcaactcccggnacttggtacctgtttggtgttggactattgaactggatgaagataccaaagccgtgggaggagaagaatacattacagaatagtttaattcctttcatttctagtgaccgaaatgtaaaaactgtttcccactgcattttatgttaacactccctgatatatttccgctaatataaatatgcctgaaaggatgacattcaattatgttaataactgaatataaaatcaggggtcactacaacttcgttttgttcgattccaactattttgctccgcatttactatgtacacaccattatttgagcaacatctgaatcccccattccaacaaagctccataaggacagatatcatgagccccctatccatatttaggatctctgtagccgtcgcccgcaacacagaacccctgtccattggcccaaccccatgaaattatagcccccacctagacccagacacgacaatctcataaaagggtgacttataccccggcccccttccactgccccgtgggtgacccaccaaactgtccattaaccggcacgcgcctcctctccagccttttcccccccccaccacgacctataagcgggccggcgggaaaccaccccccccacacaaaccgaaaacgccatatcaagttttccccccgcgtaacccgtctcgacgcccccaccgctccactgcacacgcgacgcaaatgcttagcgatgtcccgatcggcccaagttcaatac

SEQ ID NO: 18077 - DNA, 361 bp, Homo sapiens
  misc_feature (1)...(361): n = A,T,C or G
ttccgagattcacccgtgtcgcccanatggnatgcatggttcaatcttggttcactgcaacgtctgcatcccaggctcaagtgattttcctgcctcagccccacaagtagcttggactataagcacctgcaccaccacgccagctaatttttttgtattttttgtagagatatagttgccaagattgttgcccaggctggtctcaaactcctgagctcaagtgagctgcctgccttggcctcccaaagttctagtattacaggcatgagccacctcgcctggccataaacttaaattgtgttctaactgcataataatttaaataaaagctatctaaatagtgtttttaaaaaaaaaaaaa

SEQ ID NO: 18078 - DNA, 387 bp, Homo sapiens
tggcggtccgcccggccgacgcattgtttttcccggtttcggggacgcaccatcacacgacacctgtcctggctgccgggactcctctacttgactcacacggagtggactcctgaccctggaccagcgggactcagccggccagacttccttctgccgttataagatttggtgcccactgaagggttaaccagaccctgagcttgagactttaagacaaaaataacctgcaaaggagaccttgctattgaaatggagaagaaaaatggtgcttaaaataatcaggaaaaaataaacactaccgagaaaaagcatgcacatgatgaaatctaaaactcaaataatccgtttaaataaatccgcttctgactgtgaaaaaaaaaaaaa

SEQ ID NO: 18079 - DNA, 930 bp, Homo sapiens
  misc_feature (1)...(930): n = A,T,C or G
aggagcgccgccctggctcgcccggtttgtttttggnncggnnngttcgaggggngagcattgcatgananaccctttcaaacacacagnagtggctgaatcataaagaacagaagaacaatttgaatgaagatggatcaaaaagaagacagacatttctaaaaagccatctttaaatataccattttacaagctccctagcaaatatcttgagacaaaattggatgactacacatttagcatattatcatgatgctttgaaaatatgtatgtgtacatatatatgtaatatttatacacaaaatgtataacataatatttcatatgataataaatataaatgtaaatataaatttgacttaagaagggagtatatgttgatagcgttgaagcaagcttcacatgatcacccccaatgtccaaactgtctctccccacataccagctcccttttctgacacacccacacaatttccccgcttcattggacctgaatctcaggacacaccgagcaatacactcacctctcgcttttcccccccaaaaacccccacccctccactttccccccccctcccctattcccccgccattcgctatccgccccccgtgtttttcgcggcacgccgcgaaccccgctcccgactgccgcactctgactctacatccccgcccccatttctatccgcattacccgagcctacaaaatatcccgagtgatcctaccccatccactttctttttttccccccaccaccccccccactcattcgcccggaccaccacacagcccacccccgtgctcctcagacacactccgtgccatcttgtccccccacatatataccagctacacaccgccacccatagctttttcgtcgacacatcgttctttacaacactccaccgtccccccatcccttcacacac

SEQ ID NO: 18080 - DNA, 341 bp, Homo sapiens
tgctgtattagctctttatgattttctaagccatttaattttacttttatcttttgtaatattggtttactatatttttctttggaccaagtaactgaaacagattgttgttggtaatttcacatatagaaattaaagtcaaattatattgtattgagaatttaaaattcttttcacccactttctttttccagaataagatttctaggtcagcattatgttcttgtgatttttattcatactaaatatacctctaatgaaatgtttcagattgataactttgcacagcaaaataccactatattcaaataaaccattattcacttgcaaaaaaaaaaaaa

SEQ ID NO: 18081 - DNA, 835 bp, Homo sapiens
  misc_feature (1)...(835): n = A,T,C or G
ccatccggggtactggcgagtaagttgatactgttgcgggccgggccggtggctcacgcctgtaatcccacactttggngaggccgagcaggtggatcacgaggtcaagagttcaagaccagcctgaccaaaaggtgaaaccccgtctctactaaaatacaaaattagccaggcgcagtggcaggcgcctgtaatcccagctactcgggagtctgagggagaattgcttgaacctggggggcgggaggtgcagtgagctgagattgtgccactgtacttcagcctgggggaaagagtgatacttccttttataaaagtaaaatcaaaaccaagctgaaagactggttattatttttttccctaaaaatttgatatacttgttaataaaaaataaaaagttattattgttttgccttttttaaaaagtggttaaaccattaaaaatggtggatggggaaaggaaaaatataagagccctgggcctcttttgccctaacgggggggaactttgtcgggccccttttcttttagcgggggttttttaatgaaaccttccttcatctgactctccttgcttttgtttctgttttggtttgcgcggcagcgcggttctagtttctttaaagggcagaatatacgggttttttcccgtcagctggggtttcatccttgttgggaaacttgggagattttagggcccgtattagggcgcggcaccccttttaagcggcgcccctttatttggtttcacccccattttgcaatcacgcgcccctccgctcgtcttcacaaacactggttcgcaacagcgtaccggggcccccccctccccccc

SEQ ID NO: 18082 - DNA, 907 bp, Homo sapiens
  misc_feature (1)...(907): n = A,T,C or G
ggtccggtatcaacacagcatctanagttgcacagtttccananagtcagatatcctgcctaagatcttttcacttcttcttaccacgcataaacaaaagagacatttttgaggcatgaaacaccgagtctcacactcatttgtcctcttatcatctccctgtctcttctggctcaagaatcccaaagccagtattccattcctagctttggcggaagatgagaagctcataaaaatgaactgggaatatcactcagtacagcactcggctttcttgtatcggctttcctaagcgctaattattgtggttcgcgcacccagatgactcataccggtgctgtgcatcccttggggcaacagggagcgccgcgcctaccgagcgctgagcgcccgcggtctctgccggccgtttgtcgttccgcgcccgccctttacccggctgcgcccgcccactcggcccgctcgcgcctcctcccgtgggagccggccgcccgccacgttaggggtgcgaagagccggccgcgctcccgggatgggcggacgccctctacgcacccgggtgcgattggcgccagcgcccgtgattggaaggcgcccccacccagacgccacgaccgggccgcatcttcctgtcatttggcggcccacgtttcgatggcgcgtcgggggcccacacgtagtgtggcgctcgcggcccgcgcgccatcagacttgcgtgtgcgcccgaccagcgcggccgattgtgcaacggagcgggacaaggacggtccgccgtgggggccgacgaagcgcgtaagtatttgatgcgcccggggttgacggtaacccggcgacaccccccgcgctgtggtctcggagcgcggtgtaggttgtcaccattggggagcacggccgacgatgcccgcgg

SEQ ID NO: 18083 - DNA, 219 bp, Homo sapiens
tttcgggaggaagctactaagtagccagctctacttttgaccatcagtgatgaaagaatgaaccttaaaggggaggaggactaacaattcttcaggtgagaagagggaagaaagttaggatgaatctggaagtgagatttcaagatggggcaagaagaacttctgttcacctgtaaaatagaaaaaaagatattttcagtctcacgaaaaaaaaaaaaa

SEQ ID NO: 18084 - DNA, 875 bp, Homo sapiens
  misc_feature (1)...(875): n = A,T,C or G
gggtccggagtatnccttggctatggttcttctactttctattgnagtcttgagatctttgtcgctataaatatcctgaattctatgtctactatttcagccattttggtctgtttaagaaccactgctgggagctaattaatgcagtcatttggagcctattcaacatgaagatgatgaagatgataaggatgaagatctttatgatgatccacttctacttactaaatactaaatatatatgctatttcttatgattttcttaataatattttcttttctgtagctttctgtatggaaagaatgcagcatataatatatataacataagaaatatgtaataattgactgtttatattatttgtagggccaacagtaggttattagtagtttttgggagtcagaagttttacgttgctattgtgtgggaaggtgtcacccctaaccaccatcttccttgagaggcaaccgcacatatgggaggatccgccccccgtctttttgctggcccattggtccacgacgccgatttcgtctcaccgccctcctgaccacgcgccctgcctttccctccccccctttgttttcctcggcccggactctcaccctccccccagggcttaatttggtctgtgtttccgccaccccttgctcgcccggtcgagggccgccggcagttggcgctcgctcccccaacccatgctttttttctttttccccccgcgccaccccctttgttcacgccacctccatacacccccccgcctggctacgactcccttcaccacttttgcccccgtggtcgcgcccgtcgcgccccccgtcgggctggccccgacccctcgtttcggctccaccccgccccgcattctacg

SEQ ID NO: 18085 - DNA, 414 bp, Homo sapiens
  misc_feature (1)...(414): n = A,T,C or G
ggtgagcccgccccggaaagatnggataaggtttttnnnnggnntgtgcgagcttnacaattncattggattaagnatggctttttcagcacagnacatgccactcaaactgattccagtgaaatactgtcagtaaaagaattgagttcatctacgcaaaagttagcacaggtaaatctgaatttgttctgaaacttctgagataatttttggcgttaattgccttcatgtttctttcatagacaaaagtgaaataattaaaatttttaaaatgttagcatctttgacaaacagctgaatgatagctgtgctttaacaaattattaatataagctactacttatatttatgtcatacttacatgttaatttgtttaataaagtattttgctactctgctggaaaaaaaaaaaaa

SEQ ID NO: 18086 - DNA, 566 bp, Homo sapiens
  misc_feature (1)...(566): n = A,T,C or G
gttcgggtctcttggnacccattccagnaaattntctttgaggactagnaacatctggaatgcccgtggcttctccccttccttggacactatatcatgtcaccaagaagcagctttaaagcttgtaaacctctaggaaaaaaggccatataagatagaaactacattcttacaaaagcttccacttttctattatttgcatagtctgattaaatgctcagcccttgtcaccttttctacaaactacggacaagtttacaataggtataaatgccctttcttactatttactattgcagtcataatgttattttaccagtgactgttaattattttattattagtcattgactggcacttacacattcattagatagcaattattagagtttagttgggaagttacagtagttggcttaaccaatgccttcttacacacttatgactatgaacagaatgctgccaaattctgaccggtcctaacgactcagtgatgtacatttaaaaagggaaaagccttgctaatatcttctgaataaaatattttgtttataaaaaaaaaaaaa

SEQ ID NO: 18087 - DNA, 942 bp, Homo sapiens
  misc_feature (1)...(942): n = A,T,C or G
gggagcgaccgcccggcaagcaggatttgtntttnnccgnntttccagagatgtgttttcctgtatcttctggntccatgtanagtgttngagtctgtgcaactgaaggaacaatcacctcttccagtatttatagactgctttttgcagaaacattatcttttgttttatgctgaagtagagtgcagcaagcaaaaagcagcaaaagacacataatcaaagtacttggaatgctgactgtaaaattatgctgagaactggctgcatgataagatgcttttccttcctctttgttatttgtattattttgtaaagataggccagtgtgagtatgtccaaataagctaataatctatttcccttaaaatttcagcaaatattcaagagaataaaaatgtaagttattgtccacacagctaatgttaatttttcattaacataatttaagtctcggtgatagtttgaaaatgttcataatggtgattgtctaataaaatggatgattggggaattgtctagctcccgcaagaagtgcggcggcggacacccccgaccgccagcacttatgccacacgcgctccatagcacaccccccggccatacctcaccaccataaatttcatccgggccccataactctctaccacgccccccggtgatcgcgctatattttccacgcccccctattcactcgccccgagcccgccctcaccttttttccgcacgttagtccctctcccctcctcaccgcttctttccgcccaacccacgcccagtgatcacccagttgaagctactaagcaaccccctccgcactcacacccccggtattttttttcgcccccccgctacccgcttaccctccccccccacctgcctgtgtcaacccccacgctctacttttcaaacaccaccctcgcccgccgctcctattcacctcaa

SEQ ID NO: 18088 - DNA, 872 bp, Homo sapiens
  misc_feature (1)...(872): n = A,T,C or G
tgtcccgaggtgtcaaccatttttcatggcatttcaacccataaaaaaaactgtaaatttcagaaaaaacgaaagtgtaatttcaagacaaatacatnncacaaaagtatgaataangaaagaaatgtgttgtttcagctaggcaggtattcctgttaatttatggagccgtttgtcctgcttgtaaaattccattttttatggaatagagaattattgctgctgtaagatgtaacaaaatggctaaatgcctgagggaaatacaataaggacatttgggttaggaatataataatattcaaaatatttcactgggaagttagaaaaagttatcccagttttcttttaataaattgaagcagaatgctaatttaaagctaaataaatataacaatgtgaatgctgccatgcacaccaatgtaatttatccaaaagattcggcaaatgtgtataacaatgattaagaccattaatgactgcgtgagtgcgtgcggccactcgtttcagcttccctctaagacatcccttccattgcatacggccacgagccacacgccccggtgtcgtttgaactccaccttctttttaaaccccggacatagaatacaacaacgaacttaaatgatatattattcccccccccgcgtttatgtcccccaacctcccccacaattcgccagctttcacccctcccgttcctcattcgtttttttcccccccccgcccccaattttacaaccacacaatcataacgcacccgttacatatcgagcaccatactattattgcactgagtatgcttgccgccgcttcccacatattggctcacaccccttttcatgtcaccgtacctgcactcacaccttcatccc

SEQ ID NO: 18089 - DNA, 853 bp, Homo sapiens
  misc_feature (1)...(853): n = A,T,C or G
tcgagcttccnccctgnaagananaattttaatttgtattttttgttactttggaagcaaaattttatcagaatctcttggtcagaggcagaaacactcctgaagactatcctaaaancctcttcacaggaaggaaataaatttagcaagtaaacacatcagccaaatgggtctggttgctctaaagaccacagggcaaagcggcttgaaaccaacagaaacatcaaagtcattaatggctggatttcaatgtcgcgatctcggctcactgcaacttccgcctcccgagttcaagtgattctcctgcctcagcctccggagtagctgggattacaagtgcccgccaccacgcccgggtaatccttgtatttctagtagagacggggcttcactatgttggccaggctggcctccaacttctgacctcaggcgattcatctgccttgccttcccaaagtgctgggactacatgtgggcagctaccgtgcctggcgaatagtcgaactttcattaaggatatctctaaatgtcaggcaaaattgcgtgccccacgcgcacttttgtacctgtcccacgcttcgtctcaacaccgattaataatccctggaacccgccccaactcgttgacatggcgtctggggcccggttcacgccgcgccccgatgcccgacccctgcccactctctttttccccccccccccccccttttcacgccccgcgcccatgccccccccacctctccgccacgaccgcagaacgtattggtccgcccccttttcgccgtaaggccctcccccgttaggttttcccgcccggtttcttccacccttccgcccccccccgcctcccccc

SEQ ID NO: 18090 - DNA, 688 bp, Homo sapiens
  misc_feature (1)...(688): n = A,T,C or G
cagtgcggtggtgcatgcctgtaatcccanactttgggaagccgaggcagcagaacacttgnaagtcaagagtttgagaccagcctgggcaacatggcgaaaccccgactctactaaaaatagaaaaaaaaaaattagccgggcgtggtggtgcatgcctgctcgggaggctgaggctggagaattgcttgaacccaggaggcggaggttgcagcgagccgagatcgcgccactgcactccagcctgggcgacaagagtgaaaactccatcttaaaaaaaataataatttcaattcactgaacataaaaatactactccataaatttataagcattttatttctaaacatatcagaaacaagtcatgctcgaaagtagaaaattactaataacagaattgtctacaatctatttatatctgtctagattatcatttgtatgtgggtaatgttccagcttttagttcagaaattcaaactttcttaataatttccaaagtggggtttgaccatatcctctggaatttacacatttagcctattatagttaaatatacattttcattggtttctacaaagatttttttccccatatatatcttcagattaaatggagattttcattcgcatcttaaatgactatgtgcctaattatgattaaaattaattgtttcagaaaaaaaaaaaaa

SEQ ID NO: 18091 - DNA, 576 bp, Homo sapiens
  misc_feature (1)...(576): n = A,T,C or G
caagacttttcttcctgaggcttatctaccgatcaaancaacttctacctcaccagcagatacagaggcaacttcttccatagatttcttcaccagttttccttagctgtctccttggaacatttgaaatcctctggttctttggcacccaaatatgaaggtcatttcatcaaaggcctaaaattttcatagagaggatttgagaaaggtgatctcagtaaaatacaaaaaaaaaaggaagaaaagctacagtaaaagaaatattgctacttatatatgcaaacgaagactgaggacaactattatcagctttctactcttaagaattatttaagttgctactcctacttctacatttggacattggtttaccatgccatttttccttatatatatttaaaaaatctcttaagaattaaaatggtagtatgcatgttttcaggccaaatatatatttccaaactgttctaaatttgttactactgtgtttttactcctgagtaatcaataacattgagtaataaagacagaattatttatgtataaataaaaattctcatgagaaaaaaaaaaaaa

SEQ ID NO: 18092 - DNA, 601 bp, Homo sapiens
  misc_feature (1)...(601): n = A,T,C or G
tttccgaaatattgtcacctgtnattgatcgtttaattcccacatatccctctgaagtagaaagcgaaagctgggggtattggattcacatttaagaaatgaagaaactgaggctcagaaagggtcaccgactccacaggatcacacagagaatcagatgtgatctcaaactaaagaaacagaaaatactaccacaaaaccattgccataggaagaagctattaaaatgcatgcagccaaaaaatgtaggaaaaaggatctcactctgttactcaggctggagcacagtggcgtgatcacagctcactgcagcctcaacctctcaagctcaggtgatcctcgcacctcagcctcctgagtagctgggactacaggcgtgtgctaccacgcctggctaatttttgcattttttatagaggtggagtttcaccacgttgcccaggctggtctggaattcctggactcaagtgatctgcccgtctccacctcctgaagtgttgggattataggcatgagccactgtgcctggcccagtttttctttttaattgtaatttgttgtgatttttttctcctaagtaaatatccccttttatatttgg

SEQ ID NO: 18093 - DNA, 423 bp, Homo sapiens
  misc_feature (1)...(423): n = A,T,C or G
ttccaggatttgctctgtcacccagnctggnatgcagtggtgctatcacagctcactgcaacctcaaacttctgggctcaagcaatcctccttcttcagcttcctgaggagctgggaccacaatgatttacccatctgctttttacccatgggcctccaaacagcacggttagaaaaactacaagcttcaggaacaaccatgtagtttggccttatcagataaagattacaaagttgaatttttaaatgatcacactgatgtggatgtttcttaattaaacctcatcatcattttttaaaagcttgaatgaagaactggcaatggctgaaatctcttttaaaaagaagtaatttcatggatatgacaatatacaaatgaatgaataaataaaataaaataacgttcaaggaaaaaaaaaaaaa

SEQ ID NO: 18094 - DNA, 470 bp, Homo sapiens
  misc_feature (1)...(470): n = A,T,C or G
tttcggctcatagtggnaatggcttgccttgtcttggntgagnattcanactgtgggcttctgattaatgctgaatgactttgctacagtcactgtgttctacacaaatagaacgatatggagaagttatgacaactaaagtgaatttcctgagaaatgtaattttggagaaattgaaggatttaggaagagatgatactcacagagacatagcaatgttgcatttgaactgatgcaacaaactgattatgaagaggcatagtggaagaaagggatattcaggggaacaataaaaagtcatctgtgaccaactaaaaatcccatgttcaaaatagctcaaagaatcaaaatgctactctcattttaatcactatgttttgaaataaaagataatgtcttaattcattacttatatttctgccaaaattatctttgaaaaaaatttcttaatagaaagaaaaaaaaaaaaa

SEQ ID NO: 18095 - DNA, 405 bp, Homo sapiens
  misc_feature (1)...(405): n = A,T,C or G
ttggttggggaagcatacgtattagcgggagangctgtaaaggccactcaaaggcaaaaattctgtaagaaccaaataaattatgaggaagagcatatactatcaaatgaaagaaagctaagaataaagatgttaaaagatacagtaaaaggaaactggaataaaattacaaaatttattgaggagaataaagaaaaattacacagctagagtaggattttttttaagttagagaaaagttaaaacatgccacgagtaaagccaaaaaactggagaaacaacttcaaaaagataaagaaaaggttgaagaatttaaaagtgtacctgccaagagtaacaatatcattaatgaaacaacaaccagaaacaatgtcctcgagaaggaaaaagagaaaaaaaaaaaaa

SEQ ID NO: 18096 - DNA, 623 bp, Homo sapiens
actcgggccaaaaagcatggtttcacgcttgtaataccaccacttcgggaaggccagggcgagtggatcacttgaatccaggatttgagaccagcctgggcaacgtggccaaaccccgtctctataaataaataaataaataaaatttacaggcatcattatatatatgatattatataaaagaaatttttcactattttcatttttctagccattattttctttcttttatcttatgattcttaccaaataattttgtggaatagagaagggggcatttaaaaagaatctgctctgaatacccaactcattaaatacactccacagaacagacttgctcagcctcaggacctcagcctcgatttttccccccatttcttgccaagtaacctccactcatcctcaggccttagctaaaatgatatttcttctgggaaaacacctttaagccttttccagtcagagcccctgttacattttcctctgggcctatacttcctttttgtatcatcagtgtttgttcaattgtttattaccatggctagcttgtgagtggcataaggaaagggtctgtatcttgtttactcaataaatgtttgttgagtgcaccaaaaaaaaaaaaa

SEQ ID NO: 18097 - DNA, 601 bp, Homo sapiens
  misc_feature (1)...(601): n = A,T,C or G
gtctttgggacaaaaaccttggttnaaacaaaaatccacccccgcaggagggattttacatcaagacatctcccagcctactcacaagaagatggcaaagatgaagacttttatgatgatccacttccacttaatgaacagtaaatatattttctctgtctgataattttattaatattattttctctagcttactttattgtaagaataccatatataatacatataacctacaaaatttgtgttaatcgactgttgtcagtaaggcttcctgtcaacagtagggtattagcagttaaattttggagaagtcataagttatttgcagattttaaactgtgtgtgtgggggagtcagggttcataaccttcacattgttcaagggtcaactgtatatattctaaattatatgttacatatgaaagtaacaaaaaactatttgtcacaacatgtttccattttttaaattgaaacatattattacataaaaatacttttcaacattttggccttgtcaatactggctaaacttttattgaacaaatgtgttaatttctagtaagaacaataaaatacaaattatatttcaaaaaaaaaaaaa

SEQ ID NO: 18098 - DNA, 191 bp, Homo sapiens
  misc_feature (1)...(191): n = A,T,C or G
ccctccgattananngaaccgccgcctcnagggnggagacacgccgtacctggcacaagaagccatctacaaaccaagggaaaaaggacttggcaagtaaatcaatcaatgtcaaaaccttgatttcagacctctgccctccagaattgttagaaaataaatgtctgttgtttaaaccaaaaaaaaaaaaa

SEQ ID NO: 18099 - DNA, 852 bp, Homo sapiens
  misc_feature (1)...(852): n = A,T,C or G
ggtccggggggagagacaccggntttttcccctccacatgcagtgtgtgcctgggaagactgctgtcccctctccgccagcatcactctggtcctcatccttcgcctggaccacggccgcaacctcccgcctgggcctcctgccctctacaatcgaatcctccttatatggtagccagtgtgatctttaaacagtggaattcaaatccagtaactctctccaacacctccccagcacttggaccagaatccagaccccttgaccagcacaggaagctcctatgatgccccccgcctgaccctgcaaactcagcacacaaactctctcgctgttacaggaacctgccaagtgggtccccactttaggaccttcacactggcctttcccttgctctggaacggtcagacagctgcctccttctgctcatcacctcccagtttaactttcgcctccccaagaggcctttcctgatctgaccaccccactcgaagtaaacaccaagtcactgttgatgacttcaccctatttttgttactttttaatacttcacagtactgaatttcagatgtattcctctctaatatttttctttattttcttttattttattttagagacagggtgttcagtctgtctcccaggctacagtgcagtggtgcaattatgggcaccgtagcctctagctctcagcttaggggatcctccaccctcatttcctgagtagctagaactagggggatgcaccactgcgcattttttgtagagatggagggcttgcgcttggattttgatactattggggtaaagaaaagcttcctggtcttgggcctcccaaaaggcttgggcataccc

SEQ ID NO: 18100 - DNA, 352 bp, Homo sapiens
  misc_feature (1)...(352): n = A,T,C or G
gactcggggacncaaaccttttttngggactttggggaaaagcagnaagccggnacagcagtacctacaggggccaatggatccaaggagaaggcccagcgaaaggaaggacccagcagctcccccttgccagcgctggagaccctggctctggggcccagtcccaagcctagtccagcagcgacggacagtgcatcagtcaagggcactgctcacctccctccggacccaaccgccatgaaggccaaagccgagcccccatgcaggccagctcacgtcccattctgccatgtctcgggctggagcgaattgtattgatagaaaataaaatgtcgacataaaaaaaaaaaaa

SEQ ID NO: 18101 - DNA, 389 bp, Homo sapiens
  misc_feature (1)...(389): n = A,T,C or G
tccttggnaagaaagaccgnagtctcangagacttctgcgttattcaaggacacacagctgctacgtggcagagctggtgcagagtcgaggtgtgctggcatctaaagatgatgtttccactatgttatctgttgacttctccacgaggaacatgaggctctctctctctctctcatgcctgttctcaggtacatctgccaccccacccgacctcggcatgcttctcgttcttctcagtctctcaacagaattccgtgattattgtggttatatcgtcattcaggctctacattattatgactatgtttggctatttacagctgaatatagaatagtgtagaaataaatagactatagaataaaatagaatgctataaaaaaaaaaaaa

SEQ ID NO: 18102 - DNA, 514 bp, Homo sapiens
  misc_feature (1)...(514): n = A,T,C or G
tttgcgggtnctacagacccnnaatcctgnaacgtcctctgcatcagnaatgctcccttcacctcaggaaccagcaaccatcaaagtagccaccatttccgagcagctccatggtcctgcctgctccgagttttgcatctgtgcccttgcagtagctgcttctcgtagctctctacgccatccatttatccactttgtcatttggtttatgtttcaagaaaaaaatctggttctgtcctgctcagcctctataataatcaatggctccccattcacagtaggccaatgtccagtttcatgtccagagccttctccactggtttttccagctccatcctttggcattctttgcttggcacatgatttttagcctcgcagatggatctcactatatatattcttatctcttgcactttaatgctatttatgtctcgtctcccttccagaatttccgtcttctgcaagatatcacaaatcagtcattaaatgtatcttgtgacgaaaaaaaaaaaaa

SEQ ID NO: 18103 - DNA, 489 bp, Homo sapiens
  misc_feature (1)...(489): n = A,T,C or G
ttttcggttgggnaggcactggggnacgtattgtggntcttcgctaaaaactctagactttcatcttggtggtttctacatgagctcgtggaccccatagaaattgatggcgcggaggatcactgtcgggcacttgctgatactgcagatttgttcctcagtggcacaattaccatttgtgaagatcacacccaggatagtaatcagcaggccagtcctgggcacacgtctgtcatcactcaactttgcatcataggttggtaccagtgtgttgataaggaaatagatgtgcctatctggatccatttccttcaggtcaagtccaaagaccatctccaggtgatatgaaactttccccagatctcactgaagtatctcctgggaatttggactatatctttcagcatagctgcctttataataagctctttcatttgatacttgtacagaaggtaatgcaccaaaataaacaccttctcatcgaaaaag

SEQ ID NO: 18104 - DNA, 408 bp, Homo sapiens
  misc_feature (1)...(408): n = A,T,C or G
tttttccgggacttctgcaaacatggnaaaattggttngactctctacacaaccctgtgnngtgcacaggcctattggnnaccatctnagttgcaggaaaaacaagttcagggctcccactgattctacattatgatgcaaaagcctgaggcacaaaaagcttttaaaatcttgcccaatattacagaacttggaagcgttagaacttacagctcaactcagacagtcttcattgtttctgctcctaatcacttgactgataggtatttttcaatttgtgtcattatttaagttaatgtattttactgattcctgagtggaataaaatttaaatgagtacatgatttttctaaacttgtactaattttatattaaaatatacgttcatttgttacaaaaaaaaaaaaa

SEQ ID NO: 18105 - DNA, 561 bp, Homo sapiens
  misc_feature (1)...(561): n = A,T,C or G
tttccgggnnaacttnantgtcacaaaaagggactccttccacctggnaccaaaggggtaaaagacacaaagatcacagtcagtggaccagtggagaacttttcatgggagtgagaaatacgcatctgctgttaagagtcactgacagatgaagatactttgtgtaaacccatggaaatatattttnacttgaaaattatttcattaatcctgatattacttaaacttcccccttcttttaaattttacactaaagaggcctacagaaacacataccaagtaatgcagtgggatttccttatggagttgatataaaagaacagagatatcagatgggtttcaccatgttggccaaactggtctcgagctcctgacctcaagtgatccaccgtcctctgcctgtgaaaatgctgagataacacgcatgaggcacagcactttgtatgggggcatatatccatcatcacaaacatcacaaacatttatttttgctttgtattacaaacaatccaattatactctttcagttctattaaaaagtacaatacaaaaaaaaaaaaa

SEQ ID NO: 18106 - DNA, 294 bp, Homo sapiens
  misc_feature (1)...(294): n = A,T,C or G
cattcagaaacctggtgaactgtttatttgaanacaacgacacagttgaaaacacttaatcagctaggggagaatcatttttacctgtttttggattcagtatagtccctgggaatcccagcaaccaactgccattgtctccacactcagacttgtgctcaattataagctctctccacatctaagatgttatgtttccacacagctactttaaacaatcaaagaaattaaaagatctttgggtcgctttgtaataataatagtaataaaaaagtttctataaaaaaaaaaaaa

SEQ ID NO: 18107 - DNA, 378 bp, Homo sapiens
  misc_feature (1)...(378): n = A,T,C or G
ccggttcacagcttcctcacccgnacggcagcatcttctggcagtggaggagtttccctttcaacttgatgatcagaacttggagtcagagccgtggggaaaggaagaagaattcaggctgagtgaagttactgccgaggacttgtccagacctgctggtgtgggaatttcctgagatggaagagccccaggagaggaagcaaggcagatgcatttaatttctcgattaaaatgaattaaatgtccacattttgatgtgtgatcaaatcacatttgagacacactgggccaaatatatttgtgatgaactgtcgtgcagataatgaaaatcatttcaataaaattctcatccgtgctaagaccttaaaaaaaaaaaaa

SEQ ID NO: 18108 - DNA, 589 bp, Homo sapiens
  misc_feature (1)...(589): n = A,T,C or G
ccggggattcccagtattatgttgaaaagnatggtgagagtgggcatcctcgtcttgttccagttctcagagggaatgctttcgacttttccccattcagtataattttggctatgggtttgtcatagatggcttttattacattaaggtggatacaacaacctcaacccatttactatttgattcatcatattcctcttcttattctaggatcaccaagcatacttctgttaataaattaggtgcctgtgtatgatctggccagagtgagtgaatgtgtttatcagactatgagttgcattttttactctaaattaataaaatggcattataactgtccacatcagtcacactgaaaaatggattcactcttggtatacaattgaaatcaaacttctgagagcgggaagatgaggacccagctagactatgttcaattcaccaaggacttacttactgttgagacaacttggggaaaaagacactattaatcataagcattatttttctcattttgaaacttttagtgatataaggttttaatacatcttttacaaagatataaaaatttttacgaaaaaaaaaaaaa

SEQ ID NO: 18109 - DNA, 1243 bp, Homo sapiens
  misc_feature (1)...(1243): n = A,T,C or G
gggaggacaacgnaaaggacaaaaaagggagggggccggtgganagatttttttcgaggcactggctgcttcagataaccagaaggcgccgtgacttcttggacccctgtaccaggatgccagaagtaatataattacaccattaaaaccagctgcatgatgggaactggcaataccctgggcagccttgtatatcatgaaacatatccatctatgaatagcgtaatgtttccacttgcgccttgaaaagcgaaaatactctctgtccgctcttctgaagtaccatgatggatgatgatgcagagatcgcaatgtatgtacttatatatggagcactcgcattgttctttgtagtactccacacgctgcgacatgactagacgattgcctattccctagtccgccatcatgcatataatatggcaaacaagatcccgcttaggcactgttctattccatgtcaaggaagaagcatgccgttctcaagagtgaaagaggcatcatcctctcgtccgcactatccctgttcagtattgaactaataacctcatgacttgtctcttttatcaactggggtacaagtatcacattagggtcactaattatggagatttccacgttttgccgcccccccgttttaacgcccttttttgtaccacctctcatcacccctatagggtgtattttttcgttatactttatcgacttaactggcctattgcttgtgtcgccccgtcggattggttctatcgtcatggaggatcgactttaggagttccggttctacaactattagcgaaggagggttaagcgcctatagagcacctgggtcgcaccttcccgtttgatgttctcttactcgttgattactgatcagtccttcagagtaaaggagatcttataggcacacgtgaaaaatgtatctgaaaacgctccggcgagccctaacgatgatttagagggtcttaatgctcgctgtgtgtggatcttattgttgacgcactattacgcgcactaaaaccatgcgagtgtttcccgtaaatagtagaggcgtatatgtcctatgctactgtctattatcgtctatactacccctagttgtcgcttactatggttatactgctcacacaccatccgcgccgcatctatatgcttgattagtgtgagaacactccgcggccatgctatctttttatatttgtactgtgcaggccgcgtttactgcgactttgatccgctcttt

SEQ ID NO: 18110 - DNA, 596 bp, Homo sapiens
  misc_feature (1)...(596): n = A,T,C or G
ggagagacgcccgggcagacgcgcacgtttttnnnnggnnttttcggcaggnncaaccgggcanagcgctcctcactcccanacgggcagcggggcagaggcgctccccacatctcagacgatgggcggccgggcagagatgctcctcacttcctagatgtgatggcggccgggaagaggcgctcctcacttcctagatgggatggcggccgggcagagacgctcctcactttccagactgggcagccaggcagaggggctcctcacatcccagacgataggcggccaggaagagacgctcctcacttcccagacggggtggcggccgggcagaggctgcaatctcggcattttgggaggccaaagcaggcggctgggaggtggaggttgtagcgagctgagatcacgccactgcactccagcctgggcaccattgagcacctctcttagtgatttttaagagctctttacatattgttgatgtgagccctctgtcagttctatgtgttcatagatctgttcccactctgcaacttgccttgtcactttcttagtctcttaataaacagaaattcttaatttgaaaaaaaaaaaaa

SEQ ID NO: 18111 - DNA, 842 bp, Homo sapiens
  misc_feature (1)...(842): n = A,T,C or G
ttccgaggagggacctggnacctcccctccacatgcagtgtgtgcctgggaagactgctgtcccctctccgccagcatcactctggtcctcatccttcgcctggaccacggccgcaacctcccgcctgggcctcctgccctctacaatcgaatcctccttatatggtagccagtgtgatctttaaacagtggaattcaaatccagtaactctctccaacacctccccagcacttggaccagaatccagaccccttgaccagcacaggaagctcctatgatgccccccgcctgaccctgcaaactcagcacacaaactctctcgctgttacaggaacctgccaagtgggtccccactttaggaccttcacactggcctttcccttgctctggaacggtcagacagctgcctccttctgctcatcacctcccagtttaactttcgcctccccaagaggcctttcctgatctgaccaccccactcgaagtaaacaccaagtcactgttgatgacttcaccctatttttgttactttttaatacttcacagtactgaatttcagatgtattcctctctaatatttttctttattttcttttattttattttagagacagggtctcagtctgtcttccaggctacagtgcagtggtgcaattatggccaccgtagcctctaacttccaagcttgaagtgatccttccacctcaatcttctgagtagctagaacttagggcatgcaccactgcgcattntttgtaaagaagggggtttggcctgggattgaactcttgggcttaagacaactttctgtgtttggctctcaaaagggtgggaatcacga

SEQ ID NO: 18112 - DNA, 473 bp, Homo sapiens
  misc_feature (1)...(473): n = A,T,C or G
ttttcgancatgtgctctgnaggcattgggnaggcacagcatggctgaatgtctgatgaagcggggagtcacagggttgcggccaccgcctggnggtgcacatgccgatatgattgttacatcctgtgtgcagagaaatccacttggatcactcagcagagaatgaaatgagacctgcctatcctaatggaagagcagcgcctctgaggaccttgcaccattgtgctgaaatgtcacttgggccaaccctgatgagggaccacctctacacagaggcaaaggaactttttttagggagtcattcctcttttctggagctatggagatgaagtttctttgaggaatttcatgagagtgttttctcttacttcaataaagttgttttatttgataaataaatattgaaaatttacatataaatatatataaagttgttgtatttcaataaagttgttttattaaaaaaaaaaaaa

SEQ ID NO: 18113 - DNA, 566 bp, Homo sapiens
  misc_feature (1)...(566): n = A,T,C or G
tttctggtcacatgttgctctggnaaaccganagggtgagcagccaccaatncatgaccccaaacagcaagaggacagaagggatcccccctactccacagcttgacggcagagcagtgaccagaatatatgctcaggaaggccaaagagatgaagccgcagctgcctctttttttttttttttgagacagtctcattctgttgcccgggctggagtgcagtggtgcgatctcggctcactgtaacctccacctcccaggttcaagcaattctcgtacctcagcctcccaggtagctggaactatacaggtgtaccatcacacccggctaattattttttgtctttttttgtagagatggggtttcgccatgttggtcaggctggtctcgaactcctggcctcaggtgatccacgcacctccgcctcccaaagtcctgggattagaggcgtgagccaccgtgcccagccaggcttgcttctctgagccatacccttctgttggaacaagcatcctttctattaaaagcaataaatctcctcttatttaagtggaaaaaaaaaaaaa

SEQ ID NO: 18114 - DNA, 618 bp, Homo sapiens
  misc_feature (1)...(618): n = A,T,C or G
ttttgcggggtgnataaacccgacttctttcaanaagccagaacctcctcatatcttggagcagggattcatcagcactaagaagcacctggcatgtaagctgttgtgtctgatttctgtagccaactgaagactggttacttgcatgctactgtgcctgtaaatgcagtgacctacccaaggtcacaaagccaatgtgtgatagtgatatggagatttgaactgagatgtctctgtctccaaagtctacattctgcccttgatacatcaattcaaatgagtcctggcttctattaaatgtcaaaagagcacccaacagaaatatacaaagctatttacaccaaaatagtcattattgatcagtattgatcagccatttcacagtgtctcagcactacctattttcaaacccctgggtgcttaataacagtaagtttggtgctactaatacatgtctcattttgattgtttcttgactattttcttctaatgtcatttaattctttccttctccctacttttgtaatcagttgtgtcattaaacacaaaaactctttacagagacgatttactactatggaatttcaattatacaattatcacacaaaaaaaaaaaaa

SEQ ID NO: 18115 - DNA, 597 bp, Homo sapiens
  misc_feature (1)...(597): n = A,T,C or G
gactgnatttanggagnaaaaagccccttataaaaccatcaaatctcgtgagaactcactgacttcacaagaacagcagtatggggatcattgcccctgggattcaattacctcccactggctgctcccatgacatgtggggattatggaaactataacatgagatttgggagaggacacagtcaaaccatattacctacacagatgtacaaatacaaatatcaataaaataatagtatgggaatggggagaaaatgagaagacaaaggtcaaagggcacaaactagcagttatgtattatgaataagtctaaagatataaagtcaatgtaatatgaataaatctaaagatataaagtcaatacaatagaagattgtagttaaaaatactgtattgtatattgaaaatttgctaacagagtagatttgaggcactctttgacaaaaaaaggaactaactatagaaagtgatggagatgttaatttgtttacctaaagtaagcatttattatgtacctgtataacaaaacatcatgtcgtatgtcctaaatacaaacaataagaataataaataatttgaaaaacaaaaaaaaaaaaa

SEQ ID NO: 18116 - DNA, 385 bp, Homo sapiens
  misc_feature (1)...(385): n = A,T,C or G
tttcggattgnaaaaccatcattaaaagaataattggctttggtgaataaaaaagaactctgactgaaagagtggaatgtcaattctccaaaatgaaaaccgcttatgaagagcttactacggaattagaagaatataaggaagtctttgcaataacattaaaagctaacaaatccatgtcaaaaaatttaaagaaataagtcaaaacatacacttgtagaaaatcaatcaagttcattaatttgccatgaaagcataatttttagtgagacaacttcatgagattagtaggaagtgaaagctatcctgatagcataatttttgaaaataatgctagtaaataaacttacatttaaaatgttagtcaaggacaaaaaaaaaaaaa

SEQ ID NO: 18117 - DNA, 364 bp, Homo sapiens
  misc_feature (1)...(364): n = A,T,C or G
ttttccngagtatncttggctccctggtcagtgnaagtatgttgaagggatcaaccgccctgcctccccatattccatccactgtaccccacttctccccgttcctttgagctttcgcccaggatggaaagctcagagccaggaggccactctcccattcagattccctctgatgtttggctgccacaaaatccctccaactagaagaaattggttttggactactcatttcctttgcgtgatattgcccctattttaggtatagaatacaatttcatgttttaaccattggaaaaaaaactgaaaattatcattttctctctcaataaattctgactttctattgcctggaaaaaaaaaaaaa

SEQ ID NO: 18118 - DNA, 844 bp, Homo sapiens
  misc_feature (1)...(844): n = A,T,C or G
ccggtgtccctgtgnaggtgttgcccaaggaaataacatttgcgtcagaagactgggagaagcagacccacactcaatctgggtggacaccatctaatcagctgccagcacggctagaataaagcaggcaaaagaaggtggaaagagcggactggctgagtcttctggcctccatctttctctcgtgctggatgttcctgtcctcaaacatcagactccaagttcttcagcttttggactcttggacctacaccagtggtttgccaggggctcttgggcctttagccacagactaaagactacatttttttttttcggctttcctacttttcagatgtggggacttggactggattccttcctccttagattgcagacggccaactgtgggacttcatcttgtgattgtgataaacaggagaaaactcaagaaaatataacctatatgaatgtatctttctgaactttaatgagtacaaatgttcaagggctgctttcagcaacactgatctagcttcgggagtagtcatcaagtacattgggtcaattcagctgtagttaatcgcttgaagacagtgcaaccacctgttctacagaatgagttttgccaaaaaaaaaattactgctttatgatgttatgtccaaacacactgctatacatttgatgtaatatatactatatattttgtgcattttatacttaaattgtggaatttcaaaaatactattattttaatatttcaataattgaatagttaggtatgaatggttctaattagatcaagcattaattcattaaggactacagattctgtgttagagtagaagattaaaatatcaacat

SEQ ID NO: 18119 - DNA, 406 bp, Homo sapiens
  misc_feature (1)...(406): n = A,T,C or G
ttttctggtgngccagaacaaattataatgnaaccactacgagnaagttaagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacanaaaaaaaaaaaaa

SEQ ID NO: 18120 - DNA, 899 bp, Homo sapiens
  misc_feature (1)...(899): n = A,T,C or G
ccagtatcctgtttgctgttgtgagcccggacttgcctgtaaaggcagattggtgcgccctcttgtatcctccctcctactcacttgtcaagtaactctttctgccttcgagaactgtacacaacaacaaggagatcacttggncatgatgtccatctcctctccaactaggaatggctcccgctcactttaactggcagcaactatcggcgatctatgagaagctacctaggctgcagaccatgctcggtctctttgctacagctgttacctgcctgttgatgcctcaatacgtcgctttttatcaacgcccttgactcatgccaatgtctgtatctagtgaaatacagagtgtgtacaggacccatacgcggcctaaatttggaatttgagacgtaatactctaacctattctaaagctttcggaaggagggcatttataatactacgcaattaatttcatgctagtaatattgtgcctgcaaaggccagctttatgcttaacatattacaggaagaatattgtttattattgcatataacccaggatatcacacggtgggctcaggtaccgtgatgtcttaactaatgcttatctttataaaccaaagcggctaagaaacctcagatattgaccctccgtggacgattgcttgtatcaacggcttattcatgtaacttagtcactgactagtattgacattccgagcgaaaagctactagggtcattatgtcccttgaagggggaaatatcgggacgcttgcctttatgggcgtgaacttgaaaatactgtggtcgctaccctctgcgcaagggtcattaaccttccatggtcgctttctctgttgctcttaggtcggactactgcccttcgccggaattagctaatatcgaggta

SEQ ID NO: 18121 - DNA, 845 bp, Homo sapiens
  misc_feature (1)...(845): n = A,T,C or G
tttccgcatggaaaaggncaactncccgttnccagttacttccttcatggncttgnaaacagaaaaagggnaattttcagnntttggaaaatataaattgctgtgagaagatcctcaaactgccatggttaatctgcatatttcagagatattttaggcatataaattattgtttttgttttatacatttctgtgtccacttactagggattacattgtcttcccatatgcatgtggaatcaggggccctttccctgccgtcacatttagggatggagagtggaaccaaatctcctttacttcccttggcaacgaggtcaataccacttgcaaatccaaccttctctcattgcaactatgtcaaagaatcatgcctcatgtgatggaggagaagaagtgggctttgggctgctgtgttgggcaagagactatgattcatcttcctgcatggattgccttgagtcatgctgtcctcatcattagaatggaaatacatctaatgcttctatcatgatgaaatctaaaataagtcaataaggatgttcttttagtcaaattgatgtctttgcctgggatgcccttccatcttagtcgacctagacaatattccgcatctttcaagaatcatttggtgactcataaatctatatctcaagcccagacctctgtcctcaggtcctaggtcaggtatcccactgctcactaatcacagctactgggaattcttctggggcatcttgactcatcatgagatattttcttccatggctcaacaaagagaatgggttccctcttttttggtgcctccactgttctttgtgtgagcttctctacactgtctgtaa

SEQ ID NO: 18122 - DNA, 490 bp, Homo sapiens
  misc_feature (1)...(490): n = A,T,C or G
ttttccgatggancctgngacanctgnaaaaagnaactgnatgnaactggtncagtggcttattgaaagaaacatnnttttttccagcccaccanaaagtaacaatnnctgcaagcccanaaagccagaactaaanattagtcccagccccttggggtaataaccttggcatttaacccctaccatattaaagctgggggttttaacttggttaaaccaatatttttaaaggggcccaaaggttttcaaaacttccccgggtttttttgggtttttacaaaaacccacattcctcatggtttacgggttggccctttaaggggaaaaaaaaaaaagggggcaaccccaaaaaaataaaattttttataaaaaaggggggcccggggcaattttttagaatttttgggagggagaaattttttcacccgcgccctcctaaaaaaaaaaagggggggggggggggggcccctatattggaaaaaaaaaaaaa

SEQ ID NO: 18123 - DNA, 267 bp, Homo sapiens
  misc_feature (1)...(267): n = A,T,C or G
ccagtggaaataccttcttggttatanaaattgggcattacaagtatgtgcatattgttccactgtcttcttagctttcaggttttcaaaaagaaaagaaaacttagacttttctgatgttcttttttacgtaaataaccattttattgttgttttgctttttctgccttcaaactactcccacaggccaaatatagctggctgcttctttctgtaaataaagttttattgggccacagccatggccatcttttaaaaaaaaaaaaa

SEQ ID NO: 18124 - DNA, 154 bp, Homo sapiens
  misc_feature (1)...(154): n = A,T,C or G
cagacattcattgtaattctccgcaactggnaagcaagcgagggaaaaaaaaatactggtgaagaagctcatgagatattttagggaccagtcctgagatctcccatccacctccaggtatcacattgacagacctgacttaaaaaaaaaaaaa

SEQ ID NO: 18125 - DNA, 570 bp, Homo sapiens
  misc_feature (1)...(570): n = A,T,C or G
atctgagacanagcagttgtgacagactgtcacacaccctgctatgtcaggaatctcgtttagaagttaacataatccttcaattcttcaagagtgaagagtgttctgctgataaagactaaagaaaatttaatacaatttgcatgtggatatgtgttgctgatacaggacatttgccaaaaaaaaaaaatgattaaaatgtgagaagtcccatttttcaaagagaaagaaaatgcatgagtttcagcctaaacaaagtaattctgtcattctactatatgtgtttcaattataaaaatgcagacaaattttatcatgtttaaaaactggcgtcaggtgtcttgaggaaatgatacaaatagaatttaaatttaataaaagataatactaaaacaaacagctaatttgggaggaataaatcaacaaatcactaggaaactattacattttaaaataatttgaggttctgttcatttttctcttcaatgttaaaatgatgcatatatttgaaacatctttgtggttttttctccccccgattaaactttgaaaatctcaaaaaaaaaaaaa

SEQ ID NO: 18126 - DNA, 384 bp, Homo sapiens
  misc_feature (1)...(384): n = A,T,C or G
cgagtgcctcaactacgttcgtnccgaccaccagggnaatcccaccctgtgcagactgtgctccanaccaggaatcctaagtgagcagcgtggtctcactatgcggaaacccagctgatcttgtaaacttgttattgccttggccgaaagtggatgtcagagcaaagtccaaatcagctcagaaatacccaagtgatctgcacatcacaagactgcttctgataagatgtgacatttaccggtgacatgtccagcaacagcaacaaagaaccagagaaggctcacaaagctgaccctggaacgggaagtttgcttgccttccccaagcttgctgctgtgtgttgtttactttctaagttgcacggtgacctaaaaaaaaaaaaa

SEQ ID NO: 18127 - DNA, 918 bp, Homo sapiens
  misc_feature (1)...(918): n = A,T,C or G
ccccnnnnnnnnnnnccccnnnnnttttcccccggncgccnggccggcgggcntggggtcnnnggggggggggggcgcctggcctggggcctngccggtaatnggttttttcnnccgnntttttccgggnttattacncctgttaggaggccctntaggaacccggggccgagggaccccctccaggggggtttcccctgggaaatccggccccccttttttcccctccccggcgggggnccgnaggggggaaaccccaaggggttcccccccccccccccccccggggggggccaaaggggccctcccccgggggggccccccccctngggggggggcccccccccccatttttgggggcgcctcctccgggggggggggaaaaaagccccccccctcctttaacccccccccgcggaggggggaggggggcggnccacccccctccccggggggggccccccccccccttttttttttttaaaaaaaccccctccctccttttcgggggggggaaaaaataaaaattctcccttgggccgcccccccccgcggggggggaagcncacaaaagagaggggggggggggtttttttttttttttcccccacccacccccttttttgtttgggggagaaaaaaaaaaaattatattttttttcttcctcccccatacaaaaaaaaagagaagggggggggcgcccccccccccacccnaanaaatagaaggatatatattttttatttnattnnactnctnccnctntgctctctcttcttttttttttnaaaanaaaacaacacccaccccgcgcgggcgaggacgccccccccacnctactnttgttttttgtttntttntnnnnttncttttcttcccccccaaacaagaggagagnagnagccccccccgccgcc

SEQ ID NO: 18128 - DNA, 236 bp, Homo sapiens
  misc_feature (1)...(236): n = A,T,C or G
tttccgaggntattgtgcctncttncttatntnccacctnccagcctggnattgatactttaaatggacttaacacctatatatgtacaagttttattatctgatttctagcatcatgaatcaatccccttcaaggaacagataaaaaagcccatcccttgataggacagacaaagtacaaaacaaattggcatagaaatatgtctccataaaagttttcaataaaaaaaaaaaaa

SEQ ID NO: 18129 - DNA, 725 bp, Homo sapiens
  misc_feature (1)...(725): n = A,T,C or G
tttccgaggaacctgggcagaaanctggngagctattatnccttnanaaaactaactcagnaaacagnaaaaccaagtactgcatgttttcacttataagtgggagctaaatgataagaactatgaacacaatgaagcaaaaaacagacactgggnngtctacctgaaaagggaggataggaggaggaagaggagcagaaaaggctgcagtgcagtggccagatcatggtttactgcagtcttgacctctggggcttcagtgatcctcctgcctcagccccctgtgtagctggaactacagaagtgcttcagccatgattgtaagcttcctgaagcttcccaaccatgcagaactgtgagtcaattaaacctttttgctttataaattacccagtcttgggcattactttatagcagtgtgaaaacggactaatacagagtctcacacacacacacaatacacattgactaggatgttaatttggttgtcactgaatccatggacaaacttaagaagaatcaatattgttacaacattgagttttcaaatgcatttcatgtatttaagtaggttgtttgtagattaatctgagttttctatgtacataataatgacacctgttaatattgactagtctgtttcttattttgttattttaatccctgttttattttactgctacagtaaatgttgaataaaagagcagagagcaaaaaaaaaaaaa

SEQ ID NO: 18130 - DNA, 165 bp, Homo sapiens
caggcaacggtactagttagaaattgtagaggaagactgggctcagtggatcatgcctgtcatctcaacactttgggaggccagggcaggatgactgcttgaggtcaggtgtttgagaccagcctggacaacatagcgaggccctatctcttaaaaaaaaaaaaa

SEQ ID NO: 18131 - DNA, 547 bp, Homo sapiens
ttccgagctactttgcagttgaaagaaatcaaacctcatgtcattggacgcttcatgaagagtgtcaagataagatcccattcctgtttccctctgtgattatgtcactgatctgttcttggaattggaagaggaatcaagaaagaacaataacatagaagtgtagtatttggcctcatgacaggaacagcttattttatttattcactttaaaatgttattcatacatatttgtggagtacaatgtggtgttttgatgcttgtatacactatgtaatgctcaaaccacgatgattagcatattcatcaccttaaacattcatcatttctttgtgatgataacattcaaaaacctctcttctagctattttgaaatatgtaatacattaactctagttatcctcctatgccatagaaaaatatgccaggagaacaatgagagatgtaaataataatgggtctttagagccacctaaggattaatatctctccaagaatcaaactaaaccttgaaataaaacaaatgactccttcaaaaaaaaaaaaa

SEQ ID NO: 18132 - DNA, 758 bp, Homo sapiens
  misc_feature (1)...(758): n = A,T,C or G
ttttcgattgnatggaaaggatatctcctgctggcttggaaaaaaaaacatacatcttctgagagtgccaagtggatacaacttgagggcagccgctaggagctaagagcaactcctagcagacagccagcaaggaaataagcacccaggtccccaaatgctacaactgcaaatgattgaattctgccaaaaacctgaataaacttgggaaaggactgcaagttctacatcatactgcagcctagccgacaccttgatttcagtcttgtaggaatcgagcagagaagccagctaggctgcgtctgaatttctgccttgctgaaactctgagataataaatgtgtgttttttgaagcagctaaatttgtaataattttctacatagcaaataaaaatcttatacaatgtaccaggtagttggctaggtgttacgaataaaactttgaagaaaacaatttctattattattgtcctgttggatttatggcttaaagaaaaaaggggacattttaatgcagtatgtttctatgatggaagaagaaagaagttgtcagaagaagatagacagaagaagaaggaagatagctagaagaaagaaggtaggccgggtgcggtggctcacgtctgtaatcccagcactttggaaggccaaggtggatgaatcacttggggtcaggagttcgagaccagctttgccaacatggtgaaacgccgtctctactaaaaataaaaaaattagctgggcaaaaaaaaaaaaa

SEQ ID NO: 18133 - DNA, 465 bp, Homo sapiens
  misc_feature (1)...(465): n = A,T,C or G
tttcgtgaaagagcaaagactgcgtttggnaaatgtgtggtgngaacaagagcatattaatgttaaactccaaaatatttttatctcaaagattgaaaacaagataaagatgaaggactctacaaaataatggaaaatgacagatctgcacttttccagcctcccttgcagctagggtatggatatgcgacccaatcctggccaaggaaacataagaagtcaatttgggacccttggaaaagacattcttacttgattaaaagagaaaggccttaagaaaattcacttttctttcctgtctttggagatgattacatgaggctatgatgctgcagtaattggataagaggcgtgtgctgaaagccttgatttgttctactgaatcagtgctggaaaaccctatctgatgaactctttgttatatgagcaaaataaatgttcacttttaatggaaaaaaaaaaaaa

SEQ ID NO: 18134 - DNA, 498 bp, Homo sapiens
ttcgaggactaaacccacctggagtcacttgtccaacgacttctttgtcctgagaaagtcatcaaaaaacctgttgaacccacgaagaacatcgactaaaactcctgaattacgattccaaggccagcctacttactgcaataccggttatctctgaatgaatgaacgatgcttatactgctttcttaagcttaccctccaacctgtgtgttcttttgcctttctacttaacttcaaactttgaagaatgtactttatgaagctaagacagtcgctattaaatgataattaagccacattaacaaaaaaaaacaacaaaataacatgattgacatgtaaagatgaataaaagtaaggagaatatgaatttaaaagaaaaaattactgttacatatactgcttgcaatttctgtatttattggtctctggaaataaaaataggtattaaaggattctcactgcgaaaacaaagacaagatggccctctttggggggaga

SEQ ID NO: 18135 - DNA, 404 bp, Homo sapiens
  misc_feature (1)...(404): n = A,T,C or G
ttccgggggnaaaagantgtaanaccacaggnacaaaatggccttgactagnaagatgcatctacaagccaaggaactccacgggtgccagcaaacaccagaagctagaagaggcaaggaaggatagcaacnatcggagaaagcacggccctgccaacaccttgattttggacttctagcttccagaagtctgagacaataaagttctgttagaagacacatagtttttggtattttgctgcagcagcctgggaaactaatgcagctatctaaacttcatgagtgatggaataaattacaacatgtatgagttgattacataaaaagaaacttgtacgcaaaaatagaatacaaaggcttaaaacaaaaataaattggaaaactgtgttctaaaaaaaaaaaaa

SEQ ID NO: 18136 - DNA, 493 bp, Homo sapiens
  misc_feature (1)...(493): n = A,T,C or G
gtgcagcacaaaaccgccttctggctgnaaccgaccaacanacaggagaacatggcttgagctgcaaaaacanaccagagagagaaaccctgggaaactaggctctagcgggtagctcaggaggggaacccacactgcagaggaaaagtaaagaggcctgggtgccgggattaactctaatcatccgtgagactctggcaagacatgcttttcctcagaacctccaaagactggagtgatcaggtttttcaacttttaacaaaggcccagcgtttctaaccaaatataatctccctaaaccctcagtttctcatgcacttcctctttgaggattgctctgctgcctgtttattcctcagaaaccaagtttcactttctgaaatctgttataaagccaggcgacttttcattgttacactataaattatgataccaaataaaaacttctaaaaagtatatacaaggataatctgaaattcgaaaaaaaaaaaaa

SEQ ID NO: 18137 - DNA, 674 bp, Homo sapiens
  misc_feature (1)...(674): n = A,T,C or G
gacttttgagganaaaaactccactcataagagncatttncacggnatacctgnagttccaaagtgcgtcattatacagaatgccatggtcctcgctcttcccatcacagcatggatgcaacacagaaccccaaagtggggcatggaaaccttgtgtttcctcttctcgcttcattcttgtttgtcagtgtagtcaaaataataacattttgtatttgcacaacatatttcagaacagatcttcaaatcactgcagagaaaatcatatgaggttgataagtggtgaatggtaaccattatccttcctccaggagaaaggcatagaacagaatcaaagttgtctcagaatcaacttgtatcagctctaagaataaaactcagggccgggtacggtggctcacccctgtaatcccagcactttgggaggccgacgtgggtggatcacgaggtcaggagatcgagatcatcctggctaacacagtgaaaccccatctctactaaaaatacaaaaaattagctgggcatcatggcgggcacctgtagtcccagctactcgggaggctgaggcaggagcatggcatgaacctgggagatggagcttacagtgagctgagatcgtgccactgcactccagcctggccaacagagcaagactctgtctaaaaaaaaaaaaa

SEQ ID NO: 18138 - DNA, 292 bp, Homo sapiens
  misc_feature (1)...(292): n = A,T,C or G
ggtcgggtgaagatacccaatttaccgcagnacataagcatctgaaagcgattcttgcgtgaaaactgatgccaacactagaatttcctccttaggagatggacatgcacatcggaagacatgtgacataatgagactcaatgtcagcacttctattgactaattttgtgagttttagagatttaatctctgtaatctttaatttcttcttccctataaataatgatcataaaataatgcctattttgagagctattggatgattaaaggtgaaaatgtaaaaaaaaaaaaa

SEQ ID NO: 18139 - DNA, 880 bp, Homo sapiens
  misc_feature (1)...(880): n = A,T,C or G
gggtccggggggncaaaaactgcactcgcgtgtncttgcctgactcccaanaaanatatgacagaagggcaaaaggctaatggagagactgagatggagtctcgctttgtcgcccagcctggagtgcaatggcgcgatctctgatcactacagttcaagcgtttctcctgcctcagcctccggagtaactgggattacagatgcgcgccaccacgcccaatttatttttgtatttttttagtagacggttggtggcaccatgttggccaggctagtcttgaactcctgacttcatgatccacccacctcggccttccaaagtgctgggattaaaggcgtgagccactgcacctggcccggaagtttttcttctaagagaattgctctctattatcgtaatagaaaccacataccttggataataatgcttaatttcttatttttgacaggagcatcaggacttatcttcttttagtccctgggtataactttaaaaatgtaaataaacataaatgggaggagcccacctactattttgttaactttgactcataagttaattgtatctcaagcaactccggaaggatcatcccctctctgacgctatccccagattcctttatcattcacaggttttcgcttgggcggttctcaccactgcatacgcccgacctaccccccccggatggaaaaaaagaaaagaacacggcggtgtttcactacaccctggggcttcagcgcaccagcggtttgtgcgggggggagcgtgcgggacctgagggcggccgggccgtcgaagtccccacgcacgtggcgtgacctccctccaccgccacctcggcgagtccgctggccgtcggcgcagccactatgctcgtct

SEQ ID NO: 18140 - DNA, 384 bp, Homo sapiens
  misc_feature (1)...(384): n = A,T,C or G
tttcnggnnaaggactttctggtgtttctgtaaaattatcttccttggcctttanagaaatggagaataaagaagctttcgtgtttcaggctcacaaagaagagatttttgagagggaaaaacagatggagcaggatctgaccagaaacagtttggcagagagtagtatatctctctctgaacttacattttattggattcacttcagaatgatgaagagtgcatctaacattcagctagaggaatctcaagtgaattttccagatatcaagtgtcagtcctctgagcccaagctaagccatcatatcccctgtgacctgcatgtacacatccagatggccggttcctgccttaactgatgacattccaccaaaaaaaaaaaaa

SEQ ID NO: 18141 - DNA, 510 bp, Homo sapiens
  misc_feature (1)...(510): n = A,T,C or G
tctttggggacggactgctcctttgcaggnaaaacagcctcgcggcctcccaccgattctacattatggtaaacaccagaatgcccataaacccacatcaaataagactcaggaatccactcagaagacaccaaaacggggatactcacgtgtatgcacatttaaaggctggcataaactctccttgaatgacccagataacgtatcattcaataaaccaaccaatcaggaaaagtgctctttctagcaccagttcattaccctctatatagcactggacatcaaagccatggaaacaacacttattttttttaaattcagaaaatgagaaattgtattccattttcatagtttattagccaagcaaatttgataaaatatttggtcattttgaacctttttattcatttgcaaacattgttattttaatctattccttgtccaggccttagggttgtaagtataaattatgataatgcatgtgaaacacaaatccgaaaaaaaaaaaaa

SEQ ID NO: 18142 - DNA, 526 bp, Homo sapiens
  misc_feature (1)...(526): n = A,T,C or G
ccaggttcttctaccttnctgctgggcatccctctatcanaaatattgaccttggcttcagatcacctggaaagctctgaaagacctcagtgcctagactgcagcccagaccaactaacactccctgggggtggtacccaggcatctgtatttttaaaaattctgcatgtgatattaatgggcagccgagtttgaaaaccactgtcataaatcgagaattcagtaattcaaaaataagagttaggaagatgactgtattatggtttggagactgttactatattctgagagggctggtagagaaaaaaatattgttgttcagaggagatcagtggttttatctagccaggttcaaatacaggagcatcatagaattttactaacacagtcggccctccatatccatgggtttcacattcacagattcaaacaaccgtgaaaccaaaaattttttttttaaaaacccataaaaatatagcagtaaaaaataccaattaaaacaatgtgtagtacaaaaaaaaaaaaa

SEQ ID NO: 18143 - DNA, 468 bp, Homo sapiens
  misc_feature (1)...(468): n = A,T,C or G
ttccaatactttcttgcgtctcttttaccccactctganagtcaacaggaaaggatcatgctttgtgtggaggataaagatggaagttttactccaggtactagaagcacctcagaggctcaaagggcggctttaaaaacccactacagacttgggggcttaaaacaactcttctggaggtctgaagtccaagatcaaggtgtccacagggctgtgctccttccaaaagctctagcgcaaaactgactcatgcagtaccgggatcgctgccagagcgacggagcgcgcgagcagcgcggcatcaacaggcagaaagtgccacggggcggacgggacccactgccccggtccagacttttcatccgagaaagaanagctttcagtatccaacttattagaagataacatcttgataggggtctcgggcctttctaanataaatctggcagactgggaaaaaaaaaaaaa

SEQ ID NO: 18144 - DNA, 637 bp, Homo sapiens
  misc_feature (1)...(637): n = A,T,C or G
gggagagccgctctggaaagaggggttggttttttnnaangnaataactggntttctagaacgacacttttcttacataaagggcctcatttcattctttgccaacacgcactattaaactattttattaatacaacacatacatgtactagatatagagcatacggagcacttgaatgaggaccctgatagaacaaccttacataaatgaccttatttattatttacaaacgcctattaattttctgttaactcctgcggtaccatgttaagtatctgacaactgaggagttagtaccttctgattggacaataatgagcttaaagaaaatcgcctctgaactaacataacatgaactatattgaagaaggaacctgaatttttctaaacaaaacgaagcagtgattgagggagagaaaaaaggataactctcccttactgatagcctgctgtgataactacacaatactatttatcacatacttatttcatctcatcctctcaatagttttgcggataaagtagtatttaccatttcataatgaggaaactcacaatattagtgggacctgtggccatagtcctaacattttatacgaactgtgcatttccaaaataaacacttgtaatcgaaat

SEQ ID NO: 18145 - DNA, 1399 bp, Homo sapiens
  misc_feature (1)...(1399): n = A,T,C or G
ccccgggtgcgntggggggnanangnaacgnacgatnaacactcngtggggaantaaaagattgttgcnctcgccttagagntaatgtaanaanctatatggtgtacagtctagctanagnaaacaacttggacgcataggagaaaaactaatttctttacttaccttcagtaaagncncacacatggacactttgtgggcacatgtacaccttcagaggtntttttcttggaggcncacaaaggtttcccttaggacacanctnacgatactntggactcttatcttttgataaagggngtcgtatttagatatatgcttttttacttgtgataaacagatatggtttgtggttcttttgttgtaatgaataaaacaacactcatagtgaagtagatacacaatctgatgtattaaataatgtgtaagataatgtcactatatatgtcaacagatattcagtcaccccacgttctcttgggagacctcagncatgcatgatgtcttatctcatgtgtacagtagaaagagaagcagaanagtatgtggtgcctcatatgctatgtgttcacgctagttgacagaaaagcatcttcaataggaagtgaatattgcatggatgtagttggcgngtgataaataacgaatgttcttattaacagaagtttcgtctaataacctatccaattagtgtgtgaggttttagctacagctgcacaaaggatcaccactgtaagcgaaatccagccgtgttggatctcaagaaacatagagcgcatatacaccatttttattcatgctaagccgatgatacgatcacacgagtagcatgaaatcgaattacgaattagatgatggtgtatacatnacagagcgtagcaaagcatgccactgaggtnatanaggtatcgtagaacgaaatatacatatggactcgtgatgacatcacgtctgttggcgcgacgcgatacgcgcagcgctcaacaggcagcgcagcgcgctatcgacgctttcctactctagtgacgtggcgtnagagattccgattgaantgcgaccacgagcctacacacgcgcgattatgagcatacacccgcatgcaggagcgatgaggaagatgtaccgtnagacgagaaacgaccgagaggagtaacagacgaaggcgactaggagcacagtgaatggaagtaggagaagtcgcgtatacacccgccgaaagcaggtgcactgtcgcgtaacacgcgctccgcatgacccacacctcgagancgctgtatccaatctcgcacacacacgattatcgtattttgactagtccccatctntcttagtntcgtgctcacaccaacctacacagtcgcgcgccgttgtcgccatactacttcacnctaactgcatg

SEQ ID NO: 18146 - DNA, 876 bp, Homo sapiens
  misc_feature (1)...(876): n = A,T,C or G
aatttcggggctaatataaacatcggttcagnatgggnaacaacctagtgtccatcaacanacaaatgnataaanaaatgtgatacctatacacagtggnaataccattcagccataaaaaagaatgagatcctgtcatttgcaaatgtgagtggaactggaggtcactatattaaacgaaatgaaacaggcccagagaaacaaacttcacatgttttcttttatttgtgattgctaaaaactgaaacaaaggaacctatgagttttatagattccctatctaaagataaagagtagaatcaaccttcccaggaaacataatcaggctttggcaggggagtggggactggttaaatgggtataaaaatatagttagctagaatgtatacaatctagtatttgatagtgcaacagggtaactataatcaacaatagtttattatacattgaaaaataactaagagtctaactgcattgtttgtaacacgcagtaagggtaaatgcttgaagtgatggagaacccactacctcgatctcattattgtttggggggtgcctgcctccaacaagccccggaccttattaataaatataccgaccacgtgttgacaatgaccgacacctccgaattttttattaaatgataattctcgtcgcggctttaggtacatacagcgtttacgggtgattcgcccttgtatgacttccccccccggagcgacaacagggacaatccagtgtgtctttgtgcgctgaaaccggcgcaaactgttggatcgctcccacccccttcctcgaccgtgttcacacttggtatgcctcaccgtcttgtttcgcgtcgcctagccgcaccgtccgcctctctctccgaccacc

SEQ ID NO: 18147 - DNA, 862 bp, Homo sapiens
  misc_feature (1)...(862): n = A,T,C or G
ggagagccagccctggaaaggnaggaaacggtcttttttaaaganngtttcgtgganccagcacactttggcatttgttccctcctggaaaaaggacattaaggagaaaaaatttcaaggattttcctaaatctttaactcgttttacagcagcctattaccaagtgctactgtgtatattggcttcatttggaacattgtcttacctacatttgacacttaataactttggtgattaattgattgactgaatattcactggnaaaaagagtaataagaggtaaaaagtaatngttgagcacattttaagacaacgtgattaatgttctttgtagaaacttaagaggatccaacagtccacattcatagaaatattgtaagaaacagatgaaataaagatttatgaaaagggtagtgttttgtgtattaagggtgttacttagatatctaggtgaatgtagtgtgggtctggctcattgatgagatgataactgagttgttgggactagttttgatgataaaagttaaagttgttttgttttttcgaataaaaaaaaaaaaggtggtaagtggggtaaaaggtggagattagtagatgtttgttttaaggagggtgacaatttgagactaggtncctacatggggtgaactcggaagttgtggtgtagggtggggggaggatagtgcgagaaaggagccggatctagtggttgtaaggtgaggagtgggatattggggttagtatatgttttagtgaacggtaatagggtgtaggtggacggaaagaggcaagggcaagggtggagagatatatggctcccttagagtaggggcaccaccccctcttccccccccccccccc

SEQ ID NO: 18148 - DNA, 821 bp, Homo sapiens
  misc_feature (1)...(821): n = A,T,C or G
ggttcttgtggnnnagcactaacttggtgtgncatatacccggtcctttgggctttcactttagtcacaaagacaaatttattacagcaaaaagtgccccctactcaaaagctgttcaactcccagcaagactccatatgaatagaatggatgcctgaattctgcttcttgagcaacacatcttgaccactgtggactgagagagaagagtggacatcaaggtgattggctgagtacaacagaaaggaggaatggagttgtttacaaaccaagccactggattggccatcattcctatggaaagttttgcaccacaggtttgcagctattgaaagaccattctgattattgcagaatgattagcacataggcttttgaatcaaattgaactgggctctgccctttattatatgtccttgggcaagttacttaaccttgctaagtctccattttcttacgtgttaaaaaggaggataatattagtaattacctcataaaacaattgtgaagattaaatgcaatagcttgtatgaagtgatccttgtttagcatcctggttcataataagtactccagaaatgttagctgccatcaatagcgcataattttaaagaaatgggcatttttttattactggaattgctgcaaagatgacaaatagacatccttccttaataaagggatgtgattcgtttacaaatagcagcacacatttgcatgtagacaatagtgtgataatattcttaaatacagtttgttcagtttgttcttctaagagaataaaacacactgcttcccgttgatcctgaaaaaaaaaaaaa

SEQ ID NO: 18149 - DNA, 632 bp, Homo sapiens
  misc_feature (1)...(632): n = A,T,C or G
ttttccgtgganacagacaagatgtaatcaggactccagctctcctcaagnatctcaaggaacactagctcctgcaaggactgagttcaagacttacctggaatgtatggctgaaaggctggagatgccacatcatcaatatccctcatccactatgaaagaaccaaagaacaagtatttaatggaaaaggtaaacatcgttgaaagtcaaccttcttataatgccagacaaaagaaaatacaccaatgctgttgttatttgcagcacagtcaaaacttcatctggcatactctcaaccagaaatatctattaatatttgagtaaacagaataccacacactcttgactcacatggctgagaaagtgtttacaatattttatatccaaatccttaaaatttgagtggcaaagctcaaattccctttgcgggaggacctgaaagagtctaacatgaaaatactgcattggagtttattctataatacaacaacagagatccatggctatatgcaaaaaagactgctaagatctggtggcacttagaagtacctagaacagtgcctgacatatgaatacttattgagtgaatgagtaaataaaaatgtaaagcttttatttaaaaaaaaaaaaa

SEQ ID NO: 18150 - DNA, 936 bp, Homo sapiens
  misc_feature (1)...(936): n = A,T,C or G
aggcggcgcccgcttctggcacaagcagggactccggtccttttgccctggcctgtgctgagtaggtactaacactggttatattncttctncagnagtctggnaccagcagcaatggcatcatcagggagcttgttgngagtacagaatctcaggtcttacccaaaccaatggagccagaatcttttgttttgttttgttttgttttgttttgttttgtttttcaagatggagtctcaccctgtcacccaggctggagtgaagtggtgcaatctcagctcaccgcaacctccgcctcctgggttcaagtgattctcctgcctcagcctcctgagaagctgcataccaccacacccggctaatttttttgtatttttagtatagatggggtttcaccatgttggtccggctggtttggaactcctgagctaatgatccgcccacctgggtcttccaaagtgctgggattacaggtgtgagccaccgtgtccgggccagaatcttcctttaacaagatccctgcacagcttgtcatgccctttgcggttttccatctcactattcttctctctactcttactatcgccgatcccttttgctctgttacttccttgtctgtgcagccagcctatttccgccttagctgacattttccacggttcgtcctctcgccccttccgccccaatgtcttttccattcgtatttgtcagtgggggttttaacccccctcctactctttccctcctcgtgtgcttgttacctgcccgcgctctcgtctatcagttctcggttcccatgtctgttttatctaactatacccccgcgtatcatgtcaccgctctttccttcacttttcttccttttcctcccgtgtgccgcgaccccccggtcgttgtgtccctctctacccccctctttgtccaccccgcgcgctg

SEQ ID NO: 18151 - DNA, 531 bp, Homo sapiens
  misc_feature (1)...(531): n = A,T,C or G
ttctagctggnctgcatggcgncgactcggctcagtgcaacctccacctcccgggttcaagtgattctccagcctcagcctcccagtagctggaactataggggcccaccaccatgatcagagttgcgaagactttctgatgaagacatgctcaccaaccgagaaaagtccttcccagcaaaggtatgctgttcaatgtttaataaccagctcttcatggagacggggaagtcctgatctgcagaacttgccaatttctttggtgtgaatattcctgttataggtgattgcaagtgagtagctcacaaaattcctggagatttaataattggctctaacatgcagttacagaatagctccagtataccactaaaaataggtattaaatttgttttatatattatagggaagatccagtattctttaacataaattgaaactataatacaaattcaatggccattcttctaatatatgactacgtgtatacacaaataaatgaacaggtgtgcagaaagaaaaaaaaaaaaa

SEQ ID NO: 18152 - DNA, 497 bp, Homo sapiens
  misc_feature (1)...(497): n = A,T,C or G
aaaagtccgagtcaaacagagtagctttcgttttgcttgaaggccacgaaataacaccgaaatcttactaccagcatacctacaatgaaaaccgtatatatggcagaggacaatgacagaggagnctcagnatcgtggcaccacagacgacggaaaggacgaggagtgcagaacgctttaatgttgaaatacttcacacctgcattggctttgcgctttcactattgagaaataatatgcgctgtagaagttttatgatcatgttaaattatgtgttaacaacactataggtaactcttttggaatgtccttttctctccaacataagcggatatttgaaaaatatttggttagaaaaattaaaataacctaaatttaaaatccatgtacaagaatgacaaatacacacatgatagtggttaaaagcaaaacaaaactaaaatagaatttctctcagaaataaaccatctccactgtatgctttaaaaaaaaaaaaa

SEQ ID NO: 18153 - DNA, 847 bp, Homo sapiens
aactcagtattacaatccaaaatcgcgccgtcatcagccttcactgatctcctaagacactctcactactgctctcctactggtgcccaaaacaatgccacgttatagtttttgttatgtttcagtgctgcaagtctcagcaaggcaaggtacttctatagaagtgtgtgcccttacagatgaagcaatggtgaagacacagtgagaggtggcctttgcgagccaggaagagagctttcaacagaacccaatcatacaggcaccttgatctcagatttccagcctccagaactatgagaaaataaatttattttatttaaaaaaataaaacgtatagagagcatatgaggcatatagaccttgaaagacattaaaataaaaaaaaaagaaaaaatataaattggggttttttgggtttaagagggggaacttgtgggcggtttccttttagggggggtaaattattgatcttggtacattaattgtttacctctgggacatttggttgggggaagggtttttatctatttaaaggggggagtatggttttccccaaaattggggggtacccccggaaagaaactggtgagaaaagggccactatagggccgaaacccataaaaggcacgaatagtgggatatttaccacgggttgcgccccctgaagaggtatcaaaaaatcgggtgttagttcggaggggggggaggccccgcggggatttaagaaataccaaggaatctcccccggaaatatactttatgggggcatccttgtttcggacctgcgccccttccggatcctcgcctcgctttttgtccttagcgaaaggtgtcccccccccccccc

SEQ ID NO: 18154 - DNA, 525 bp, Homo sapiens
  misc_feature (1)...(525): n = A,T,C or G
ttttcggggattcaacctgttgtccagctggnatgcaatggcatgatctcagctcactgcaacctccgcctcccaagttcaagcgattctcctgcctcagcctcccgagaagatgggattacaggccctgaaatttacgacaagggtccgagcagctggaccttgcttcctgaggaaggattaacatctgagcacagagcctaattaaggccactctacaccaacactgccgagtggaatccagctatgctaggcccatgtgtttcccaggatcctgtctttaggtggcttcattttttattttgagggagggtaataggtgaatacccacacgtagagtttcggatctaatttatatctgccatatgacttttctctgcctcccaagattaaaaaaaataagcacaaggattatagagcaactgcatagtcatgttacaacttccaggaagaaatctgtttatccataacaaatctactgcatggagtaataaacatagaaaataataccgaaaaaaaaaaaaa

SEQ ID NO: 18155 - DNA, 414 bp, Homo sapiens
  misc_feature (1)...(414): n = A,T,C or G
ctttcggtggttttatgtttggctgccaanaaaggaaagtttcaagatgggatggtcggctgtcttgactgcttcagaagggctgtgagtgttctccacgtggtcaaacccaaggaacaattttcaggccttttctactgttcaaaatcttgtcagaaaaagtttgttgagaatgagggtaaaaattgaagacttggaattgagggaaactactttttagagaaagaatatagaagagcctgttcatataataatgggaaaggtacgtgaagtggggaaggttgatgatctgganaaataaataaaggaagcataaacttttggaaaagatggggacaggtggagaatttctgacaaaagatcactttttctgttctaatggaaaagaataataaatgatgatgataactgaaa

SEQ ID NO: 18156 - DNA, 603 bp, Homo sapiens
  misc_feature (1)...(603): n = A,T,C or G
gggcgcgccgcnatggacagcggttttggtnttttnncgccaaacggggacttaacccctcgctgggtttactaccgtacagacacttctacctcaccagcagnaacaggagcaacttcttccatanattcttcaccagttttccttagctgtctccttggnnaacatttgaaatcctctggttctttggcacccaaatatgaaggtcatttcatcaaaggcctaaaattttcatagagaggatttgagaaaggtgatctcaataaaatacagaaaaaaaaaggaagaaaagctacagtaaaagaaatattgctacttatatatgcaaacgaagactgaggacaactattatcagctttctactcttaagaattatttaagttgctactcctacttctacatttggacattggtttaccatgccatttttccttatatatatttaaaaaatctcttaaaaattaaaatggtagtatgcatgttttcaggccaaatatatatttccaaactgttctaaatttgttactactgtgtttttacccctgagtaatcaataacattgagtaataaagacagaattatttatgtacaaaaaaaaaaaaa

SEQ ID NO: 18157 - DNA, 620 bp, Homo sapiens
  misc_feature (1)...(620): n = A,T,C or G
cgggagggccggccctggcccgccgggttccgtttttttaaagcctttttcgggntacatgcggtggtcgtttaaggtatccaaaatccctttcccatgttccacttttctatgacatcctccctttgagtgtagctagcacctatgacttgcttcatctaacaaatagcatatagcaaaggtgatgagatatcactgccatgattatgttacactatataagactgtcttagcagcctggagctagagacttctcttatgagtttgatgaagtaagcagctgtgttggagaagtccatgtggccagaaactgtgggtgactctgcaaactctggacagtctataggacctgagagtggcccatagccaagagccggcaaaaagccagagccctccattctacaacctcaaggtaataaattcttcctacaacctgaatgagtctggaaatgaactttaccccagtcaagcttccagatgataatgcagcctgtctgacactttgattgtaagcttatgaccagagcagaagactcagttaagtaacacctagattcctgacccatgaaaactgcaagataataaatgaatattgttttaagctgcgaaaaaaaaaaaaa

SEQ ID NO: 18158 - DNA, 476 bp, Homo sapiens
  misc_feature (1)...(476): n = A,T,C or G
tttccagtactggatacagnacccgctttctcttgacttccacagcaaacgtgaacagctgaacaaacacacagtccggtttcccgagaccaagggtcaggggaaacccccgctgaaaacgtgcatcagtggaacaactactctcttccaggtcccaccgagggcaaagaggagaaatagaatccctcacaagaaatccacaacttctagaaatccgcagcacacacagaacacacttacctctcacagctctacggacacttcacaccccacagtgggaccgtctgattgcatttgcattttgggacatgtagtccagaaagcttaaatgatgcgagaaaaaccacaagtcccacaatcctccgcgtctcgcaattgacagccccagatcatccaggaacgccccctgtcggctctttctggtcagaggttcccccgttaatataaaagcttttaatcatggaaaaaaaaaaaaa

SEQ ID NO: 18159 - DNA, 610 bp, Homo sapiens
  misc_feature (1)...(610): n = A,T,C or G
gcggagacgccagcccctgggaaagaaagntgttnggtttttttttnnnngnactaactgagtgttgagaggaccntactgtttaatgnnaatacagttcagggcaagnaacgggcaggtgaaaaaggcagaagcagaaagtgaagtgatgaaactgcaagtcaaggaattccaaggattgctggcgaacacaggaatttaggaagaggcaagaaagaattccttcccagagacttctgagggaatacagccttgccgatagcttatttcagccttctagatttcagagctgggagagaatgaatgtctgttgtttcaatcttccagtttatggtagtttgttcctaggaaactaatacgtatattgtttatctttgaaaataggtatttgagaacatttctacttctctttgactaggatattttgtaaaattaataaggaataagcactctttaatcaaataagttttttgcatcttgcttgctaaaatgtatgcattttttaaaaagtatgtattttagttttaaaattgtctgtatatgtatatgcacatgaatttaatattttatataaatccataaatgcaatcatgttacaaaaaaaaaaaaa

SEQ ID NO: 18160 - DNA, 487 bp, Homo sapiens
  misc_feature (1)...(487): n = A,T,C or G
ctttccgactataggctactgggnatgtgttcaactgnatgnaaaactcatcatctttctttgagatcttccttgctttctggccaaagaattattccctgacccgactttccaaaaagtactagttccttttagcagtgattagaaacctgatctgagtactactgtgtgtgcttgtgactagtgtggttttattgtttctatgtcctttcagcgagcagatctacaatgagggatacatctaaacaaaactccatattaataagtccagttgaaatctaacaacatagggttctttcgcattctcttgcattccatatttgtatattcgttcacccatggtggcaaccctggctattagaaatataattgtatttattttgctgtatcctacaataaaacaaaaaaattaagaattactataccaacatcatgataaaaatacacatactaagtaaatctgttatgtaaactaaaaaaaaaaaaa

SEQ ID NO: 18161 - DNA, 517 bp, Homo sapiens
  misc_feature (1)...(517): n = A,T,C or G
actacttggggnagaggctgatttttaaaggtgcaaaaggcatttaaaaaataaaaatccatgaaaaacanacataaggggaaaaattcagcatggtctctacaataatcatcactttatattcatcatggcattgccagtatttatgaatatggacatgtttgaatgcagttattaacagggaatgtatactatttgtcttcaactttaaaattttgacagctggcaggcgcggtggctcacgcctgtaatcccagcactttgggaggccgaggcgggaggatcacgaggtcaggagatcgagaccatcctggctaacatggtgaaaccccgtctctactaaaagtacaaaaaattagctgggcgtggtggtgggcgcctgtagtcccagctactccggaggctgaggcaggagaatggcgtgaacccaggaggcggagcttgcagtgagcccagacagcgccgctgcactcccgcctgggcgaaagagcaagactccatctcaaaaaaaaaaaaa

SEQ ID NO: 18162 - DNA, 620 bp, Homo sapiens
  misc_feature (1)...(620): n = A,T,C or G
ttttccggggagaagaccggaaaangagacttcattactttngctcatgnagnaaccaggcagagctaccatctgcagcggcataagctgtgtgccacatgcatccagagtcatcatcacatatatacagtggacacaagattccacgttcatgccttcaattagtacattttgctgcctcttgtaaatggcttgtcaataattggaaatcaattccattactacttatgacatattacttttagaaacattatgggtcaaacctccaaaggtttatttggtgcctcacaaatttcctggtatttcagtaaataatttcctcctttcatgtgcctgatgctatgaagttacagttattctgttatatacacaggacatgactattaataaggtagctgattgtcacatatatgtcagaatttcttcatatttttaacttgtatacattttcaggcacgatttgaagtatcaaatatgatttaaaatattttttatggaaatgtgttgattttatgttctaaatgcaatacatgacacatttaattttgttatcaaaaaaactcataattttactgctgatgttaataaaagcttcacatagaagaagaaaaaaaaaaaaa

SEQ ID NO: 18163 - DNA, 331 bp, Homo sapiens
  misc_feature (1)...(331): n = A,T,C or G
cactcggganaagaacagcttatcatggcctctgctgtctttattggctcttgttttttggaaagctgagtctcccctgtgtctacaagtattgcttttttgccttttaaaaactttaaattatcattttggacttacagttacctggattctgttttgtgaaatgcatcttattaaaaatctatttgcctccattgcatagaaaggcccagcccatctgcaatgctacctcctggaatgggataaaactttaattgaactgatctattctcagaactaaaaacagaataaaaaatatgggatggaacattttaacttaaaaaaaaaaaaa

SEQ ID NO: 18164 - DNA, 579 bp, Homo sapiens
  misc_feature (1)...(579): n = A,T,C or G
gccccgggcacaccgaacaggcggggccagaccctgccccgagggtgttggttttttganngnttactcgttcaaacaaccccttttccgcccagagaacaaaacacaatgcatacctgtaggacagccagtagcttcccctggggctgagggccagtgcctagcaggttcaaacagcagcgacaaccctgagacccacctgacgaagaaaacagagacacccacagagatctcctatgcttggatgcaaaaagtggaaactttagacagatcggcagaccctaactgcaaaaacactacatgaaatggaacactgacctgaccagaagacgttacccacgagatgccgaaggactgctcactacacacgagactcactgtgtaattacttagaaccaactaactggagaaacaaatgccagaacctctaacagtacatgagtacttggttagtatgggataaggcacagcctctaattcctctgcatgaaaaaagaggccacggtgtacaaggaagacgtcatagacgacaaaaaaaaacggaatggcattttttaatcactgacaaaaaaaaaaaaa

SEQ ID NO: 18165 - DNA, 386 bp, Homo sapiens
  misc_feature (1)...(386): n = A,T,C or G
cgttcnggctaacagcatgctgcctctaaggnaatctctggctaacanacaatcacctcctcaagtatcaagctttgctgctacagggatctacagtccagttaaaaacctgcccttgcctgaagccagccgctatctcccagagaaactggaaaacctaaacatgattttgaacaagtggtggtgcatactgatataagaaatgcaaaagattgcaatagtataaaagtgaatcctcccatatacacactaaattgttgaatactttagtattgtgaaagccttagttgttaataaaattataagtttgtgagtcaaattttaaattgtatttttcatttatgtgcatttataataaaccttcttagatagcaaaaaaaaaaaaa

SEQ ID NO: 18166 - DNA, 456 bp, Homo sapiens
  misc_feature (1)...(456): n = A,T,C or G
tcctctngggaacctncgctctttttcagngagccagngaggccatcagaagataactcttcagctttctgcttccagccaatatggagtaacagggactagaggtacccttctatctgaaacaaccgaaaatctgaaaaaactatgaaataatcatttcaagacactggacaacaggtggagacaaagctatatcattcaatcctatgccctttgttaggaaatatttactttttaaatggaaataaatattgtccttgacaagagtgtggcagccattgggcaagtaggatggtattatttagaaaatgttgatgcttaacaacacaaaagcctggattttttagttaccagatgactaatatttgtttgttcatttttgttctgttttgttttgttttgtttttttcattcctaatgtcataaacacaatgccttatttcaaaaaaaaaaaaa

SEQ ID NO: 18167 - DNA, 624 bp, Homo sapiens
  misc_feature (1)...(624): n = A,T,C or G
gggagagccagctcctgggaccgaagagattatgttttttaannnggcaacatcgagttaaacacacanacttggncagtttgtaaacttagtggaaacaaaagggacaattgaagggaaaaatgatatttaaggacgtgcataatattaaactagatatacagcagactatctccaagagctcctgagtataatgccttaattccggaacattgttgttacctctattagacgcttattaacttggtgcgataaatgatgactagatcaaccactgtcaagaagattaataagaccgtaaaagactgcgttgagcacattttaaaacactcgaagattaatgttctttggggaaacttatgcatgtatccaactgtggcacctttcatacgaaatctttgttagtaaacacactgatttgagatttatgaaaaggataatgtgatcggtattaacgctcttcacttattacctatgggctagtagaagaggcccaacctcatagatgactataaaactgcgttcatgtactcctttctgctaataaaacctaatcttgttttgctctgtctgagaagaaaaataaaaaacggtctccttggcctaaggggaaggaatgatcct

SEQ ID NO: 18168 - DNA, 511 bp, Homo sapiens
  misc_feature (1)...(511): n = A,T,C or G
cattccgaggtagnaactaagcccgtaaacttgcctggnaatttaacaacaacagaggagagctcctttatcatcaaaagccaaaaaagcaatgcagtcttacttataaaagttacacctgcaaaatgggactgaatccagtgaggaaggacataacattttgcctgaatgtgcaaaatatgagtggggtgttgtctgtatccctgcaggctccgagcagcctagtgggtaaatgagcgtttgtttcctgtgcaccatctttgagttgaaaatgagtcacacactcgtggaaagaatagtactatcttcttttgtctagctctgcatgcttttgtggttactgaatttgtcttaatgggaagcttgattgtttctctttttgaggcaaaccattagaatttatttttaatctggaataagattactttaaatatattattctcgattcataactggattcacagccagtgtatacaattacagaaaatttatatggggaaaaaaaaaaaaa

SEQ ID NO: 18169 - DNA, 450 bp, Homo sapiens
cactcgggtggagaaccggtttaggactatggttggagatggaaaactattattaagagcaagcaagcaatcagtgggaacaaaacagccatgaagatcaactgtgttcagccaattgtggaaatttggtataaattaaaacaccattaaaacagttctcagaaattcacagctaactagttcaacatcaatatcagttacagacgttccaggatctaatattggaagtgcagaacgagaagtctacaaagagaaatttttggacaaagtacgtgattgtattgtaagagtagtgtactcactgcatagagccatggttattgtaagaatgttgtaactgttatttgtcattccttacaacatgaaacaagctcccactaaatatatctgtaagtgttaacaagagtatgaaataaaacccatcattctttagaaataaaaaaaaaaaaa

SEQ ID NO: 18170 - DNA, 774 bp, Homo sapiens
  misc_feature (1)...(774): n = A,T,C or G
atctttgggatnattaccnagttccagtctcctgtccaaaatccccaacactggcatcgactgcccagcaaaatagaatgaaccccttattctcccctctggaggctaagttaagaaaagtgaagaacttcgtttggttattcagtcagttcaatgaagcctagagtgaagaaactaaacatatatatatatatatagcttctgttagtcctcagcattaaaagttagcttttttgtaaaaattcttcatttttataaacttctgaaatgtaatttaaattttcctctttgttggtcaatattatctaatattagctaattatgttactttattagcaatattagctatttgtgttgcatgattagtcctttcattgatatcacattttttcaagttacagacttatatctgtatctggcatctgctatggtttaaatgtttttgtctcctctaaaattcatgttaaaacttaatttttaatgcaagagtattggaggatgtgggtcatgaatgggatntagggattaatcctttataaaaggacttgatggagtccctgtaacagttggaagctacctctttgccctgctgccttctgccatgtgaggacacagcattcttctcctctggaggatgcagctttcaaggcaccatcttagaagcagagattggaccctcaccagacaacttaacctgacagcgccttgatcttggacttcttagcctctagaactgtgagaaataaatctctgttcttttgaaaaaaaaaaaaa

SEQ ID NO: 18171 - DNA, 507 bp, Homo sapiens
  misc_feature (1)...(507): n = A,T,C or G
gcggggagcccgctcctggannagaagtntngggtttttttnnngnactacttgttatttttgacaagcttcaggnanactacaaccaaataccaggtttgttttttgatgaactaggagaaaatagagcctccatctaagaacaagtgcgtaatattccagaatgagtgaagagtccagagaaccttgtggaaggtatcagagatgtcttcagagaaagactcaaatagtagtcatcaaaaaagatccagtcaaatacaaatctgaagtgcaaaatccaaaccatgtatttacaacagagagaaaggactagatgaactgatggcaacagccgttaaaatcctgtttagtttcagaaagagactttgcatatccaattaggaattacagagaaaaattcatattcacgaatatattctatctctatggagggggagaaatgttttgcattgaaaataacaacagaaattgtaaaataaaaacgattcatacagaaaaaaaaaaaaa

SEQ ID NO: 18172 - DNA, 895 bp, Homo sapiens
  misc_feature (1)...(895): n = A,T,C or G
aggagggcccgccactggaacgcccggctccggtatctttccccgccnggttcgtgagataacnagtttgtctcccatggnagaagagctcgctcacggccttgctgacccacaccagatctgattgataacctggtagctcagctggcagagatccggtgtgccctggaaagacagaaccaagatacgagatcctgctggacgtcaagtcccggctggaatgtgagattaccacataccgcagccttctggagagctcggatggcaaatgaatattcctggtgaccattaccgatgtttncccactgagatgaacgtntggattttatgagcttgtacaaaacaacccaggctcctttggaagaacttntggttaagctgaaaccccttaaccctatctagccactagttccttgagaccaacagaggcatgtacacatgtatgttttaggatttttttttaacagataaaagttataatttttagaaaagaaaaaggagaaaaaaaaaaaataagaaaagatagggatggtggtaaaagtgaaaatgtagagggaaagagaaaaaaaaaaggggaaaggtttgtaatgaagggaagaaagatgaagggaggggtatgggtatgatgatgggtaaatttagaagagaaaaagagaaagatgattaattaagaggaagaaaacggaggagggtgaagaaggctgggggggaagggcgatattctagttaggatgagcgggagaattagttatctaatttgtttgtatgtagaaataggtagagaaaggacaagtataagagcagtaattatgagaggcagaaagggacacaggggatgtgagcgtcgccccctcgcggaaatcggtgccctttcccccccccccgtgttcataat

SEQ ID NO: 18173 - DNA, 344 bp, Homo sapiens
  misc_feature (1)...(344): n = A,T,C or G
gggggccgcccggaagaaggttggtttttnnnngngactcggtgccaaactctcttgtttcctctgtggcaaactgctcctggtgtcctctgcactcagctccagtccctctcctgtgaaaccttcccctgtcaggaggtctttggggaccactgaaccaacgctgctcctgtcaaggtcatcagtcatccccatgttgctgcatcctgtggtcaatatcagtcacttcccaggccccatctcacttgacccatcacagaagccttcgactctgttgatatttgtaccatgaactttattccacaaataataaagaaaggttttgaaaaccaaaaaaaaaaaaa

SEQ ID NO: 18174 - DNA, 515 bp, Homo sapiens
  misc_feature (1)...(515): n = A,T,C or G
gggggagacggcctggacagaggtttggtttttnnnngttcacctgttctgcagcacttcggagaccatcaggacaggctggagactaccactcacattaggcctgctggcacccggatcctggaacttgccactctgcgaactgtgaagaaataagcttctgttgactatgccaccctgtctatgggattgtgttacagccaccctaacggactaaaaagatggcactgttgtggagattgcgtgctgcatacccatatgggcctcgagttacaccattatgtattatacaaagaatgggctgtgatcgaataatgcttgcagcactgccacgcgcgctctccttgcagggcaacagctgccatccctcccattgaaggggacttgaattgcactctcctacaagaccgatggtctctgggacttgcttgaccaccagagatggatgaaggcgatgctatctgatttatgaggtaatgaaggtacatatttctatcatgggaaaaaaaaaaaaa

SEQ ID NO: 18175 - DNA, 474 bp, Homo sapiens
  misc_feature (1)...(474): n = A,T,C or G
ggcgcgcgttctggccgccggatcgtttttaacggngctcgggtaaaacacccttttgcctgnatggttctttcgtcccactgcagttgattgatggcatcacatcgaagacactctggggggagctgtttatccccatcttccatctggagctgctgggatagagttcactgtgatgatggctactgaatgagctgcactggcaggacctctgtgacaaaggaagattgcggctagggagccaggccccgaatcaaaagatgtcaaggaaatgaatggagctaagcaggaacagccaactcttctcanacatgatggggcagcaattcaaaaagaaagatggtgcacaagcttttaaaaactacaaaatgggagaatattatgttcctttgttctttcacttacagaggttactttatagatatgtgtttcagatcaaataaacatgctgctaacaactgaaaaaaaaaaaaa

SEQ ID NO: 18176 - DNA, 691 bp, Homo sapiens
  misc_feature (1)...(691): n = A,T,C or G
gatttcgggaaataaacgcactgtaccanagnacccatgcccanaaaccatatcagttctatacagatacaaggtgatgctgattatttcatcaaccatcttggagttcccatcgtgcagtttgcttacgaggacatcaaaacattagaggctgaataggccggacgcggtggcacatgcctgtcatctctgccctttgtgaggctgaggcgggaggatcaccggaggtcaggagatcgagaccaacctgaagaacatggtgaaaccccatctctactaaaaatacaaaaattagctgggcgtggtggcgagtgcctgtaatcccagctactcaggaggctgagatagaagaatcacttgaatcctgcaggcgaaggttgcagtgagccgagatggcgccactgcactccagcctgggggacagcgtgagactctgtctctaaataaataaataaataaagcctgaatacaagacaattggattttcatacctgttcctgcattatcttttgtaatatgttgttttattgtaaaagtatgaagaaaaatctgctccaatattttattcatataatgacaagtatttttctttggagctacattgaaacttaatgagtattagtttcctaaaggttaatatcaatgtggaatcttaatccatcttaataaactntttgtactccacacaaaa

SEQ ID NO: 18177 - DNA, 340 bp, Homo sapiens
  misc_feature (1)...(340): n = A,T,C or G
gggagtgccagctcntgggattggaggntttttggttctttttnnnganccataccggntacnntatgctgtcgtcangggcacatnaagtaagaacagagctgttaataaaaagtcaacaacaacaacaacaacaacagatgctggtgaggctgcagagaaaaggaaatgctaatacactgttggcgagaatgtaaattagttcagctactgcagaaaccagtctggagatttctcaaataacttaaaacgagataccatttgatcaggtgatctcattactgggtacatatccaagagaaaataaatcattcatttgttctttttaaaaaaaaaaaaa

SEQ ID NO: 18178 - DNA, 427 bp, Homo sapiens
  misc_feature (1)...(427): n = A,T,C or G
tttcggtcctcccatgcggtaccanatgacactttttaaaactttaaaaagatcaggttcctccctcaccctccaggtgcggtcaccaggtccttgtccacagtttagtacttctctctcctgcctttttcccagacttcctgcccttgggtgaaccagctgccatattattaggactctcaagcagccctatggagatgcacagaagaaactgaggcctcctgccaacagccatgtgagtaagccagcttgaaagcagatcctccagccccagtcaagacttcagatgactgcagtcccagctgacagcatgactgcaactcatgagaggatccaagccagaactaactaagctgctcccaaatttctgacccatagaaactgtatgagataataaatgttcactgttgcttgaaaaaaaaaaaaa

SEQ ID NO: 18179 - DNA, 575 bp, Homo sapiens
  misc_feature (1)...(575): n = A,T,C or G
ggggggcccgccccggaccgacgagtttgtttttttnngatttctcggcaagaatccatttgtcgccaactanatacatggcgcgaactccgctcactgcaacctccgactccctggttcaagcgattctcctgcctcagcctcccgagtagctgggattacagacatcattaccatgttctctggaagaatctgggaagccggatgccaaccaggatccctacaattcaatcatcagaatctcaaacatcaccacccatcagaaaactttaatttcataaaaattgaaaaacgtcttgctaacagttttttttaaagcaatggaatatagtgtatgtttcaagatagctagaagagaagattttgagtattgtaagaaatgataaatgtttaaagtgatagatatggtaatcaaattacctcagtttgtttgattattacactatgaaaatatgcattgaagcaccacgttgtaccccacacatatgtacaattactatatattcattagaaagaaaaaaattttaatgataattttaatattaaaaaaacctcaacacctaaaaaaaaaaaaa

SEQ ID NO: 18180 - DNA, 458 bp, Homo sapiens
  misc_feature (1)...(458): n = A,T,C or G
acaaactgtgagtaancactgtcttctatcttgcttggnaagaaaaaaatccagcagcttcaaacttagtatccttgttaggtaaaatccaaaaaaagaagaatgtgtcaattattcctagaagtcacatcatttcattaaagacaagtcacattaggaagatacaattataaagagttggaacgctatccagttgattgaatcaatagatgtggaacccatggatacagaaggctgactgtacagaatgtgaccatgtatttcctggacccaactttgtaaaagaatgtttatttaaaattctcattttctgatcaagagagctaaaatatattgaagtgtgaaataaaaataaattatatgtttgcattcattgtacttctatataaattatctaaaaaaagaatgttctacaacagtaaaatcaataaaatgcgttttatccaaaaaaaaaaaaa

SEQ ID NO: 18181 - DNA, 617 bp, Homo sapiens
ccactgcggaggaggctacacggcattgctctcatgcctggtagatgtgaatgagcacgtagcatgcgcatcactgtctgctctcggacctccatgggtctcaggagatcctcccacctcaccctcctgggtaggtgggactagagagtaccatttcttttcttctgtaacacatgttttaatagatgataacatgattgactaccactatatcaaattggagttatactaacagagataagatgaagacggccgaataaacactaccaaaaggactgagattacaagcatgaaccaccgcgccccccctgacataaagcgattgttattagcagaagcataaaacccaataccacacattacacacttataccacgtactaacaccaaagtcacactggcgtaaagatgacaacaacagatagtgaatgctacccgatgactggctgaaacaccacctataaagatctatgcttacttcctgcgagacatgagtaatgagaactccataccttgacatttctcatgatgcccatactcccaacctacacatgtaccccgaacctataattactctggaatagaaagagaaataaggatctttctacacaaaaaaga

SEQ ID NO: 18182 - DNA, 878 bp, Homo sapiens
  misc_feature (1)...(878): n = A,T,C or G
cactgcnagggagananaccanttttaggacattaanctaccataagnaaagnaaacaggaggattctcttcttttggatcgtatggtacagatgccgtgtgaatgcctaatgagtgggatctgaacacaactctgctaataaggaagtctccaaaatgtagttcctagctgtccagttcctgtgattcttgaacagttgttgaagaggatgagtatattgttgaatgccaacacatagttctgttttccttcacagagacaatatacatggggaatcatccccaaatagaaagaagagttgcatgctgaaccaaaagattacagcagtgtacataacaatgtaacactcaaaagttctttatataatatgtgtttctaaacagatgaaagcatccaataaaaattgatttttaaaccaccacgttaaaaaaaaaccancaggtatgtaaaaaacaaagatgtaagtaaaaaatccccgtcgactactcagacccctctgtcattgggcctgccccccctggcaagagcgatatgcgcttccatggtcttctggggggccgctctcgcgcgcctcccttttttgtggggggggctttacctgctccttccgctcttctacggtgcgaaatcaagcccctcccccccccctttcgcgcttccccgttctccaacacggccctcgttatcgcgccccccgcctttccgcgggtgcgccccgttgtaatactgccgtttcctaccctcccccctcgccccgtgtgccccccatcttgcccccgtttttatgttcatttcggacatccgctcgacgccccctacgcggctactcaccgcatgtaagtcctgccccgatacaactcacccgccccccaccccg

SEQ ID NO: 18183 - DNA, 754 bp, Homo sapiens
  misc_feature (1)...(754): n = A,T,C or G
cctttcggagtnccgggatgcanaagtaaactccttantaaagtttctcaagtaccagctttccgagtactattcctctctatgtgaaatctgcccgtcacccacacctatcatatgatgttgggacagaggctggcctcaaactccttggctcaagtgatcctcctgcctcagcctcctgagtatctgcgaccacaggcacatgccaccatgcccagatcttcataaatttttaaagacctcgaaagatatctactgtagaagactcttagttttttttaaaaatttttttaattaaaattattgaagtgaatagtatacactctgagttaacttgatgtagtataaccattgtgatagtatttctaaaatatgctatggaatatgttggctaattaagtcttacttattatttacctgtggcaatggcaatttatttggatttgtgagaaaaaaaatttacagtgtatgaaagttctaacatatgctaagactactcctgctccttcttaaccacaaaaatttaatgtaaggtgtttcaatgggaattccaccagcctcctccagctaaatgtttttcttctaaaacactgtttntagggaagtttccattaagatgggttgaggtagaattaggattaaaataataaaccaaaaaaactttatgcagaaaaagtgaaagctaagggaagtccagggtatgtcaatgattgccgaataaaagaagaacgggaatgtgacaaaaaaaaaaaaa

SEQ ID NO: 18184 - DNA, 413 bp, Homo sapiens
  misc_feature (1)...(413): n = A,T,C or G
cgattttcgggtntnnattaacccgtnactacannancaggattgctgtcttaatactgtaatcctgctgcctacttcctgtcatctgtccatcaattcaaaaatgaatatatagagagagatgtatttcatagtatcgacaggacaaattttctaaagactgaatgactttaaaaccttttccaaattgcttgaaatcttctctgacaaaaaaaaaaaatcaatattaaaacataattctaggtaagcaacaacaaaaaaaataggtcatcactcttcacatacgtggaaaaatcattcttcaggtacatggaaaatgtccaagggaaaacatcactaaatgaactactgatttcctttttcctgttctttgaaatcaaataaatctaagacaactaacaaaaaaaaaaaaa

SEQ ID NO: 18185 - DNA, 241 bp, Homo sapiens
  misc_feature (1)...(241): n = A,T,C or G
caacccggaggnntacaaacctttgtctctttgnaaacgaaagaatcccgtctcacactgnaagtttcctatcgtgaggttcagtgtcatctagagtcaacggatgaagtataagtgttcactgtggaatttctacaacacaaaaagaagaggctggataaagaagataaactgaatattgaaactgttccttttccattaaaaaatagcaaaaaagttttccctgttaaaaaaaaaaaaa

SEQ ID NO: 18186 - DNA, 403 bp, Homo sapiens
  misc_feature (1)...(403): n = A,T,C or G
tttcccgacttcttctgggctattgtgttncttattncctgnacaatcattttgatgagggaaaaagttcaaaactaaagtacctttttgctggctggccttggggctgcaggtgaacttggagcatcactactgccagagcaatagtaagacattcggctgcagttgcgatcggcgatctaaaatacacaaaccatggcttaacagtcaaccaaccatggaaaggtcatgaagaacaaagaaagtctaagaaattgtttccagcaagaggagcctatggaggcaagactgcaaaatataatatggcattcagaatgggatcctgggacagaaaaaggacattagagaaaaactgagaaggtgtgaataaagatgaacttaatgaataataaaaaaaaaaaaa

SEQ ID NO: 18187 - DNA, 305 bp, Homo sapiens
gcagtgagccaagattgcaccactgcactccagcctgggctacaaagcgagactctgtctcaaaagaaaaaaaaaaaaggaaaagaattaaaataaatggaaaaatgtgttttgattagcatagaaaaaattctggagttaacacacacacaaattgttaatagcagatctctgagcagtggctttaagaggatatccactttctacaattgtacatttctgtaatgtttgattttttacaaatgaattgacaatagttctgtaattagtaaaaaacaggaatttcatttccaaaaaaaaaaaaa

SEQ ID NO: 18188 - DNA, 369 bp, Homo sapiens
  misc_feature (1)...(369): n = A,T,C or G
cacctgggntatttgtcttggttcngtgnanacanaaggaanactgcagnagactgtccaccagnacctgctgcctggatgctgggtgttaaccaaggttaacacggttaacaccatgtaggagaacaatggttctcctacccaccctaaaccccctcatcctcaaaggcagagggaggatagaagagaattcctgagactgatgaaatgtcacaattaccccccacccacattctacacacacacacacacacacacacgttgacatctgttgcaaaaatgctgtaaaaaatacattgtgtttttttccatgtgctttgtatttagggctttaatataaatttatttcagaaatcaaaaaaaaaaaaa

SEQ ID NO: 18189 - DNA, 385 bp, Homo sapiens
  misc_feature (1)...(385): n = A,T,C or G
acacttgggatccaaagcctgctcctcnagactactgnanaggaaccagcattgatgaagatttggaactgcagatttggccaaaacatgttttgcctcaaaaatggtatttgaactgaaacagtggacctttttgaactctattattggaggatacattttcatatgctcaaagtgtattcacacgttacgttgaagacaaatattgatttagtttctcactgatttttgtttactactatttgcaatgagaatatttgtgaaattatgtctatttgcaaagtgcaaacaaaaatatttcaataaaatacatgagttgttagtgaacagagcagcaacttaaaaaataataaatggggccaaactaatcacaaaaaaaaaaaaa

SEQ ID NO: 18190 - DNA, 464 bp, Homo sapiens
  misc_feature (1)...(464): n = A,T,C or G
ccggggggccggcccggacagagggtttggttttttnnnggnttttcgtctnaagaccccttttggaccanacatatggctcttcttcatgaanacataccatacttcaggatcacanaagtcgtgagcagacacanaagatcacctgaagaaatccatatacgtgctactcctgtgttagtgttttaaataatttatataaagggcagaaacctagaaattcatatcagaatctatctatatatcacctgtagtttttaaatataatcatgggtatgttttatgtgtatattattattttgtattatagttttagccatcaaacttttaaagaatttaacttacaattacatttcattatattttacagaattttccttacagttatattccaggcttgtcatgtgaaagcctcttttacaagaaatattatattaatattatcatcttcaaaaaaaaaaaaa

SEQ ID NO: 18191 - DNA, 559 bp, Homo sapiens
  misc_feature (1)...(559): n = A,T,C or G
acacctggtatcagactccaaattgcaaaggnaaaaacaaacaagacactgaataattgaagctcaaaggccaggatgtgcgattcagtatgtgaatgcaagaagtgttgagtatgaatcattaatgaccaaaagaagatctattaaatttagtagaagaggttattagaccaactcagaaggatatgtctttcattggaaaagggactttgaatatatatttggaaatatatggtgtgttatgctaacaaaaataaaaacaaataagaatagcataaattaatcaacaaaaatgcctcaatcataattgaagactaagtcctgataataagaaaactatatagtgctgacattcttatcactacaagaaggacggatgaacggggagtggtttgtgcagaggatgactgagatctgagatcagataaatgaagatatgagttattgatcaaagtaaattgctttgagcttgagttcttcttgggcatggtacctgcccaccattcctttagagctcacacctaatgcaaataaactttccagtctaaaaaaaaaaaaa

SEQ ID NO: 18192 - DNA, 389 bp, Homo sapiens
  misc_feature (1)...(389): n = A,T,C or G
gaggaggaccagcccctggacgggagggttccgttttttgaaaagannatgctgtgtaaaaagaccacctttttgacannnctccaaaccagnaaggtngaatttaataggacatttcggnaatttaccttngtgcctgggccaagaaagggaagnaacaaggcaggaacttttgaaacccatgctgttgtaaagttggatttgagtcagcaagcataatgtcatttttctgcatcttcttgtagacagccccctaggagatttccaggtgtaaaaaccctgaagcttctgttctgcacatttctaccagaccaagttcatgttcatgtattacttaatgtatttcttagcttactttaaacaaacatttcatttgaaaaaaaaaaaaa

SEQ ID NO: 18193 - DNA, 447 bp, Homo sapiens
  misc_feature (1)...(447): n = A,T,C or G
caaatcgggtgnaaaacgnatttaggaactgcatccagaagagctgaaggagggttgtaaattcgattaaaaatgcaagactggatgccaacatgatcctaaatataggttcatgtggtgtatgggataacaatgtcctgctcaccctataaacaagtgattgaaaagaccatgagcctttgcctcttaaaatccagtatgtcggaccatgtaatattgtagaacaaacttaatcagactatcatgaaatatgctatctaactgagcaactcaatattctggcttctactgaacaaccatcgagaaaagacgaaaatagaacctatcaaagactgatgaaataataaaactattatataaagggagacttacatatttggaaacaacatattacgtataaattttgaagaattggaataaaactgattcattttaaaaaaaaaaaaa

SEQ ID NO: 18194 - DNA, 673 bp, Homo sapiens
  misc_feature (1)...(673): n = A,T,C or G
ggcgagccagtaccggacagaagagtaatgttttttnnngnttcacttggtgccacaaccctattgcccggccaaaccaaacaaactcggatcatctggggcaaaataactcgggcccatggaaaacgcggcatggctcgtgccaaattacgaaagcatcttcctgcttaggcgcatcggaagcacagtacaggtgatgctgtcacccctcaagattgaaactaacggaaaaatcagtaaataaatgtggatgtgagactatagaatttgacaagctggcatacataaaaacttactacctttaaacagaaaacagcaccacctatatatgtcaagaagccaaaccttttcgttttaactgatcattataactgcaggcttatattaaatggtccagtgggcccctgctatgaaaattttggatccgattccttagggggggggtactttggtggccttctaaattatggaaatggcatttatcttttattgacagggaatgggtttttttaatactaaagcggaataaacggttttctcacaatgctgggaaaaaccaagaaaaaagccttgatgaactggccggagaagggctgcgaccgctaaacggacggagggtgaatttatgatcctggctcactccctcggtgagctaggacaaaaagctgccccc

SEQ ID NO: 18195 - DNA, 559 bp, Homo sapiens
  misc_feature (1)...(559): n = A,T,C or G
cggcggctccgtccaagcctngccccgcccagtctttggnnngggctttccaggattnaacatcataattncaaaggaagcatactatacttgcaagctataaatgattgaggttgtggcctctcccagaagactttatattttaaaaagaacagatcacagaaggataattttatggggcaggtggccttctatacatgacttcccatgctttcatcctaacatcaaaatgtctcagaggggaaataattgcacctgtgagaaatgcgatggacttgtcaaaatacatgtataatatatagatccacatacattatatacctatatatgtttctatgtgctttgtgacaagaaaaaaatcacaatgtcacgtaatattaaatgaaatgagataaagtgctaacttcaagagacctgccactatactaccaagttctctgtccagtctctggttacatctctgatttgcatcttatatgaacgttacagcaggccaacctccacctgatgaagaataaataataaatgaagtgaaggcttgccagcaaaaaaaaaaaaa

SEQ ID NO: 18196 - DNA, 534 bp, Homo sapiens
  misc_feature (1)...(534): n = A,T,C or G
ggggcgcttccgggncattataancacggtggatactgtggaactattgatatacaatatagtgaaaacagtgtctcccttgaccaatgaaaactgcacatagtcaaagcgtatggccaaaaaggtatatagagcgtacatgtccttccacatgagaccgaatgactcttctcagctcacgcagatagactgctgcacctgctcaacagatatagtaaagaaagaacgctgcactttcagagattcttggacgatgaagctcatgagttaggaacactggagggagaagaacgtgcactcctaatggagattagccacatagccggtgggtattgcacaggcttgtgacagatgacaactaaaaatgggtgtggtgaggatggtaaaacaactacattataaaaactgactggatgctcttcaagaaaaacatcacctatttaatggttctaacctcattttgtatggagttaagtaactggcagggcttttgtgtgcaaaaatgaagacaataaccgcctcggtgggctcatt

SEQ ID NO: 18197 - DNA, 1007 bp, Homo sapiens
  misc_feature (1)...(1007): n = A,T,C or G
cggccccggaggccgcccccgcccatagtcccagannagggtttaaggtcttttggaanaagnccgcttcncgttntacgtaagaccntgctctacnccggnncnagacctgattaccttacacagtgtctggttacttcactgctgcttactatttcggtaactgggcctttcttggggctattttctgatggattaatggtatcctgtagcaaagggaagaaacccggtattgaaggagtagatgaagaataagacgtaagcagacagtatgaggccactctgtggtatttgtagacttgcacaacccttaccgtgcattaaaggtgttctatgaatcgctgcactagagtatgctgattacacagtttttaaacgcctaaaccaaccttaagatttgctaactagctttcatcaaggggggaacatggctataagacaacctatatttcattataggactctctgaagtaacattgtctcatagattaacatcttaaattaccataatcatgtcttgtaaatataagactactggctttgggggggaatgctcgggcataattctttgctctgatgcctgatagtgccgactgggttaaaaatggtgcgcagggttaggcacgaggcagtgggccagagaggctaaccgggagggcaaggagggcagtgagcctttacgagggggtggcgggaggaactggagtggccggctgggctggggtgggggtgggcggggaccggggcaacgagaaggggggggtggagggggggggccgcgcgcgcgggggggtgtggggcggggcggcgtgcgcgagggccgcccgggcccggcgcgccctgtcgtgcgcctcccgcctcgcgcgtgcccgccacggaacatcccggcgccctgccctcggcggctcgcgcgcccgtcgccgcaccgctgccgccgactactcgacgcgcgtggcctcggcgcgcccgtngttccctgggccgcactaccatcaaaaatataaaaa

SEQ ID NO: 18198 - DNA, 1015 bp, Homo sapiens
  misc_feature (1)...(1015): n = A,T,C or G
gggagggccgcctaagcccgagggttaaggtcttggaaaggcgttgcgatgnaaaactctacacttacgatgnatntnagttccattggtggaacactgggtgatccctgccactctgcatggccgtcgcccttgagtatcgcctatacatggcaggagactgaacacctgctcacaaccaacgcaggaaaaaacctgctttggacacggggagaaaagaagccattgataactacttaaactgaacaaaaaacttcgcttgcaaacactgattcaaatatgaaaactttatttaaacttgacagcgtgtggaaacaacccgacggcgacgctgcaccttatcggcgctcaaacgacccaaaagggaagcctgccagccaccacgtggttcctccgaggacccgcactgcccccgcccctaacgcttaagactggcccgcccattgttccccgaggccaccgcgcccccccgccccccggctcgagcttcctccccccccgccgcaccgcggggcaagaaaagagaaatctacgcacgcgctccgctcttcccaccccggccctacaggaccgctcccgtccttacacgccccccccgcgcccgcgggcgacaaccacaccccgccccccccacgagcccactccccgccttttccagaccataacgcgcccacccccaacctcctcccccccccattctcccccccatacaccacaccccaccgacacccaaatctccaccccacacctcccgcctgccaccggccactcgtcgggtgaacacccccacacagcgtctcgaaaccctccaccgcgcgcacccaacccgaccactacatacgaaaagaccacgccccaatgcagcaccacagacgagccccccaccgcccacaccgcccacgcctccctcaccctcacccacgcaatcacccactcgacacagtgaggaccggccaccacactagcctacgtctcaaccccgccatccacgtaacaactcacacacgatcaaccc

SEQ ID NO: 18199 - DNA, 638 bp, Homo sapiens
  misc_feature (1)...(638): n = A,T,C or G
ggcctccgggncactacgccngatattcactatcaaaatcataccatgattgctattttgaagacttttacatctcttgtttgctttatattcagaaatcattccacgaatgctatgtatcaaaatgcagtaaatacaattactattttaatactgatatgaaaaactttaccaaatacattaaattcttaagagtatatcaaacaatatcagaactttaattatacacttttagtttgtaagctctacaaaactcttattaagcttctaattaaagaagaaaaaagtatgaagtgaggacagtataactcagtaaattaactcatgtgaagttgacataatggaaaatgatctgactcataataggaccaatgggtatttgttcttgaacaagtctcttctcttaggctcaatgtcttcttctaaagaatgaaggttttactaccttattcactaggttattataaatgtttaatgaaaccacattttaaggtgctcagagaaatagtaaagcaatggaataatttgttcttgaacttttttgctgaaattattttggaatcccaaatgaaacccaatgtgtattttcacatatgttctaatattaaaatgttatgatcttttgaaaaaaaaaaaaa

SEQ ID NO: 18200 - DNA, 461 bp, Homo sapiens
  misc_feature (1)...(461): n = A,T,C or G
ggggggcgcttagtnagcgggtttagtcttgaaagaccgcggagtctaacccgtttccanacgnatgcacggcacatcttggctcactgcaaccctctgcctcctgggaacaagtgattctcccacctcaccctcccgagtagctggaactacaggagtgaaccaccacagttggctaattttttttgtctttttagtagagacggagtttttgttgtctttttagttgagaggctggtctcaaactgctgagttccagtgatccacccaccttggcctcccaaagtgttgggattacagtcgtgagccaccatgcccggccccaaacattgaagttttaataacctaattccagaagttctttgtaagctttgatttcaattttcataaaatcaaatgctgtgtatgactgcttctgaataaaggcaatctgctgatgggatttaggaaaaaaaaaaaaa

SEQ ID NO: 18201 - DNA, 470 bp, Homo sapiens
  misc_feature (1)...(470): n = A,T,C or G
ccttgcgnggagtgnagacacnacaataataatagaagaaanctgnagtgnnactaccacatgnatggnaacactatgaggagtgaagtgtatttggtgcccagcctctcaccccgcctcacagttcagtggacccaactccagtggagttgcctttccagttgcaacacagattcctcctgagtcttaaccaaagtgccctctctgacttaaattgcgaacacatgtgtttcatgtttgtagctggatgccagttcatatactactggaacattttgtctactgttacataattaaactggaagaaacccttggtaggatgtgaaatagcaatatgatccaaagatcattaaaatgtcaaaagtcctttaatgatagtgtgtatttgattaaccacacaaaaatattgacttgattttatttatattaaaattaatgtttggaaaagaatatctgcaaaaaaaaaaaaa

SEQ ID NO: 18202 - DNA, 368 bp, Homo sapiens
tccatggtcatccatagacagcgcccaaagacagactggaggacgtctacaaatggcagaccaataccagggagggaagggaggcaaaagcaagctgacttttccttacccacaaccttgcagtgtaatctgtcagttcaatcgcaccagcatctcacgaatcatcagacagagacggctgcacaagaacatcagacagagatggtctcgctgtgaacatcagtcatgctgccttaaaagttccagaaagaaatatgaatgcattttttaaaatctggtagaaaagacttggtaatccctgctcaaacattttcccaaatcctctcatgttgatattaaagtgctcccaaatttcaaaaaaaaaaaaa

SEQ ID NO: 18203 - DNA, 511 bp, Homo sapiens
  misc_feature (1)...(511): n = A,T,C or G
cccctgcggaggngaacatccggcattctctggnanacttttttattgttacagctggggaaatggtgctattggagtccagtggtgtagagatcagggatgctactaaacatcgtatggaaggcagtgtgtggatcttacacattgtcacatctcctgtcacagtgacttgtcatgcaaactctgttccttctttaagcgccaactcaaaagctcttttgtgcatgatcaagcctttcctgatgcccttggtgagaggggagctcccctcccctcagctctggccacagtgtatccggatggccactgtcccactgcagcacgtgggctcgttagctgtgatggctcctggagggctgaggccacgttcaatgctgtgtctaattcagctttgtacccccaacatctcacacagtacataaaacagaataaacacttttgtttataaatgactcaatgagtgacattgtgaatggtgaaataaaaactggttactacaaaaaaaaaaaaa

SEQ ID NO: 18204 - DNA, 260 bp, Homo sapiens
  misc_feature (1)...(260): n = A,T,C or G
cggaggggcctgttcagggtttgttttgaaatagtttttttnnnggggtttcgaggcagcaaccatacctgnagtgnagcgttttgntagggcanaaaaaagttattcacaaggctgctgtgtgagaagacgggagaaccaaacctgaaatccacctccccaaattagggcttgaaggtttaatccagaaggatgcagctaaaaagtatgattttcccataccattgaatgaagcttccaaaataacaaaaaaaaaaaaa

SEQ ID NO: 18205 - DNA, 459 bp, Homo sapiens
tttgggaccaaaccctgctcaatgactttcagcattcgactacacctcacaatacctgcattctcttttttactacaacttgctgcagatttcttttttttttctggtagcagaaatccccatttgatgccaattcctcatcatcataagggaatgtaatcaaggattctttcctaataatgtgaatagatgtgcagtgactgacagaggtgatacagcgggtttattcttcttatggcagtgatcttctgactgtaacccaagggtgaaagctcatgcactcttagcaacaagtaaattgtacgaacatgccccagatatttcttcatttatttgtaaattatatacagtttagtctattctgaaaatatacagttttttaaaaattgtaaaacaaatatgtttttctttactatgtaaaattaaatgtcactgagagtaaaaacaaaaaaaaaaaaa

SEQ ID NO: 18206 - DNA, 304 bp, Homo sapiens
  misc_feature (1)...(304): n = A,T,C or G
ggggtcgggggtaggaaatacgnaacctgtgtggcattcttgtggcgggatggtgccttgtgactagttctgaccaatgagttgtgagcagaagtgaagtgtggccagagcacttaattgccaactagaaacttccagagtttctttcccacttcttcaatgattgtgaagtgatgttcccacaaagctttcattcctgagttcctgagagactacagaaggatgcaaatcagagacctctgctgactcacctgaaaacatgggcaagaaataaacttttcttgcattatgaaaaaaaaaaaaa

SEQ ID NO: 18207 - DNA, 235 bp, Homo sapiens
tgcagacaccagttacctgcctggcttctcccttggaacaggatagcttatcaggatgcgcgcgagcatcgaggtctggagtggcgcccatctacggtacctgaaagacaacctgggttctaccctcggtgagcccttagcttagcataagaatggaaccctctgtaccagcaactaccccgctgagaggagggtgtgtgttgacgcgaggggggagaaggagaacgagcaaagt

SEQ ID NO: 18208 - DNA, 309 bp, Homo sapiens
  misc_feature (1)...(309): n = A,T,C or G
gactcgggnttaaaanccgnaggctggtgganacanaccacttccananaatcctgcttgctaaaccacctgaggacacatgcaatgataatgaaagtagatagccaggggccatgtgctaattttactcaacactgattttggttcaccaagcatggaaagaaaatcctggatggagtgaagcaataatattttttaaaaatccttacaattacttttctattattccaaatattaaatgtactattatatacgtctccaaatataaaataaaactagctaatgtttagaaccgcaaaaaaaaaaaaa

SEQ ID NO: 18209 - DNA, 362 bp, Homo sapiens
  misc_feature (1)...(362): n = A,T,C or G
gggaggggcccgcccggggcgggacgcgtctggtcttttngnnnngnngctgcggtgtgacaaaacacttttatgccactctcgtggctcaaaccgacagagtgaacatggcaaacatcacaagggcaatacacagtatgggccctaggaaacgactacttccatcaagcttaattgctgtgttctccatttaatgactttccctgctggtacctaagtaccaaatggatggaactgtgctgtcgtctgccttgattgttgagttagctaggatcgtagccatatggcattctgcgctaaataaagcccatgtggatactggaacggaaaaacaaaaaaaaagggcctcggtggcccccaca

SEQ ID NO: 18210 - DNA, 358 bp, Homo sapiens
  misc_feature (1)...(358): n = A,T,C or G
ccatcctgcagtttcgtgtcctggcaatccaaggcaaaccanatgtttggccaccctaatgcagcctgatcttggnagatgttgcctgcttgcattcagaggccctctcaacaaagggaagacagaaacctgtgaatatacaatgaaggcagaaaatgcgtctgcctcttgtctgtctggtgagcccactgggatggagttgacgctgggccatgcgggagctggggagcagcctgaaaggagatgcttatgtccagccttcttgctgtgatggaattgtatcttccccccctgcccctgatctgtaccacattcttggggtgatatacttgattattaactgtgaaaaaaaaaaaaa

SEQ ID NO: 18211 - DNA, 192 bp, Homo sapiens
  misc_feature (1)...(192): n = A,T,C or G
caggaccacccagnacccttgttgcatatacagcccatttatctcccacgttatcgagttattgaagaaactgaaacaattgatagaatttctacattctgaattttttgtgttttcttacgatgttagtcactatgtatctttatccattgtatttcctgaaaattagaagatagaccaaaaaaaaaaaaa

SEQ ID NO: 18212 - DNA, 203 bp, Homo sapiens
  misc_feature (1)...(203): n = A,T,C or G
ttccgagtnatgnaacaggncctgnatatagcagaattggcagttnactgaaaaactcaatggattcagtccactgtggctattaaatgagttttataagagaacataggaaagtgcaattccattatcacccacatggaagccttcacaattgcagtagatggaacccaataaatatttttgttacatcaaaaaaaaaaaaa

SEQ ID NO: 18213 - DNA, 266 bp, Homo sapiens
  misc_feature (1)...(266): n = A,T,C or G
ttccagganaaaaaataagaattctaaatcactggnacatcttattaatgggagaagcacggacttaaatctgcataacaaaccttacctttgtttgtcctttttctggtcatctcaacatcctttttttcttcgcttcagttgaagatggtatttaggcctgaattcaaagccattactttcagatttattcattttccaattatctcccatacatatatatgatatatgtgttattaaccttgttttcttgaaaaaaaaaaaaa

SEQ ID NO: 18214 - DNA, 268 bp, Homo sapiens
  misc_feature (1)...(268): n = A,T,C or G
ttccaaccatctgtcctgcctggnancagctgacaccactcagacatgatttggctcaaccagttctgcgatcccacccaggagggaagactgaaagaaaacctcacttccacctggctaagatttcatctctaacctgaccaatcagcactccccactctggagcccctacccaccaaattatccttaaataatcttatctccaaatgctctgggagactgatttgagtaataataaaactcgaggtctcccacaaaaaaaaaaaaa

SEQ ID NO: 18215 - DNA, 169 bp, Homo sapiens
  misc_feature (1)...(169): n = A,T,C or G
gcttcggttncaaaccgcctttgggggangnaaaaacccagnaanaagaagattatgtgccttatactatgatgaagaaggacacccacaccttacctaacatgtacattaacacctgcattggcaaaaacctaaaaaataaaatatttacttagcaaaaaaaaaaaaa

SEQ ID NO: 18216 - DNA, 317 bp, Homo sapiens
  misc_feature (1)...(317): n = A,T,C or G
gactcgggtttatccccagnatactctggctgccctgacaccccaccacagggacagcagcatttatttgacttgactaggattggaacttccagtgatctacgatctccatatgatctctgtttctacaaggaagcaccttctccatgaatattatgcacttagttaaactgagccatggaaagccaatcattcactcaacaaatatgtacagagtgtcaataatgtaccaggcaagaaacaaggagctgcgctctttcttcgaggaacccatagttctatcagtagaaggaataaaatattctaagtgtcaaaac

SEQ ID NO: 18217 - DNA, 332 bp, Homo sapiens
  misc_feature (1)...(332): n = A,T,C or G
tttccggtatcagnaagagtgactcacagnaaaggganactaagttctgatagaggaacttttaccataggctaccagccattctttccagggatgatgtgtgcaagactcatctgcataacaagacagcctttgctcacccatgcctttcctcctggcggcccccgtgacgtgtcaccacctcccacctggagctccaggcatctagtcctctctgtagggtataaaaactgcagtcatctggcccttctttgagtctcatatttgtgtggctccctgtgcatgtgcacagaataaatgtgtgtgcctttgtcctgtcaaaaaaaaaaaaa

SEQ ID NO: 18218 - DNA, 234 bp, Homo sapiens
  misc_feature (1)...(234): n = A,T,C or G
ttccgggacagccttgttgcccanactgactccactcctggcctcagtgatcttcccacctcagcctcccaggtgctgggagtacagtcgtgagccgccactcctgagaacttttatacacacaactatcaactaattccagattttataaacccagcatttccattatctaaatttccaagccaacacgttttgcaaaataaaacaatgttaaccatcagaaaaaaaaaaaaa

SEQ ID NO: 18219 - DNA, 274 bp, Homo sapiens
tttccaataaaatttttgctctttgcccagctggatgcatggcccgacttggctcactgaaacatccgcctcctgggttcaagcgattcttctgcctcagcaccccagtatctgggattataggtgcccatcaccatgcttggctaattgatctttaattggcttgtctggtttttgttgttgagttataggtgttctctgtgtattctgaatactaaaccattgtgagatacttgatttgcaaatattttctgcccttctaaaaaaaaaaaaa

SEQ ID NO: 18220 - DNA, 429 bp, Homo sapiens
  misc_feature (1)...(429): n = A,T,C or G
tttccgagtaagnaatataggagattgnataggaatcaaancctagaaataaatcagcacatacatagccaactgatcttcaataaaagtgacaggaatatacaaagggggaaaagatcatctcttcaatagacagcattgggaaaactgaatggccacatgaaaaacagtaaaattagactcttaacaccatacacaaaaatcaattcaaaatggattaaataattaactgtaaaacctggaagtataaaactactgaaagaaaatgtaggggaaaatcgttatgacattggtattggcaataatttcatgaatatgacaccaaaagcatacaagaaagcaaaagtaggcaagtgggattatatcaaactaaagttttgtatttaaaataaaaaaataaacaaatttgtgagtgcaaaaaaaaaaaaa

SEQ ID NO: 18221 - DNA, 283 bp, Homo sapiens
  misc_feature (1)...(283): n = A,T,C or G
tttgccgaggcnatttagatcatncatnataatncaatctncagctaaaagggaggaaggaagggaggaagnaagtaagcagcaagaaaagtaagaaaaagaaaagagagcaaagaaagaaggaaagaaagaaagaaagaaaagaaaagaaagaaagagaaaatcagaacaaccatggcatcagcccaacctgctattactttgtgcaaaaatcagtccatagcagtggacagatcaattggttaaaataaaatcttgtgttatgctcctaaaaaaaaaaaaa

SEQ ID NO: 18222 - DNA, 323 bp, Homo sapiens
  misc_feature (1)...(323): n = A,T,C or G
gagcttctcaaattggccancccggtgacttttagatcatttcctgaattgacagagaggaaaaggaaatcacatggcatttattctgtgcttcttcaagcaaagatggaaaccctctgccttatgtttaccttcgtgaaggaaggtcttcctcaaagaatcaatctacatgctgttttgctgcaagaacatacctttccctaaaagataacagattgaactacagacagctgcaagcacatcagtacacaacagtagcactcaagactgtcatgctggcatcaaagaaataaaatttaaatccagagttaaaaaaaaaaaaa

SEQ ID NO: 18223 - DNA, 419 bp, Homo sapiens
  misc_feature (1)...(419): n = A,T,C or G
actaactgggnnnnnnnngggggnnnngacttgggnnnngggatnnnnatnnnnnngnttaactatccgaggtggncnctnntggncnncaccgancctgggcacactctctggnctgnaattgnaacttnantaggncncagncctncccaccccnaganagtcttncattnctncttnctcccattcctggacatnacagnatgtgnatgccttnggnannctctaagtagcttattctcggggccatgtgnagnngtgatccactgnaggcttggatggnaggattcaaaattataccagatgcctgggtctctgttgactacagaacttccaaaacagccctggatataactaattgcagactgtttttgacgcaaaagaataataaatatctatcctgtttaagatcacataat

SEQ ID NO: 18224 - DNA, 333 bp, Homo sapiens
  misc_feature (1)...(333): n = A,T,C or G
gctcgggtccacctcatgtttccacttgctgggnagtttcttttcctcacaatgctctgagataactaagtcaagggaagtttgcgcagccctccagaccctccagatttcaaaggaaagcccaccgctgctggtctgggggagctgatggcctattcatggatgagatggactaaggacagtgggaagcacaatggaccaacagcattgttggaggggactgcgtgaggaagcaggagcctaaacaacactctccagatactgcgtgaacactgtctccagaggggtcttgtggcatcaaaaattaaaactaaatgttgaaaaaaaaaaaaa

SEQ ID NO: 18225 - DNA, 237 bp, Homo sapiens
  misc_feature (1)...(237): n = A,T,C or G
cctttgnggnnnaaactnaagnaatctgnagaaaaatgaggcacagnaaactcaaccccgttctggagaaagctgactctacggaagcctttttgtttgcaatgagtaaaagcagaaatatgacaactcatattgtcactataataaattacaaattgatgaaattaaaaacactgtggacagaatccaaagaaatatggctcaaattaaaatatccacaaagcaaaaaaaaaaaaa

SEQ ID NO: 18226 - DNA, 360 bp, Homo sapiens
  misc_feature (1)...(360): n = A,T,C or G
gtggtaattttgattgctataataccaagggnacccacagnaaaagaagagtaggatgacggaaaagtcaggcagctaaataaaaacagtaaaggcaaattgaagattaaagttattctttaaaaaattctaagcacatatatagcagtattattttccctcgtttatcttactatattatatgataatataattttgctgaattaattagacatttggctcaattatacaataatatgtaatggtctgatgactctaaagtaactacaaggcttatgattgtgtaatttcaataaatctgcgtttatgtatttgttgggcaggggaaacaatacatagaatggaataaaaaaaaaaaaa

SEQ ID NO: 18227 - DNA, 395 bp, Homo sapiens
cacccctggagacaggaagagacgtacatgaggaaaacatctgacaaggccagctggggcagaggatgggaaggatggagacaccttggtttggaaggctaggaagcaggcaaagactggctgtcacttcaaatcactaaccgggcccactgattccatctacaatcctaacccacctcctcgggactccctatgccttcctaccagtgaaatgcgaaatagcagcacctaccacagccaagagagcacttaacacaacagcagtttatggacacgaagaagagaagggagaataaagaggaaaatgatgttgatctaaaagtctcactctggtcccttttataatagatattttactttgaaataaacagatttttatgacaaaaaaaaaaaaa

SEQ ID NO: 18228 - DNA, 182 bp, Homo sapiens
cccagttgtcatgaatagcctgcaaagttctcaaccatctttgcagccagaagaagtggctcccatctgccagtttggaagagaaccttcaccagaagccaaccatacgggcaccctaatttaggatttccagctttgagaactccaagaaaataaatttctgttgcttaaaaaaaaaaaaa

SEQ ID NO: 18229 - DNA, 610 bp, Homo sapiens
tttcggtcaaggcagcaccttttgcacggttggggcaccctggaagtaacaaagtaacctctgctcacattcagcaagaggaggaagcccttgtgtgaccgcgggatacggaccttgtcatggaacttcagagtgatgactctaaaagattgaattgcttgaagacaccatcacggaatatcaagatacttctcttcaaaaattcacaaggctaggtctctcttattctttattgtggaagttttttttctataacctttacggatggaaaattgccctgcctgaatacactggcattattcctgtcgtgctcttaaagtagctgatggcgggctcagcaccactcaaaggcggaaatacggccttcctcgcctccagggggtgactctgcagccacttgccttcaaagagggctaattaaggaaccaacctcactgacgccgtgcggttggccgttctgcataggctaccgccccctgactaccttaaggcggatatacgcgttatccacaaagtggggggaccccgcaggactgaacatatcaccggcgggcccccctgggggctcccatccgcactatgccgtgccgatcctgtcgttcactaggtt

SEQ ID NO: 18230 - DNA, 868 bp, Homo sapiens
  misc_feature (1)...(868): n = A,T,C or G
gggctcttctctgnaactgcacagccctttcactgacttgtagcagcatgaagcatgaaggaggtaatacctctggggacaccttcaagagtgagatagaggagcctgtttatcaatgcttcagcatcccatcattcaggtagaaaatttcagaagcattcagattgctttttagaagatccttgtagaaatgagcccccatttttgacaatcattaccgtgaaaacgtactcttatattgccttttcttactattttgactcaattttgtgagtccgcctctcctttttctatgataatctctcaaatataattcttgtaccctaacaaaaaaaaacaaaacggcctccctggcctctcccggggaggtgtgcgggcgatagccttgaccgagggcgttttcatgatacctcgttcactccctcccctcacccccatatatccctgcttccacagtcctttcctccctcccgcgtctctcacagatttgccgcccagttggccgcgccgacccccgagcctgctcgccgatgcaccccacgcgcgccgccatagacagacccagagcccctacaccacccgtagcagcactgaccccccccacccgcccgaatctcgcccacccccgtcccgggtaggactacccacatccttcgagctgcccgaaagtcccaaccagaccaccaagtgcacccagctgcccgcctttactcaacccccccatcacaccccacgcacttctcacgaactccacgtccctcacgcgcccacggcgcactaccgatccgcgagagcgagttgagtacgccggcgggacaggggaagctcgacctagccggcagcgcgaggaggtcgccgccccaccggg

SEQ ID NO: 18231 - DNA, 879 bp, Homo sapiens
tttcgaggataggggtttcaccgtgttagccgggaacagtcttgactcctgacctcgtgatccacccgcctcggcctcccaaatgctgggattacaggatttgggcatcaagattatgatagtgtcataaaatgagtttggcagctttctctttttccattttatgggatgactataagataaagatactgtgtatcacgcactaatatgaggcctggactacttcataagacttcttggagaaccaaaggagcatgaataagtaaaacagctaggaagatcaaagtacaccatactgaagagggaaaactgcatcaagcttgaggacttcggatctcgagcgacaaagacgcgggctcaacacttgtccatgccactccactctgatatgcccccactgtgatctcagttcgtctgtgcccgcccgcgacgaccccctacgaccccccccagcccctcattactccaccccctcagtcccagatcagaggaaatgccaccactgatgcaccccccgaaacgatacccgcacccccccaaccctcccaccaacaacccccaagacacactgaccacccacaccacatctgttttaccgccagccctcccaccacccccgccgtattactcatgcaccccgatccgacatcacaccccacccgaccgccccacaaccaccagttatacactttcccgtccaccgaccttgctctacccgcagaccgcctgtcagaacacctatcacacccaatcttgtgctattcacactcacccccgcatcctgatcgcccactcccgctccgttccacctcacgtttacgccccgtaatgagaggaaccgcgcccgcgatccgcactcaagacccgcccgaccacccc

SEQ ID NO: 18232 - DNA, 457 bp, Homo sapiens
  misc_feature (1)...(457): n = A,T,C or G
aactttggtagnagaacctgctcttttgcctagnctggnatgcatatgtgatctcactcactgcaacctccacctccaggttcaagtaattctcctgcctcggtctcccacatagctgcgattacaggcgcccgccaccatgcctggctaatttttgtatttttggtagagatggggttgcatcacgttggccaggctgctcttcaattcctgacctcaagtgattcacccgcctcggactcccaaagtgctgggattacaggtgtgagccaccgtgcccggcctttatgttaactttttgaggaactgccaaactgcattccacagcagctgtaccaccaatttgtatttatgcaagcaatgtataagggttccaatttttgtacatcctcatcaaaacctgttatttttgttcttttgatcacaaccatcccagtgggtatgaaaaaaaaaaaaa

SEQ ID NO: 18233 - DNA, 170 bp, Homo sapiens
  misc_feature (1)...(170): n = A,T,C or G
gttccggtagtttacagcagtncatgtgtgncctncaaancactngtcttggnaagggaanaaagggtgcataaaatgggaaatcacatttatcaagttctatgctgctgctaatgctgaacaggataccttaaataaatatgccttttaacactngaaaaaaaaaaaaa

SEQ ID NO: 18234 - DNA, 467 bp, Homo sapiens
  misc_feature (1)...(467): n = A,T,C or G
ccggggagggaggcatagggnanaattcacagncacagnanaagcaatgtaaagatgaaacagatttgaagatgacgactttgaatataggagtgacgtagccacaagccaatgagtgccaacagccaccataagctgaagagtcaagaaatggattctttccaagagcatctagagaaagcatagccctgttgacatctgatatcggcctaataaaattgattttggacttctatcctctagaaccatgagaaaataatttgttattttaaaccaccaagtctggaaatttgttacggcagccacaagaaactaatacagcttgtttatctaactttcttttggactctaacataacttacatttatatcagtaattatcttcacatttcatttataaaaaacaacttatcctaaagaagacaaatgattaaataaaacaaaaacctaaaactaaaaaaaaaaaaa

SEQ ID NO: 18235 - DNA, 371 bp, Homo sapiens
  misc_feature (1)...(371): n = A,T,C or G
tttccaggtaaaaatgntccttccnctctaagnanactggtagcttccttgccctgatgcttagctgtttatactgaaacttcccctccacttctctcctgtattggatcccctgattccttgaagtaatgtctattttttattttaccctatcaattgctaaaacatgttctgcaataacttcctgagaaaagatacatgaaaaattagtttttggacttctcatgtatcttgattgattgattgattgattgatttacagggtatggaaacctaagttgaagtcacatccccttagaattttgaaggtatttctttactatcttctagaatcctatattttagccatttcaattgcaaaaaaaaaaaaa

SEQ ID NO: 18236 - DNA, 275 bp, Homo sapiens
  misc_feature (1)...(275): n = A,T,C or G
tttttccgggaanacacnctgnnaccctncacanacaagaaaacactnggccttctgcagnanaaaaaattcaacaattccaagtccgtcatctaagatcctttactctcttttctctacaagataagaataaaattcaatcacggacctaagtaggtataatagacattaatataaatcttttaaatactaatactctttcctataaacatctactcaataaggctaaaagatgaaaataaaatcgaaaatttgctttttgaaaaaaaaaaaaa

SEQ ID NO: 18237 - DNA, 274 bp, Homo sapiens
  misc_feature (1)...(274): n = A,T,C or G
ttccgatctgcagaagaacattgtgtnganaaatatcagtgagnagtggaagatctgcggagggcctccctggggctcacctgtgcttttgcctgagcttcaccgtgtcaagcactttttccctctggaggaagcagctttcaccttggaagaatcttgaccttgccattcaaagtcaccagacgaaatctgccagtgccttgatcttagacttcccagcttctgtaactgtgagcaataaatgtatgctgcttataaaccaaaaaaaaaaaaa

SEQ ID NO: 18238 - DNA, 1039 bp, Homo sapiens
  misc_feature (1)...(1039): n = A,T,C or G
gaactggcggggcgacagtacctggggcccacataaaaaaaacagaaacaaaaaaaaaagacttttccgaagtacctactagtggcccttgngactgtgggactccacactgctgtttgcaaaagcaacaggcaggcaaaggaggccctgcaaagtgtgccatcatgagtgagcatctctgtctactcaaactctgattttttcactgaaaacgacttagtgaggaatatgggcgcactagcctataaaatataccaatgacaccaggctacacaaaaaacacaaactggcctccctggcctaaaggaggaaactctgaaaacagttacatttaaggaggagaaatgagtaacgctcggctaatccgtcagtaccctccacacctcaaccactcaccaaccaccaccacacacgaccacgtaaaatacccctcaaaaccacaccttaccgccaccacctcacgcgaattgctcatacccctctcaaaatccgtgccagccccccgcccacaccccccccccaatacatacgtaaacaaacttccctacccggcaccgcacggccgatcaccccaccacctacacaccacacacccgccgaccaacccacaccaaaaaagacaagatccacatgaaacaacaaacccaacaacacacacatacgactacaacaccccttaccactgtctaaaacgcgagaacgcgcccacacactcttatcaaactctcgcagttccccccacgacattcgtacccgcacacccgacccctcgccccccctctctccggccccccccgctacacactagacccacccaactcacacgccgtgccgcaccacgacgctacaccaatagccgaccccccttattcaccacagtgtccttcgctggtcatccccgatataccacacaaatgaacgccgaccacgctacctatctcccgctacctcctcatatctaccgcccganaccactccctcggatatcaccccagtcttccgccataccctacaccacaatacacgacgntgacccact

SEQ ID NO: 18239 - DNA, 302 bp, Homo sapiens
  misc_feature (1)...(302): n = A,T,C or G
ctttccgtgataaaaacactgggnagtgggtgcagggactgctgcagactggaactgatcgagctggaaaatcatcacttngactactgctggaacactgctgcaaaaaggcaacaacaacaaactttagtgaaaagacaaacagaaaatgagcagcattagaaaacttcttaaaataactaataggtctaaattttcagactggaatttctggagaccctgcattctacacatctatctcgtactctaccttcagaggtggcagaagacaataaatatgcaggagcacaaaaaaaaaaaaa

SEQ ID NO: 18240 - DNA, 308 bp, Homo sapiens
  misc_feature (1)...(308): n = A,T,C or G
gttttccgagccaaacgcacgcgttgtggtcagnatccttccgtcgattccacggctctaaaaggaagcacacattttcggtggcgttttgacatggacagcatagttttctgagataaatctttttcatcgccactttggaaaggtggagaatatatggcatattaaagacaagggaattcagccacaattatcaggatgggaacagaagaagaaacaaaatcagagttttgcagttgatcctgctggaaaacagtaatttaatattaaagcctggtgatctggggaaaacttgaaaaaaaaaaaaa

SEQ ID NO: 18241 - DNA, 340 bp, Homo sapiens
  misc_feature (1)...(340): n = A,T,C or G
ttccaggacactctttctctgggnaagggnacttgnatatcaatcaagggaaatgataccagcggagtaatgaaaatatcatgattggaagtgaagattggaagtgaaggctactgatggagcatgggcatgatggctggagctccagaagccaccttggactatgcagtgaatgtgaggatgaaagctacacaatcagagaagtagagagaagacagaaggagcctgggttatgttgacactatgtgtccacaatactagtgctgaactggatgtctctggacttcctatacatgacagagaaataaatttctatattgttaagccaaaaaaaaaaaaa

SEQ ID NO: 18242 - DNA, 331 bp, Homo sapiens
  misc_feature (1)...(331): n = A,T,C or G
ttttccaggaacttctncacctncttnccaancaccacttgggnaacctgataccccaaacatggctgggtacacctgcacatcatgctactgcccctgcgcaccagcatatccctggctgctgagccgtccaccttgccatcttcactggtcaacagttcttcatgccgtttgaagagctttgcaaaatccctcaccaacttcacaaaccctgagtctttttactatcaccttcataagcccaaacccccacttaggttggtctcatatctttgcattgtgaaaagtactgcaataaacatgcgagtgcaggtaaacaaaaaaaaaaaaa

SEQ ID NO: 18243 - DNA, 309 bp, Homo sapiens
  misc_feature (1)...(309): n = A,T,C or G
ggactgcggttncaangagncccaaacgttagngcanctggagcatgaacactacgaactagattgcatgaaaacagtgtcagaaacaacatcaacccacaactctactgcattgtggnaaaatacaatttaaatgaaagacttctaagcgattttcacctgttttcaaagtacgatgattcatgctataagtcttaatttaaaaaaagatgaagacgtcttagtgacttttcattattatgtttaataaaattttatcattttgaaccatgaaaaaaaaaaaagaaatatggactcactggccttaga

SEQ ID NO: 18244 - DNA, 195 bp, Homo sapiens
  misc_feature (1)...(195): n = A,T,C or G
actcgggngcacaaaccatccattcaaactcctcctggaaacacacacanacanagcagatgcgcacccacagatacctctcttccttcgaggcctggacacagccatggagactcctagctcttctagccaatctggtcatgttttattgaaggaaaataaaaatcaagggttttgcttgtaaaaaaaaaaaaa

SEQ ID NO: 18245 - DNA, 273 bp, Homo sapiens
  misc_feature (1)...(273): n = A,T,C or G
gactgggtncaaaccgacgttggggnagcacaaagccccggatagcagagtgacaganaaagaaagaaaggaagaagcagccggatgtcagagagaagcagtttgagctcagagggacagcttgatggtgggacctcggagaagagtttgtctgaactccaggggaataccaccttcccattccatccactttccagctccctatcccgctgagatcctcttccatccctcaataaaatcctccacattcactacccttcaaaaaaaaaaaaa

SEQ ID NO: 18246 - DNA, 905 bp, Homo sapiens
  misc_feature (1)...(905): n = A,T,C or G
ttttctgtggaactacactcttgttgcccagnctggnatgcagtggcatgatcgtggcttattgaaacctcaacctccccaactcagnagatcctcccgcctcagcctcctgagtagctgtgactacaggaactcatctgcagtctcatgatgaagtcagtgaagaaatggattttgcattttacaaactcattttattgtctacctggctgatatgcctattttgcgtaaaataaccgataatcggcaaattgtcaaacaaagatacatggtccttttggaaaaaccaactccaagccgacaccgaccgacgatcaattcatatatattatgattgtggggcacaaccagcatgtaggcccgcccgccgccccccgccctccacgctgtgtgcgctgaggactcagcgccccagcctgtccgcccgccgtcccacttctcgtatattgcccctactcccccctcgatacccgatcctcccatcctcgatgagtatatcgcccacccggccgcccacggcctaccgcgcccacccccccatccgcgctcgccgcgcttaacatcccaattcagattcgcccgcccgactgcgccgccactcgcaccgcgcacaccccgccccccgccaaccttccatatccttttctagatcaccaatatctccgccagccgcaatgcctattgcggcgggaacacgtgcttccgccttgcccctccgcccctcacccgcccgcccccccccccccactccctcccttccccgaactcctccgcctccagccccctggcctttcgtgcatgccccccgcgtgcgctgtcttccagtattccgcgagttgcgcgccccccaatcgcggcacaccgggtacgtttgcgctccctcgccccgccccgtctccagcgcg

SEQ ID NO: 18247 - DNA, 1001 bp, Homo sapiens
  misc_feature (1)...(1001): n = A,T,C or G
gcacgggcggccccgcccggcaagaaagacagaattnnnngtttttcgatgactacccggcctttgctctttgcacacacacagaattgttttngacctactcaaaagagatttataatcagctataggattttgacaagtgttctcaatgcaagattccattaactctggagattatgacattgaaaaaaatacagtactcatgaagaactgaaatgttcatgaatatcaagcagaacaagagaacagaatggattgaactaatgacaaaacaagtattatttttaacctttttggttaaaactttggggatccttgctttgattttgtgagtgaaggatacttattttgaactatttgaaggctttgataattgggggaactatgtgcctgtggacccagggggaaaaagagaaaggcgctcgcgggccctgaagagagggaagctctaaaggcccctgtggctttaaggaagggacgagggggtaaaaccggcaccaccagctacccaacgcgcgccactcccccccgctccacgcgacgggacgccggcccccccatccgcccggccactccggagacccacggcgcgtgggattactccgcggctgccgacgcggcccgagatttttcctcatcacccgcgcacacgcccgacccattgcgagctatcgcatctgacggctgactgcgcgctacgttcgcccacgtctttttcggaccagcgcgaggggctctcctcccgtcgccctctgcgcgcgctcgcaggggcccgccggacgcacgcgaggcccgccgccgacgtacgccgagaccgcgtgcggatgactgctagaggcccgttgggaccttagagtgaacggcctgtggcttgcctcccacacggacgccgtaagtgctggttgctcgcggaaccgtgcccgccgactctctaccgccccgccacagtcgtaacaatcacggtcccgcagctacaatcgaccaccgctccccgcgcgtcc

SEQ ID NO: 18248 - DNA, 404 bp, Homo sapiens
ttcgtgttggctatatgagaaggcaggacccctttagaagagagatgagaaaaccatcaggcttggtggctgcctttgcaggcagcacttgggaatcacgaaggccctggagctaagacgtgttcttgacgttgctacactgacatgcactactatcagctctccaataactggtatctgcagggaacaaagactttcccacatcgatttctcctttggggaagtgaagccaactggccaccatctaactgaaccaatcagcctgaggtatggcaagtgtgtagatggacagaacaagatgtcgcaggagggatgacctggctgaagtgccctgggacaaagagaaattggtgggggttgggccaaataatataaataattttgtaattttaaaaaaaaaaaaa

SEQ ID NO: 18249 - DNA, 494 bp, Homo sapiens
  misc_feature (1)...(494): n = A,T,C or G
gttcggaggccacacancaccctncgggttnccaanaancagctactggnaaacagagttctcacacaccgtgggcgagctcatcgagggtgcacctgcgcgccaggacacatnccctgcttctcagtcgctcaccctcgagctttcacccgcagaccgtgcgtaacctgagctcgggggctaaacggaacccccttgtttggccggacctgaagggcccctcccccccaccacaaggtggggggacagttttctctttccccccccccagggggggaattttgatttgaaaaaacaccccgggggcacccaccattggggttttttttttgtggggggggggggaaaaaaccttttttttttctatcataaaacacaccaccctccccaaaaatctccgggggtgggggggggaggcgcaccacaccccgggggtgcttcctcttttttgaaaaaaaaaaaatatatcctccccccccacaaaaaaaaaaaaa

SEQ ID NO: 18250 - DNA, 323 bp, Homo sapiens
  misc_feature (1)...(323): n = A,T,C or G
caggtctcaaaccagnataacanaattgaagaacaattgcagaaacacttttttctcacatgctcgttgaagacaaacaacagaaaacactaatatattgttgctgatcactgaaaagagagaattggcaccaagcaagagcaaggaaccagacatcagttacggaaaatgtatccccacatcacatcatgggagcctagctcacagacactgccaatggaaattgcagaaatagatcaactgcaaaaggttacataggggacccgcatgctacattaactctctgtgaataaattacatgtaaaatttgaaaaaaaaaaaaa

SEQ ID NO: 18251 - DNA, 409 bp, Homo sapiens
  misc_feature (1)...(409): n = A,T,C or G
tttccgagcacggtnctcgctctgtcgcccagctggnatacagtggtgtgatcgtggctcactgaagcatcaacctcctgagctcaagtgatcctcccacctcagcttcccaagtagctgcgactacaggcatctgccaccacacccagctactttttaaatttgttgtacagatgaagtctccttatgttgcccaggctggtctcgaacttctaggctcccaccttgacctccatcttgacctcccaaagtgctggaattataggcatgagccaccatgcccggccttgatttatgtttttgtgatgaacattcatatcttactcccaccccatggaaacagttcatgtattacttttacaatataaaacaaataacaataaaaacatcaaaaagaaaaaaaaaaaaa

SEQ ID NO: 18252 - DNA, 984 bp, Homo sapiens
  misc_feature (1)...(984): n = A,T,C or G
gggaatgcagggaacccacaatccgcccccaccccgctttccgagtagcgatctcctgttcacgcagatggnatgcagtggcacgatcctggctcactgcaacctctagcctcttggagttcaagacaactncttcctgaccccagcactcctacagtagcttaggactacaggaactgtgccacaatgccctgctaatttctgtgttttttagtagacatggggtttcacccgtattgcacaggctgggcttggactcccggcttcagaaatggaaaaaagaaaggaacctgacataagccctgagtccgggctgggcttctgaagaactagcgtgactcctcacaaagatcaccttgaaaaccggaccgaccctccttaaaaattggaagaaaacaagcattataatatcaaaaaaacacagaagcctcgcctcctaaacgcccacaaaaaatccgtcctcccccgacccaaaacaagtacgcccaccccacatcacaaccacccggaccccccctaccaccgctacgatattcgcgcgtcccacagattccagaccgcctgcggtgacaccccccccttcaaccaacacgcaccacacccgctccccccgacgaagcacccaacaaccggctcacccccaacgcttgatgccaccatacaccaccccctcagcccaccaacactaccgccagacccctcaccgactccatgccgcgcgccccccctactccatatcggacttccccccgctcctcagcagccccccggaggacacaagtacagagacccccacacccacaataccgccaccgcaacgcacaccgccacactacggcacgtagagatccgacgggtcttcctaggaagacatcgacgtcgcacacccttcgagctactaaagagcaccagagaaggcacggcgcaacacgaacccgcagtaagacgagccncgatagactttgtacctaaccgcgcccaggc

SEQ ID NO: 18253 - DNA, 437 bp, Homo sapiens
ttttccgtgtattcataaaacaaaaacttctgctcttcaccatatggaacatttcctaaaagcatcctcgctgcagaacaacaaatcctaagaaaaccagaaatcaatttgggagtgaagataagatctagaaagaaaatggtaatctcatttcagtctgcattattaaaaggtcttaaatacatcactacaacatctgatgaagctgataagaattattggaaaatctataatattcatggtaaatcacataaatgtgtatcatagttttaagtgtatatataataggggctaatatttgccacagaggttgaggacccctgctcactgtgactaaaattttcagtgtgactaaaagatcattagatcacgtatcttattaaaatatgtattaaagatattgactaaaactttctgggaatgtaaaaaaaaaaaaa

SEQ ID NO: 18254 - DNA, 683 bp, Homo sapiens
  misc_feature (1)...(683): n = A,T,C or G
ttcggagncatcaccctgcttgttattggnagnaatagnagcaaaccaaaatcatgatttccaccanaaagtccggcttctaggaatcacctctgctgtcttgcaaacaaagtctcctgctagcagatacagatttttgtcttcagagtaccgggtggcaggacttttcttttctcttctgcagggtatcttcaattgtaattctttcacttatacttgtttagccaactgctgtccttagggaatgaggcaagaaacttccttccacataggtgtttaatattttaatattaaagacttttcatctcaaggctttggtctatgcattttcattaaatattggggttttggaatccgaacccaaatttattaataaaatacctatgggtatcctctttttgggaggtaaaaattacccagaagaattcaccccaaaattttttttccagtaaagcaaagaaccaaaagccaattccaaattttttttcgttccatagggaataaatgggtaaatttggggagaaatcctaaaataccttgttataaaaccaggtggacactttggaaacaacaaaaggtttggtttgatatatttcaaaagtattgctactatgggaacccgcaaataacaggcaatggccaattagaaataccagggctcataaatactaaaaaaaaaaaaa

SEQ ID NO: 18255 - DNA, 549 bp, Homo sapiens
  misc_feature (1)...(549): n = A,T,C or G
ttcgggtcaccagctcgnacagacccttcttgctctgtcccaagacaaanaagaggctgctgcgttcccctctgtgaagatttgctggcctttgaaagaaacggtcagtagaagattcactggatagtgaaattctttgtgcctgggatgtgttcagtctgcttttctgctgcaccaggaaagaaggtccagtgtcttatttcattctggagctttttgaaactttttactctgtactttaattttggcaaccttggactgatgggggttgtagatattaattatcaaattgttatttatttagctgatattctttcaattcaataaatatttaaaatcccttgggggtgtctggtgaacactttcccagaaactgaaaaatatcttcagtcttcctttttttcccttccccaaataggaagaaaatactttcctagctgatagttattttctcttcacaaattcaatatattatttttaagggcttctgtaatattttgaactgaatgcaatttaaaaaataaaattttaagaccaaaaaaaaaaaaa

SEQ ID NO: 18256 - DNA, 1441 bp, Homo sapiens
  misc_feature (1)...(1441): n = A,T,C or G
ggggnnnnnnnnnnnnnnnnnnnnnnnnnnnnnnnnnnnnnnnnnnnnnnnnnnnnttcccttnnnnnnnnggggnnggnnntttnggnntgnngngnnnaccnnnnggtcgnatcccaccccccancnntnggccncaacaggactctgtgagatagggcgcgcttgcgaacgagatgcgcggggagcgactctcgnccctttcgtcttncntgtgagtgtgtgttgaggagagttattntctcgatgttgttttctgtgtgtggtagagtgaaagtcggtgtcagtatcaggggttgtaggagagcacaaaagacatcacagtatctccacggcgtctgacacgtgttgttgtttcctacgtaagggaagagaggaggttagcagcagagatgaaatggcacaaggctggcgaccgctcggcgtcgctccgccagggaggcacccccacaagaaacagccccccccgatgttgtcatttccaccgactacgcgcgtctgtgttacacctgattccgcccagccccgacgagagccccgccttgattcttgtccctcctacgttttcctcgttgtactccccgggtgggttgaggggctctcgcagtgaatgtgacaagcggagcaagtgtagaagcgtacgaccacgagctgtcatctccgtcgtattcaacaactacaacttgtccggacaggatctccccgcgcgccccgttcttatgattgatgatgtagttaatgcgttgttacgctcatgttatactacatctttgcacggaaagccctgctaatctatgccgcccacctcctccttgaattaactttcccgccgnccgacctagggtagcgtgagctagatgacacactcaagtgttgaagccttcgtgatgtgtgcagcacatggtgaggcctacatcatatctacggtgtggntctcctcgacactcccggcgttgcggtcgtgtacttacctgggactggacgaacgagagaataagtaacatgtgataccagaagtatcgcgaggcgcgtagaataatatacattattaaaaacagggagcgtacgtcttcgccctctgtattttttttgcgctgcgtaatccctacagttcttaaaacggcgtcttgtggcctcttcgtcggtgtcggttcacctgcgccgcaataaaccaacatccgaccgccctggtacaatacttcccatgagcaaccgcgatagaagctaccgcacaacatataaaacgtggttggagggaatagccgatactattttatgttcattgtggtccgccgcccgtcatttggcccgcccgagttcgccactctagattaaacgaccaaggtagaggctattcgcgataccggcaagaagattccgtttacgtgcgctttcaagttaagccgttaacgtaagcgcgttttggactattgagttgtcg

SEQ ID NO: 18257 - DNA, 1022 bp, Homo sapiens
  misc_feature (1)...(1022): n = A,T,C or G
gaagaaaaaaggtaggatggagatgcggaccgcgcactacgcgtttcgattgccagggctgatgcagncggatttggaaaaccacctgccaaacactgtattgggtgggaagttggttcatacctgtcttaattggccaagattctattcttcacctaggatatctctgtaaatcatgaagtgcttactaaaagtattatatccaaatgaatattcaaggcaaaacataaacgataaaacaatagagaatgctaataacacaaaacaaaaaacacagataccacaacaaacggccccccctgccgtcaacgacggacctcctccgcccctcacctctcaggcacggccggccccgacagcgctggccactgactaactctacaccaggtattcgcctagcaagctaacgccaccgcctagacctcggtcccggcagacgcgagatcacccccaggcccacgccaaacccctccgccagacgacgcgcgccacgtgaccagaccacgcgaacacgccacgcctatcgcaccaacactgccacctcccccccccgacccgcccgacacactgcgccgttccgcccgctggcccccgccccactccgtctccggtcccgggtcgcgcgtcgtcccagcctcacggccgccctccggtctccgcgccgccgcagccccaggatacccccgagtcgagccccctccccccccatcgctgcgcccacctaatacgcctacgaccgatgaacgaacagcctatcgccccccccaattaaccacccacccacgcctacgcatcatcaccccggcgactacaatattacaatcccacgccccccccagccaccccccaccaccgaatccaccacgcccccccgccacacatcccgcccgcactccncccacgagaccccccgcccaccctacaacgcccaagatcaatccccctcgaacgggctcccccgcantncaccctacgcaggcgccacagtccagtgagccagaatctcgccgctctgccgtttc

SEQ ID NO: 18258 - DNA, 501 bp, Homo sapiens
  misc_feature (1)...(501): n = A,T,C or G
tttccgagttcttgctctgtcacccagnctggnatgcagtggtgcgatcatggctcactgctgcctcgatctcccaggctcaagcgatccttccacctcagcttcctgcatagctgggactacaggcatggcccttcatggccagctaatttttgtattttctatagagacaaagtgttactatattgcccaggctgatctcaaactcctgggttcaatcaacccgccagcctcagtcttcaaaagtgctgggattacaggcatgtgcttttaatacttctataaattttacctatataccccaatgtcacaaaaataattccctagatatgttcctaaaatatataaagttttgacttccattttaacctctttaattttaaactcttcatccgacattgattttgtttgtttactctatgaagaaaagatcaatctcttttttaaaaataaggataatcaatcatcaaataaaaagttttggaaagaaaaaaaaaaaaa

SEQ ID NO: 18259 - DNA, 855 bp, Homo sapiens
  misc_feature (1)...(855): n = A,T,C or G
ttccagnaacctgttgactccttgggnagggnaaaaccanaccaagnaaatcccactgaggaatcaatgatacattatccttaagaaagaaatgagtaaatggaccgtgctcagtgcccaatgcacattcctatgtgttaactttcaagtgtatttccttaattgcctgaaaacacatggtcaggcaaattgacttagagtttagcagcgctatacccaatcttctaaatccattccctcccaccttccccaatggggcagacacatgtatacgaagaagcagcatcagtaaaccggcaccctagatgaaaggcaactgctcatccagaaggcaccaataacacagtcatgtttccattaaggggcaccttggcttatgcaaaactgtacttttgagatatgacacagaaaatcacatttttgtgaatcaaaatgtaaataatctaaaaaaggcactatttgaagggagcccaaatttttaacatgactaagggctccagaactgatcaaccctgtaagtttagtttgacatggaattaagtatatttgcttgaaattggttctgaaactattatttagacaaaaacgtgtaaaaatctttgaaaggcctttgtatcattctatggtctttatttgtattggcgntattattactcctgttattagtgatgaatttgcccaggtcagggaaattcaatgtatttatgcttttcttcaccttgccaaccgtaagtcatatcaaatgcaaatccatcccatccatttccccaataattccgattttgtacattttttttctgcagaactctcatagatcatttaacaatatactctggtgagataaaaaaaaaaaaa

SEQ ID NO: 18260 - DNA, 918 bp, Homo sapiens
  misc_feature (1)...(918): n = A,T,C or G
tttcacanngnnanctcgccanctctgcattncagtgtcccatcagttcagttgtgtgaagaaacattggcttgatcagcttcattttagaagctttctgatatgctgggattttttttttatgttgtttcctgagcttttggaatcctgacaaggatttatccatttggcgaatgtgcatctgggtaattctgttgtatcgtgtccagagtgtatccaccatgtgattcttacagccccagttacaggcaccattgttggctcaaggctttgctgctacaatcaacaccgtgaggaccattcttttccatgtccctataccatcatggagacaccatcatgtaggaaatgtgaatcttttacccatctcttcaggactcccgaagacagagatgagccttctgttcccagtgatcacagggcgcccaggatgaagctagcctcaagataataaaataagcctcgatcttgaggaggaaggcacttcttaaatagctgcaactccccgcacattgtaagggtgaacttccctgtttgcattacataagactgggcatctgactgggtgtggccacngaaaatgtagatgaaaaaaaacctgtgtcaccctcttgaccagatattatgaggcagggggtgaattgaaacaattccttctcctctgcctgggggaatggggaaggggggtccttttcatttttttggcctcaccaaaaaaaggtgggggttgaggaccctaactgaccttccataccgagagagaaaaaaacccttactcgcttttaaccctttaacccttgtagattggtggtccaggcccccctccaaaaaaacccttaagccttcttttccatgctttaaaaaaacgctcgcttttttggtcacccacgctacttggggggaatctcaaaaaaaaac

SEQ ID NO: 18261 - DNA, 432 bp, Homo sapiens
  misc_feature (1)...(432): n = A,T,C or G
ccttccgggnnaactagcaggtacctactatgacactntatttgaaagnaaacccatcttcaaactatagatttactgagaaaggctagtactctgttggactttggaagacatgacttttggatacaaagaatttaaacacatatcacttctgttaaagaaacaaacagtagcagcagaagcaggattggagaaatcaaagaagaaaagggcgttttctcttccttcatagatttttgttatactttaacatggtagccatttaattctgtgggaagtttaagaatgcagtttatctggagaatgcatagccgttcaagttgtgcagtattatttatgtctatttaaaaaaatagtaggtagcatgtactttggactcaaatgttgactgtattgtgtggaataaatttagtaaactcaaaaaaaaaaaaa

SEQ ID NO: 18262 - DNA, 918 bp, Homo sapiens
  misc_feature (1)...(918): n = A,T,C or G
caggaaatttaacatctgtgaactgctctctgaggccccanacataaagtctgtttattggcataggggagaggctgaggcagcctaaaatctaggctaatattatcacctttgccatgcatgttttcccacaatctggagaccggtgtacataaagaaaaagcaacatctgtgatactccttatactactttgtgaaaatcaatggaaatactgcaaagcagaatattacgatgtaagtttgatcactgcgaggctaggaaataatgagaaaactcctgccatgaatagaattctgccaagcaggaagaatatttgctgaagtggaagtggtgggaatctcactaagaaggggaacagttagtgccaggcattacaaaaggtggattggagaatgcggaagatgttcgggctgagacttgagtgcgccccagcatcatccactgaccccgcgccctcaactacgccatgagtgccacccctccctccccacccacacaatgatctcttttccccccctctcacgccctccctcctccccccccctcccccctgcccccccgttgccgctctcccccaccagcatccccatatggcccaaagcccactcatgccgaccgtctcaccgcaaccccccctcttcgacgacgtccgccgactttagattacaaactccccccccctcaccttaacttcaccacgtcgacatatttctcaactcccccaccacgggattacctaatggtgcatgtacgccgggccgccatcgtaccaatgtctctccaccgcaagtctaccttccattgtaactgccacaccaaagcctaatgtgtacccgcacacacttcagcgcgctaatcgaggattactcgctgtccaccgctaccgtatgatcataccaacaatcctccacccacat

SEQ ID NO: 18263 - DNA, 217 bp, Homo sapiens
  misc_feature (1)...(217): n = A,T,C or G
cggtgcatactcgctaccttaaaanagnatatttattgtgngagacacaatttacatggtagtcgatgcctgttttatagcctcacaaatagatgtatgaactcaagcatataatggcccaaccagcaggcgcaaatacgttctaaatcttctaaatgtgcttcacaaaaatgtaactgaggaatataaaacagatcaattctgaaaaaaaaaaaaa

SEQ ID NO: 18264 - DNA, 622 bp, Homo sapiens
  misc_feature (1)...(622): n = A,T,C or G
cagggaagaggtgaattcaagnacatagctgttatcttcaccaagnaaaagctggcagtattggataaagcccagataaacctgtaccaagacgtgatgctgngaaaacttcaggaacttcatctcagtggggtcttgctctgtcacccaggtggctggagtacagtggcctgatcgtggctcgctgctgaagccttgaactgctgggctcaagtgatcctcctgcctcagcctcctgagtagttgggactacaggcatataccaccactttcagctaatgttttcttttaaaaatttacttgtagagatggggtcttgctttgttgcccaggttagtcttattctggtttcaagcaatcctcctacctcagcttcccaaagtgcagggattacaagtgtgggccactgcactcagcccacaatgtcttttattttttcttcaaaaacaatgtccttttctgttttaattgacttataagtttcttcatttggatcatgggttattcctagcttttcttgcattatattttcctgcccgctatagtttgtaaacagaacagccattcaagtgcaaataaaaccatccctgaagtgtcattttcttactgaaaaaaaaaaaaa

SEQ ID NO: 18265 - DNA, 863 bp, Homo sapiens
  misc_feature (1)...(863): n = A,T,C or G
gttcgggtatcaccacctgtttatacttnttctaccctgctgtgtggcctggacaaaatcagaaacttccttgctctcttgtttctgaagagtagaagatcagaaagaagaaaagtgagcagatctctagaacgtactcatcttgcttaactggaactctcagcccatggattagcaactccaccaccttctcctctgccctacaccctggcaaccaccattctactcttcgattctataaattttactattttaggtacctcatgtaactggactcacgcagcatgtatccttctgtgactggcttatttcacttagcataatgtgggaatgcaaaatggcacagctgctaaggaaaacagtatggaatttcctcaaaagaataaaaatatatcttccatatgatcaaacaatctcatttctgggtatatatccaaaagaattgcaatgaggatctcaaagagaaatctgcactcccttgttcattgaagcatattgataaccggtagatacataaacaacctaaatgcgcctcagcggataactggataaacaaaaggggcctatgcctggaatggcaaatcaccctgcctttccaagcaatcgcactctccccgagtggaagcatgcgccaccccttcaggatgttttccctccgcaaccctctcgccagtcccacagtagtagcgcctcttcctgcgtggacacccggcacatatacgtatgtgcacccgcactattagtcgcgcgtccgttccgacgggcgtacagacgcgaccccccgcagagagcccgcccgtggccccccgtcgtcacccacgtccgaccctccctcccgagcagcggcggaccgccccccgccc

SEQ ID NO: 18266 - DNA, 867 bp, Homo sapiens
  misc_feature (1)...(867): n = A,T,C or G
cactatcaccanctgtattacttttctaccctgctgtgtggcctggncaaaatcananacttccttgctctcttgtttctgaagagtagaagatcagaaagaagaaaagtgagcagatctctagaacgtactcatcttgcttaactggaactctcagcccatggattagcaactccaccaccttctcctctgccctacaccctggcaaccaccattctactcttcgattctataaattttactattttaggtacctcatgtaactggactcacgcagcatgtatccttctgtgactggcttatttcacttagcataatgtgggaatgcaaaatggcacagctgctaaggaaaacagtatggaatttcctcaaaagattaaaaatatatcttccatatgatcaaacaatctcatttctgggtatatatccaaaagaattgaaatgaggatctcaaagagatatctgcactcccttgttcattgaagcattattcataatcgctaagatacataaacaacctaaatgtccatcagcagataaatggataaagaaaatgtggtatatgcatgtaatggaatattatcctgcctttaaaaagaaataaattctgcaacatgtgacaccatggaataaccttcaggatattatgctaaggaaccttctgagtagtagaaatgttctaagtctttatctgtttgggagatggctctctgtatctatgtatttgcctatataatgtattatcataacggaaatatatgtaaaaagtatcgggttgacacttaagctgagcccctttctaaaaatgtatggctttattaaaaaaatgaaaagcgctaatttgaaattaaggaatgaacccctttt

SEQ ID NO: 18267 - DNA, 834 bp, Homo sapiens
  misc_feature (1)...(834): n = A,T,C or G
caggtgattcgcatatcanaaggacacacatggtngattttgtgctataacggagggctcaacaggttgctgatggaagaacagaagacaccatgactctgccaggaaagccacttcagagaaaaggtggtaacttatggggtcttgaaggaagaaaatgattaatgtcaaccatacagaccttctagactatgcagagaaagtatcaaccatattttactaatgagaaaaccaagaatttgaaaaaatgtattattagtcgatggttccatgatattttaggggcagaaatggaactaaaactcagggcttatcatctgtatctcttactacttctattctttctcccattctctcacatgaataatatctaagtttgcagaaagaaattagttcagcagtttaattacactgtggataacttttaatttattcatttctcatggaattatttcctcttgcttgatttatgcccttacttgatctatttcattttactttgattttcccctttgtaatcagatgatgcatctttgataatatttcattctctttctgtatatagccatttgtttttctctccctggagaactaattcatatatattctaaaaataagcaaatagtgtaaatgcaaatgggcttcaaaagatactttacaaacgccttaattgaacttttttttcacttgtatcctgatgccaaaaggtcctaactttaaaacatctcccactaggccatctcaatgtaaaagaactctcatctgattttcaaatattggaactacctatttccctaactctgataaaaggctttgtagcgaaaaaaaaaaaaa

SEQ ID NO: 18268 - DNA, 626 bp, Homo sapiens
  misc_feature (1)...(626): n = A,T,C or G
cagggaagaggtgaattcaagnactagctgttatcttcaccaagnaagagctggcagtattggataaagcccanataaacctgtacccaagacgtgatgctggaaaacttcaggaacttcatctcagtggggtcttgctctgtcacccaggtggctggagtacagtggcctgatcgtggctcgctgctggagccttgaactgctgggctcaagtgatcctcctgcctcagcctcctgagtagttgggactacaggcatataccaccactttcagctaatgttttcttttaaaaatttacttgtagagatggggtcttgctttgttgcccaggttagtcttattctggtttcaagcaatcctcctacctcagcttcccaaagtgcagggattacaagtgtgggccactgcactcagcccacaatgtcttttatttttctcttcaaaaacaatgtgctttttctgtttttaattgacttataaagtttcttcatttggatcatgggtttattcctaggtttttcttgcattatatttacctgccagttataggttgtgaacagaccagccattcgagtgcaaatgaaacccatcctggagtgcgattttcttactaaaaaaaaaaaaa

SEQ ID NO: 18269 - DNA, 933 bp, Homo sapiens
  misc_feature (1)...(933): n = A,T,C or G
ccggcaatttcatacctactaatgaaaaggnacactatcccttcttcagtgatgcaatgttaaagtagacacatcaacataaagtgcttgattatgatacctctcatatttacactagacatatgtgtatggtgaagaaggaaggcttagccatgggtcggatattgttggaagactggaatgattcatacaaactcaaggaggcacattccttgttgagaacaactttatgatatatgatattaccgaccgaactcacgccatattcactggtgtctatttatcattgatgatgatagtaactatacccacatttactgacctgaggggggctgtgcaacatcattccagatgcgtaggaatgaggaaagaccagatgactggtagttaggaagggacacaaacactcttgcttgctcctgcttccatnatgtactgtgacctgctcccccttcacctcccggccatgcttataagcttgctgagacccctgtagacctcaagcggatgccatctccatgctttctgtttagtctgcggaacgatgagacacttccatcttttttcttgataactgacaaaaacaaaatcaatgggctccctgccctcacctcgaggccctctccccccgctccccttaagtgagggctactcctgaccctccctccctgactccctgccctcccccgtccgcgccccgtgcaccggcgccatctccctacgccgggcgtacttccctcctcccccgaccccgcggcacccccccgcactacatctctcgccagagccccccgatggcctccaccgcacacaggccccgtcccttgcccctcttccccaggcgttttctcccccccgaacacgaccatgccagcccctcagtctcatcgtctcccccccccggagaagatttctatgctcacgccccttttc

SEQ ID NO: 18270 - DNA, 394 bp, Homo sapiens
  misc_feature (1)...(394): n = A,T,C or G
cagaaacactggngactaatgccatcagnaggatgagaggaagtgctagagacaggactagcatcaaggaagtcatggacttggcagctctgcaatttgccgagagaggaacagcagcaatcagggaggctgacagacagtccaagatctctcagaagactcttgactgcaataatacttctcagagagctcagaaaaactttttccttcaacccgtccttatattgcaccatttttcactttttcccaagtttacactcattctaatttaatatatttctatattaatttactatccatcatgtcttttaaaaattttcatatttgatccaataatcccattattgagtatctacccaaagtagaataaacctttatatgaaaaaaaaaaaaa

SEQ ID NO: 18271 - DNA, 554 bp, Homo sapiens
  misc_feature (1)...(554): n = A,T,C or G
cagtctttcaacacaatagncccatttatgcaaaatatcactctgttgggatgcatacatcagggcagcaaatttaaatagcctctaataacagagtataatgattgaaagttggagaaagaatattacttgctgatgaaaaagaaaaacagaaaatcaagacaagtggtgaaggatttcataagcctggatctcattggacctgtccctgagtcagtgtgagactgttgagaggatgaaccatttcctcagccaagaaacgagcagacaactcttctaaccatctgggaattcagtttttacagtggtttaaattgctcctcatggcattttattctaggtgctaatattcaaatatttaaaattttaaatgaagagatgatttttcattaagtttgactggcttttactcttgatcaaactaaagtaagcaagacagactaatggaaatttagtgcaaatttaaagaaataccgctttcacttttatttgtgtaatattaaaaatttttatttctttttaaaataaagcaatggtttccaaaaaaaaaaaaa

SEQ ID NO: 18272 - DNA, 566 bp, Homo sapiens
  misc_feature (1)...(566): n = A,T,C or G
tttccagggaaancacaccattcctatcctccanagnattggctctcagaagccatcttggaagcagaaagcagccctcaccagatgtcagcaccttgatcttggacttcccagcctccagaactaagtggtactggtgagacaacatcaacaattctggtttggagaaccttccacagaaggcaaaacaagaacaacaaaaaaccagaaggaacccaggctgctggatgaccctgtggaactgagctgtcccaaagccctgaagtctgttttggatgaataatcgaatcaggatggacccccgcggtttcctctgaaagtcaaggattgaaggattatttagctgtctgggctggtaaacctccactgcaggagagaaaggagaaaatttggacatagacaggtggagggaaggccatgtggagacacaaagagaagagagccatctacaagccaaggagagagccttcagaggaaactaaccctgccaacaccttaatcttggaattccagcctccagaattgtgacaaaataaataaattttagttgttcaaaaaaaaaaaaa

SEQ ID NO: 18273 - DNA, 868 bp, Homo sapiens
  misc_feature (1)...(868): n = A,T,C or G
tttccaagatctcactctgtcacccagnctggnatgcagtggcatgatctccactcagctgtgacctcccgggctcaaggaatcctctcacctcagcctcccgagtagctgggactataggtctaccaggattctgacaggtgccctccaagaatggtgggtgtctcggcctctggctccatccactcctggacatctagctgggtagtgctttgcttaagctctgaccctcccgtcacacatagcctgcatcggcctgatcagcacccagatgggctcactccagccaccgtaaaggtgcaacattgcaaacaacctgcctcagcctctctactggggttcctccaaccacttccatgagagaccttggacaggaacccaaagctttttgcaggcactgcctatcagatgtggaagaaaacagcaagacaagaagaggcagtgacccaggaaaggcccaccagctccagaagttgcctactccacaatacggagattgctcatttcttttaaggaccattcatttgaattatgcaaataattcattgaaagttgggaaatttaaattcctagtggaaatacacacacacaactatctaggatactaatgcgccttttttgagctttttaaagatagctctggttaagagcgatttctaaacttctttgagggtgggctggtagacttcacaaaatgagggcaagacatggagggtggggagagagagaaagaatttaaaagtccacgacacccccttaaatttgaatctcagaccatgcgttgcccattattttttactccacactgcttaaaaacagattgtgtgctgtcttttcccccagtatttgtgtactgaatgggcaccaa

SEQ ID NO: 18274 - DNA, 646 bp, Homo sapiens
  misc_feature (1)...(646): n = A,T,C or G
cagggaagaggtgcacttcaagnactanctgttatcttcaccaagnaanagctggcagtattggatagagcccggataaacctgtaccaagacgtgatgctgngaaaacttcaggaacttcatctcagtggggtcttgctctgtcacccaggtggctggagtacagtggcctgatcgtggctcgctgctgaagccttgaactgctgggctcaagtgatcctcctgcctcaacctcctgagtagttgggactacaggcatataccaccactttcagctaatggtttcttttaaaaaattaccttggaaaaaagggggtcttggcttggtgccccaggtaatcttattttggttttcaagcattncttcctacctcagctttcccaaagtgcaagggattaccaagtggggggcccactgcactccaccccccaatgtcttttatttttttctttaaaaaaccaaggaccttttcttgtttaaattgacctaataaagttccttcatttggaatcatggattatttcctaggttttgtttgcactataattgaccctgccaatcttaactggggaaacacagacaccctttcaagggcctgatagacccttgcctcgaacgcgagtttgtttaccaaaaaaaaaaaaa

SEQ ID NO: 18275 - DNA, 481 bp, Homo sapiens
  misc_feature (1)...(481): n = A,T,C or G
ttcgactaggggnaggcaggcagggctgtgaggccccccaccaanaactggaagaactttctcgaatcctgcagagctgctcagggcctgccttgtatctgcctggctgttccagggaggttggaagacaaactgaaggctttccattgctgaacatcagacctcagaagtactgactggagggctcccaagctggctcagatcagcctcatattgccccgaacagtatcatcaccgctttgccctggtggggaaactactctttaccctctgtatgaacctatgaagcacgcaggtcactggggcaatttctgagtttgaagttgcttggatttgccattgctgctatgttgaggggaaaggagtgcttttgaagaaaatggtcatctctagttccagtaacaggcatggaattgacacctaacacggggttgttgaaatgagcctgataaattaaaatctgggggcaaaaaaaaaaaaa

SEQ ID NO: 18276 - DNA, 407 bp, Homo sapiens
  misc_feature (1)...(407): n = A,T,C or G
ccattcttaatggactggnnanccccagcagtcacactggnaccatgnagnnattcttgaaaatggaagccacaagccatccatagagtaggaacaagatggaaagagggctagctctgaaggtatgttcatcaacatcgtagaagaagaggacacgtgtttcgcactgcactctttaagaggagaaacggaaataacggggaaaagtttttaaaacttcagcaggtttccctttgcagtttctgacttagccagaagacatcaggcaaaaggaacatctccatgtgagccaacatttcagaaaggcttcaggggtgttggagaatgaatgcagtgattttctgaagaaaagtaggggagtattcaaattaataaagagaaccaatgttattttaaaaaaaaaaaaa

SEQ ID NO: 18277 - DNA, 472 bp, Homo sapiens
  misc_feature (1)...(472): n = A,T,C or G
caacagggatctcgcgcttcgcccatctggnatccaacgcacaatcctggctcactgcaacctccgcctccaggttcaagcagttctcctgcctcagccaccaaacttttgtgtacaagactacactgaactctggcaagccattcttccgtaacattgtatccgaagatgtatcacctgaattccgtgtctttggaagctttcagggatacaagtttgcttatacatttgtccatgttgctgcagaaacactgttccatatggttacctaaggtgttttcccccaataatatgtattatctttgattctgattcaaaataatgcatttactaaagtcctgacttagctgcaatattcctaaaacatttgtgctgagagaaaaaaatgttttgccttgtaaaatttctaaaatgtttttgctgagagaaaaaaattaaatattttggttcttaaataggaaaaaaaaaaaaa

SEQ ID NO: 18278 - DNA, 393 bp, Homo sapiens
  misc_feature (1)...(393): n = A,T,C or G
cccttcttcccccactgttgnctgagctgtcttcccatggnaggctgatgacagaagatgcctgctggctgtccactgcaactctgtatccagagtgaaattgaggcttgctagaaagattttaaaggcatttttttaaagataagagggcatcattaacaactttatgccagtacattttggtaaaatgtataaattcctagaaaaacaagagttaccaaaacaaacacaagaataaatagaaaatctaaataattaatgcatcatttaaaaatcttcccgtaaagaataccccagacccagatgacttctcaggtgaatactaccagacatttagaaaagaaatggcatcnaatttacataagtcttccagaaaacagaaaaaaaaaaaaa

SEQ ID NO: 18279 - DNA, 842 bp, Homo sapiens
  misc_feature (1)...(842): n = A,T,C or G
cacctatttgcaaacaggcanaaaaacacaaaaggnaaaaaagtcagtttgaagtgtgaaatcaagtgaatgaagtaagacagaagcaataatctctacaacaaaagatgagaacttgcctcctctaaatcccatacacacatggctatttgttccaagcttatgtggatcatcgctaatttacaaacagtgggtgatgtgctataaagaaaatgactcattggcccatctgtaatttaaatatgtgacaaaatgtttaaatgtttcaaacaatggttaattattagagacttaacagtttgaaaacaagtgtggagcttttttttttttttctgtttttttggcttcattttgaaccaccccaaatggacatcaggtgtttgactcttactgagatgcagcccataatgtttaattggacaccctcgtggaaaataaaggagaaaggatncatttttattttttgcaataccctgggcaccattcatgcacccgaccggtcttacgcctgcctgaaaagaaaccgaacccccgcgctttatttaggcaaaaagtataacataagggtcttacttggctcccacgcagcgccatgttatccttttcttttatagagggctcccaacggaagcatcacaactcacaccacacgataaacctcccgacacgagcacacaaaaaattagacactgcacgtaacgtacacctacgcatacaacctaaaagaacagaatactcagaacatcgaagctaagcatacgacctgaaaacgaccggcgtaacctgtaacacgcgtatcggcgtcgtcacaaccagcgtacgcgtaccgcccgagtcctccc

SEQ ID NO: 18280 - DNA, 851 bp, Homo sapiens
  misc_feature (1)...(851): n = A,T,C or G
ccatttttcttatgnattgtgagcctgtccacccctggaactttatagagaaaatggggatggatttccccaaatatgtgctgactctcgggaaaaactgccgagccaaaatgtgtctacatgaaagttgctgactctacagagtttaggaagcttctattaagttaccttcaagctcactgcttatttccttggctgtgttatgtctactgatgaacccaagaaagatttctcgtaagagccttccttcagtaatcacttacaccaggatttcatgtgaagcactgcttcaagagatcctagcccaggacatccacccctcaaaagactgcgtctttcagacttaacaaataaataatcatactttgtgtcgccaagaaatattttaacaaatgaataccgagtgtctggaaatgaagtaatgcacaaagatataccacgcccatatgaccaaaaagatgcttttgtaacaattttaagcccacagtaaaagccctagatacccatgaagaaatgaaatgtgttaccgtttataccaaggtgcattgcccaataagctactagtcaccgccgcagtggctttggattgaaaaatacggtcaacatacccgccagtatgatattcacaaggctctgctggtcagtcacttctttcgagccaccttttatctctacctcccccttgcacatcgggcaaccgcccccgcgtttacacacacatgggcgaaacgaagccggcgcgcgtagcttttatcactcggacagagtagaaacctgcttcgtccccttgacgacgccaccgtcgtcccgtggcacaccaaaacgcaggccgtcgcaccccagtacacgct

SEQ ID NO: 18281 - DNA, 890 bp, Homo sapiens
caagtaatttgcaaaatttccctacaacgaggcactcagctgtgattacttgtgaagagaaaggtcaagctctgttgcccaggctagaatgcagtgctgtgatcatagctcattgcagcctcaaacacctgggctcaagggatcctctcactgcagcctcccaagtggctgggaatacaggcaacatcatactgaacaggcaaactctggaaccactccttttgagaactggaacaagacaagtatgcgcactcacaccactcctattcaacatgctggaagtcctagccagagcaatcagacaagagaaagaaataaaaggtatccaaacaggaaaagaagaagtcaaactatctctagtctctggaattttaatttaactaaacttatttgtttaatgagtatctgatatacttgaaaatatgatttattcaggttattctagttgtttcaatctctaccatattgtaactagattcagaggccctataactgctttcaaaaatcttcaatatctcactatagtttagaattttttggtaaaaactactcttttgattatcaaaccactcttaatgttatcatttggaacaatatttcatgttaattgacctttatccactctttaacatgaaaaagaacatttattcagctaataaatccggagctctcgcactgccaaaaacaaaacaaatggccctccgtggcctaaacgcaggagctttgcaagccgcttacctttgatagggggaaaactcgcgcaggagccacccgactaaactcaatcacactaacatgaccacaagttacccacagacgtacgtacatccccaccgatcacacgctccgccgctcccctcgcaaccacgaccacccgcgacagaaaacat

SEQ ID NO: 18282 - DNA, 900 bp, Homo sapiens
  misc_feature (1)...(900): n = A,T,C or G
ttccggcatgctgcgcagatacgtcaanaaanagcaatgccctgcttgttggagtaggaggcacaggnaaagcagtcactcacgagacttgcagctcatatatgcggttacaaatgtttgcagattgaactcagccggggatataattatgatagttttcatgaagacctgaggaagttgtacaaaatggctggtgtagaagacaagaatatggttttacttttcactgacacccagattgtagcggaggagttcctacaagatataaataacatgctgaactcaggcgaagcgcctaatctatttgaaaaggatgaactggagcacgctttagccgcccccacaccagagcaaaagaagcacgaatctctgaggggcacacataccagggatgatgcgccccataccttatggggctttattacagccccctgtcttcacctttcatttaacccattcatgcttgcactcaagcggcccttcacttccatttttttccctcccacccaaaccaacaaacatggcccgtttgacccctcctcgtggtatcaccctgcccgtttccttcttcgccgcttaaatatggatcctccaatcctcccccaccgccccctcacctctacccccccccgcccaccgactccctcccccgcccagcattcggttcccaccgttacatgcaacatcgtcaccaacacaagttatcaccccctccccccccgtctccaaacccaaccgtcgccctgacttgccgatttcctcatctaccacccccctccaacacctccactcctttccaccactcgctcaccgggcggacaccttcacgccattctccgctacctcctagtacccgtatagagccccctgcacgctgactccgcgttccgcgtgcatcat

SEQ ID NO: 18283 - DNA, 445 bp, Homo sapiens
  misc_feature (1)...(445): n = A,T,C or G
ccaggctggaaaacttaatggnanaaataataagactaaaaatgattatcatcccttaaagaaactcatattaagttacaagaacattataacaaattatgcaatcaaaaaacgtttgaggaagacaaaaagtttcaggtgaaaacaaagcctctgatatcaactccactacaaagccatttgcaggcaatcaagacgactaaaaatacttctggtgatgatgactggcagagcctcattacgaatcaactaaataaaagtgaaaatttactaagtttagaaaatgacaaccagccaaaaaaaaagaaaagcagaagagacgttggaaaaaaacaacagattaaaataatgtagataagtgctttcagtagtgaaattatgtaactgaaattctggtatagtttttactagaataaaatgactgttgtatttaaaaaaaaaaaaa

SEQ ID NO: 18284 - DNA, 907 bp, Homo sapiens
  misc_feature (1)...(907): n = A,T,C or G
tgtctgagccagtgtcccatctctgctcactttgggnacatctgtgagcagggtgcctcctttttgtccctccaaaaggacagttgggggacttggcctctggccgcctcaagttgggtcagcacctgccgggcctcatcctggttcatcgtgcatcaatgggagcgcacctgggttctgctgacatgtgagagcttcttcaccgaggggttcagaaaagtgtgctcatggcctgtagatctggattcaaagggagatgagaaaataggaactgagcccgtggcttgcctcacccacttcctgagcctgcgcaagggacaagactttcctgtgtggccttcttacggcagtccacagggaaggggactcattttctgtgtgttgacttgaccagggacccccactctactgtgctggggccagggcatgcccttagcagggggcgggactccagacccgcgtagttctgtggtgtggctgggatgttgaggttccgtccatgggtgctgactggaacctacgcggggaccacccaaaaacccacgcctatcaacattgggccattgcgcctgttcttcctcggccgccctgtgagccccccgggaccggttctcgtcaacgccgtgcgcccccggcggcgctctatgcatatctcgctactaatcatcccctgcgtcggtccctccccccccccacacatttttcccgcgcaccctgagctgttgtacgccccgccctctcgcgcgcgcccccctcggctcggtcctctaccccccgccgaccccctcgccccgtgctcccactaaattttctacgcgcccatagagcgagagacggaccgaacattgactccgtgtacgacgttccactgccacccactcgcacgtccagctcacatccacccccg

SEQ ID NO: 18285 - DNA, 515 bp, Homo sapiens
  misc_feature (1)...(515): n = A,T,C or G
ttttccagtactgctatgttcgcaatttttctactggnggtcttcagtgctatgaattttatacaagatacatatgaagagtaagaactcactgcctattaagattgttgcaaatattttcctcatttgtcagttaattttctttataatccttttttgtttataattgtaaagcagtttaaaactattgaatttttcttcctctgcttttattctgtctttcaccctacttatcagactttcaaggaaagtatagaaataatcaccttaatgtgatttttttaaaattatgatttcttttaccttaccaagaatctcctcggatgccagaattgacttttactcctttatacattaatgattatataacagaaatcattatcatgttgatgtaaccaattacctaaaatatgtaaattcactttcattatcttttacccaaagaatcattctatacttctgcacaaggtgagaataaaaaagacactttataaaatgactgaaaaaaaaaaaaa

SEQ ID NO: 18286 - DNA, 849 bp, Homo sapiens
  misc_feature (1)...(849): n = A,T,C or G
ccggaaatacctgatattgcataagtgatcttcatgaacttcctattccctgtggagtttggaaggagaggcattcctgtaggcttctgctgagaagggaagaagagtcttcctgcttggacactgggcttctgaaaaggccatgtgctctcctatctcacagttttctttcttttactttttttgtttgtcttttttctctttttttatcctttttttcttacctcacagtcttgtatgtgttttgactgtcacaagaatgagcattggatgtggtagaaaaaattcttggattagtgcctctcattagtccctaaaaatacatatgtatctggccccaactcctggtgactctctaagcttatgatgcattttttggtatgttttgtatacagttttgagcttccgcaatgatttttaaaacacggacaaatcccatatgaacattctgttatactccattaaattgtccataccccagatacaggaaaattattttctcattctaactttatataccccatatctaacaaagcacctgcaaaatgggtgctactcaataaatattcggtgaatgaatgaaggaatgaacagcccaatgtattccctagaaaacgtgactataaattctttggtacacaatcgaccaccaaccataatctatgaaatctgccccccgagaaatgctcatcatctctttaataccttataacaaccagagttctttaaccggggccccttctaccatcgtggatattttatgtctgcgagatcttcatcgccgtgggcccctcctcctcctcattacgnaaaaagttcgaaaaccgtgcggagccataagacacaaat

SEQ ID NO: 18287 - DNA, 495 bp, Homo sapiens
  misc_feature (1)...(495): n = A,T,C or G
ccaaaaaacactgggncacttncaccagnatggnaaaacactgnnaccactatcatgtagccctaagataagaaggaactgaggactgaacactgacagaagctctttttctaaatttcttcctgcagggcctggcgaatcatgcctacaggccaggcgaaaccttaacattcctttcttctaaccccaagtttttacacaaagccttccttccttaacaaattgcaaatcatagagtctctgaatccacctataacctgtaagctcccacttcaagatatcccacctttttgggagaaaccaatgtataccctctatgtattaatttataattttgcctctaacttctgcttccctgaaatgtacccctgcctttcaaaacctttgcttgtaagacatcagggagtttgggtattaagcattagctttccaatttttcttgcttgttgtcttgcaataaatacctcactttctctgactgcaaaaaaaaaaaaa

SEQ ID NO: 18288 - DNA, 1041 bp, Homo sapiens
  misc_feature (1)...(1041): n = A,T,C or G
gggtggggcctgacgagggcnnagacngaacctgtatttaaannnggnttttccgaataatacaactacaccctnaaaaaagtncagtgnactnacaataatacacagnaattagtttntgaaatgaagatcttgtgagtttacatgccatgctgcttacaaactatctcatttttataaatatgcataataaccctttcttcttatcatcatctccctcccatgcttataatgatttggggcaaacattaggagctatcagtgaataaaaaagtgattaggggaaataatgaattaatgaataaatgaatgttcatttaaagaaacttaaagaaaaaataaaaattgaaatatgtcaaaatttaggaacaattcaaaactttaaaagtaagtctgctgggagggttacaatcttttccaaaggtcaattatgcccatttcaaaaagttttcaagttaaatgctgggtttgcatccaaacaattttacttgtgggagtttttctcctaaaaaaaaagcaaatgagtccaaaaacacaaaaaaaaatggcactaattggcctcaagagcgggagcttctgaaggccggttcgccttcagggaggggtcgattccatgaacctaaagtaactaactcccctacacttcaactcattcccacccagaataatcccacaatagagtaaacctaggcagcgacgcagcaccccgcgtacccccaccctgccgcgtcacacccgacgacaacaaactggctgagtcttaggcgtaaaacacggcacctataagcacaactcatgcacccacanctctcgcctactgcggcactccgcctccgccccgccctaattccgagtcgtacttatcctctacgccgccgcacacngtccccgaccgccctactcgcccacgatgttgctgtgctcgacacccactcgcaccacctgcggcaattcacgcctgacgcgagcctgcacagtagacagagctcgacccttccatcgtaagctgagcaactagcagcagtatcgacaacaatagag

SEQ ID NO: 18289 - DNA, 628 bp, Homo sapiens
  misc_feature (1)...(628): n = A,T,C or G
ttcgaggaaagaggtgccattncaagnactagctgttatcttcaccaagnaaaagctggcagtattggataaagcccanataaacctgtaccaacacgtgatgctgngaaaacttcaggaacttcatctcagtggggtcttgctctgtcacccaggtggctggagtacagtggcctgatcgtggctcgctgctgaagccttgaactgctgggctcaagtgatcctcctgcctcagcctcctgagtagttgggactacaggcatataccaccactttcagctaatgttttcttttaaaaatttacttgtagagatggggtcttgctttgttgcccaggttagtcttattctggtttcaagcaatcctcctacctcagcttcccaaagtgcagggattacaagtgtgggccactgcactcagcccacaatgtcttttattttttcttcaaaaacaatgtccttttctgttttaattgacttataagtttcttcatttggatcatgggttattcctaggttttcttgcattatattttcctgccagttatagtttgtaaacagaacagccattcaagtgcaaataaaaccatccctgaagtgtcattttcttactgagaaaaaaaaaaaaa

SEQ ID NO: 18290 - DNA, 1113 bp, Homo sapiens
  misc_feature (1)...(1113): n = A,T,C or G
tggattggttaggggaaataaattttttttttttatgatttggaggtttccgagtctacacactttgtgagactactggtagacaacattaccagtgactggatgtatggaagtacaatgaagaatttgttcttgaggaagtaaccaaacagtaagactcatgagagagtaaacacctttgtaaagaatctgtaaccaataccatgaagttcaggctgagatctgggctccctgactttatgaagctaaaaaaagttgtgtctaccaaccacctttacatccccagcccctataataccctggaagcactactgaccaaagcaagaagcttgagattgattaattatatgttcgaacttatgcccatatgatttagcttctgcaacctgaaagcaattttcgaaaatgacagggtgaactgtaagtgtaanaaacaaagtatgaatgcgcctacgcatggagctcataggagagagagactatgcggcgcgaattgccctttcgacagagggattaatatcatcgatcccagaagtggactaaagctcaagtgaagctcaaaacgacacaaaccagcccaacaacatgactatcacgtgactacctgcacgcgaaactcgctggacatactaaactaatgagagattactgaccaagcaacaatcatgaacgagacaaaatctttcctcaagatgccctacttctacgctctggcaccaagattcccaatagtaataacgcaagaggttcgcgtccccccctgtgactatttgcccgagcagatagcgtcccccctccgcgagcaacaatacgattatatatagcccntagataaaaaccacaagaacgtcactcaagaccgaatgtcaacccaccgtacaacctcatatgaaacaaatacttcccacaagccgagaacccgtctactagaaatgtcaacacttccttacgtatatgactcgacaactaaccaagaccgacgtgtaccacacgagttggtcgtaagctgcgtatcagccggccgaactattaatcatatgttcaccacctttattctattcataagagattcagataaatcttcacagcactagctggaaaagccacagtcag

SEQ ID NO: 18291 - DNA, 200 bp, Homo sapiens
  misc_feature (1)...(200): n = A,T,C or G
cgagtggacctggtattncagaaaacaattnctnccttaaacttcctgcatgcaaatcaccaactcanaatctgcttcctgggaacccgtctgcaatatgctgtgatagacaatatgtggagtcctgcaagaacctgcagaattcctaaagccaaacacaaataagaataaagaaaacttttcaaccaaaaaaaaaaaaa

SEQ ID NO: 18292 - DNA, 567 bp, Homo sapiens
  misc_feature (1)...(567): n = A,T,C or G
ggaggggcccgccgaggccccgaagggcttgagtttttggncagngttttcgtgctggagacgcatgttgtgnactcggctaacccacctctgtctcctgngattcagcgaattctcctgcctcagcctcccgatagctgggactacagtcttgcacctccacgcccagctaattttgtatttttagcagggacgtggtttctccatgttggtcaggctggtctcgaactcctgacctcaggtgatccgcccacctcggccttccaaagtgctgggattacaggcgtgagccaccatgcccagccaattgttcctctttccatagaaaaatctggttttgtgtcactgggtaacacaagcagcaggttgggatagaaaactgatgatgaatatggaaatgagacgcagagccatgacaaaaaatctggatatttccactaaatatttgccaaccagtgaaagaaaccagaaaacaaaagctgggaagccttgctcattacataccatgcaagctcattaaaaatggctctaacacgacgaaaaaacaaaatggtctcggtggcctca

SEQ ID NO: 18293 - DNA, 185 bp, Homo sapiens
  misc_feature (1)...(185): n = A,T,C or G
tctgcgaagctagtcnttncagccagntncatgtgntgnccctncagngaancactgtnncttggnaagggaagaaagggtgcactaaaatggnaaatcacatttatcaagttctatgctgctgctaatgctgaacaggataccttaaataaatatgccttttaacactgacaaaaaaaaaaaaa

SEQ ID NO: 18294 - DNA, 453 bp, Homo sapiens
  misc_feature (1)...(453): n = A,T,C or G
cagtgttttccctgcctganagttcctcctccaaacatcananactggatgaaactgaagaccattatcttaagtgaaacaactcagacaaatatcatgtggaaactcactgggctgatgaatgcagtcttcctgatgtgaatgggattgaagagcttgtcaaaaaacataaagccaacttcacccttgtcactgaactgagacttttcaaccaaacctgttacacagaaaagaaaataccgaaagaatattcatcaatctgtaaatagtgattatctgtggggtatgtgtggaaaattataggagacttaaatattctacatgatagatttttataatagtttatttttataattagtgtgttatgtttgtaattataaatcgacaacagcaaaatataatttaaaggctcagagttttaataaaatatttagaattggaaaaaaaaaaaaa

SEQ ID NO: 18295 - DNA, 482 bp, Homo sapiens
  misc_feature (1)...(482): n = A,T,C or G
gcgcaggtatctctgtcgcccagctggnacgcacggtgtgatctcggctcactgcaatctccgaatctccgcctcccaggttcaagcgattctcctgcctgagtctcccaagtagctgggactacagacgcccaccaccacgcccagctaatttttgtatttttagtagagacaggatttcaccatattggccaggctggtcttgaactcctgaccttgtgatcagcccgcctcggcctcccaaagtgctgggattacaggcgtgagccactgcacccggcctatgtattcgtttcttttaaaaaaaaacctatggatactagttatgtctacatgacacaaaaatttttgtcaatacagaaaagtctatggtaatataatttaagttagcttgagactattgctaagattaaaaaataatactaaagctgagaatttaaaaattaaaatgaacattttaattatggctaaaaaaaaaaaaa

SEQ ID NO: 18296 - DNA, 477 bp, Homo sapiens
  misc_feature (1)...(477): n = A,T,C or G
ttttcgccagggatctggctctgtcgcccagctggnatgcagtggcaaaatctcggctcaccgcaacttctgcctccccggttcaagggattctcctgcttcggcctcccaagagtagctggaactaaaggtgcatgccaccatgcccggctaatttttgtatttttagtagagacggggtttcgctgtgttagccaggatggtctccatctcctgacgtcgtgatctgcctgcctcggcctcccgaagtgctgggattacaggcgtgagccaccacgtccggctacataccatcttattacaagctgaagatatgttggaaaagctaaattatctgagaactcttaacatgaatttcaggaagcctaatagctgttggcttctagggaatatataaatggaatggggaggtgcaggggagatcctcatactgatcaatctcccaaattaaagaatcaaaagataaaaaaaaaaaaa

SEQ ID NO: 18297 - DNA, 388 bp, Homo sapiens
ccggtgataaacacgaacaacccttcctcttactccccctcctcagcctactcagtgagaagacgatgaggatgaagacctttatgatgatccacttccacttaataagccacctggttacatgtgaccaagcagagtagggaaagaagaaggaagcaaagaccaataatcatggatgaatggacaagtcagaaaatcccttgagttgtgtgtgatttgtaattataatattttctcctggggccttagtgacccgggccatattttttatttactaattatgttttcactacatgcttcccaaataaccaagttgtctctttctacagagaggggaatctggatctaactgtaaataaattaatatttacctggaaaaaaaaaaaaa

SEQ ID NO: 18298 - DNA, 323 bp, Homo sapiens
  misc_feature (1)...(323): n = A,T,C or G
tttccgcagggaatactaaagaatttngataacgtcaacaatccagttgagagagaggtcaaagaatccagggcaaggaggctcagagatgcagcaatgtcctcgggtgagcagagaggagggatccatgacacacctgaaggaaaaggaatctgatacgagcagggcctttggtgcacaggacacgctagcctcccagcagcacacatcaaggctggcagttttctagatccagcccatgtgtcagcaaacaatggtcctcaactctgacctgctgcctgtttttataaataaagttttattggaacacaaaaaaaaaaaaa

SEQ ID NO: 18299 - DNA, 375 bp, Homo sapiens
  misc_feature (1)...(375): n = A,T,C or G
ccaaaggcatcccaggcgtacagcactctgcttctgcacatgtaggncactgcantgtgaagattgaatgtcgtaacaacatgaaactcgagttcaaagtaagcgtgctcctagaaggtgccttcttatccaatccagctcacaaatgcagtattctgactggaggcaccactagacacgtcctcttctagctttgtgctgcagatccacctgtaagaatcacacatatacttaatggtagataggactttgcattgcacactttaaaatgggaagaccggctttgaagagggtgtctaacacacataattgactgagcatcacactcactaatggaaaatgaccccttgcccataaaaaaaaaaaaggtggcct

SEQ ID NO: 18300 - DNA, 304 bp, Homo sapiens
  misc_feature (1)...(304): n = A,T,C or G
cgactatcttgnatctgggtttcaggctttccacatctggcctaagctttttacaggnaatcaccatggatgatgcctgaccttgcattttgctcatgcagtttgtttgtaccattcaagttccagtggaagactctgaggaggacttaagtaaggcaaacccaccagatgaaggaagcctgaatcccagagtctcactgcttggaggaaaactgctctagagagctgcttgaccaagaacacctgcattgaacctcgtgtgagaaagaaataaagttctactactacattaaaaaaaaaaaaa

SEQ ID NO: 18301 - DNA, 354 bp, Homo sapiens
  misc_feature (1)...(354): n = A,T,C or G
ccaaggcttttccctttccttnnnttaattgctgtnccgtggnaattccctttagcatcaacctcctctcaaaactgctgtggagtggaagaagagttaatctagttagaatggtacctagaacgagtttcaagagctgggggactctattacaaatataataccttctcaggtcacctagaaaaaacactgtttgttttgttttgttttgttttgttttgtttttgtaacattgctgtaaggaattggggttattcaaaatttggtaaaatatgtcctagatggagagaaactgaattgaaagacagtgacatgagaccgactttaataaaaattactgcaaaaaaaaaaaaa

SEQ ID NO: 18302 - DNA, 393 bp, Homo sapiens
  misc_feature (1)...(393): n = A,T,C or G
cccctggtcccagncaggtctaccagnctccanatggtactgggggttgtccgcacanagtcctgtgatgtgaactgtctgtgggtctctcagctgtggataccagcacctgctcccgtggaggtggcacaggaatgaaatgaactctaagccctgggctcagccagagttcagcagagaatgggtgaccagcagcagagaggagcttcccactccagggatgacctgcctgcagagaggagccacccaccacatggcctcctgctctctgctgagggctgaacactcatcgtgacactgtggctgcaggaaggagatacctacagtgggtctctgagctggtctactgctcaataaagctcttcttggttttgctcatcaaaaaaaaaaaaa

SEQ ID NO: 18303 - DNA, 374 bp, Homo sapiens
  misc_feature (1)...(374): n = A,T,C or G
tttcggattgnagcaacactgttggnattcacaaacgcagttgtaagttgtgtgcaatcgtgaattcaccttcagtctctcctatgagctccacaagcacaggaaacgtccgaggaaacataatcacgatagatttgcatctacaagcacactcaaacttctgcgaaagtcatctgtctgaagcgcggatagttttgggactagccgctcatctgctctcgatgtgctgaaatctgcgcctccggaggctccgcagagcagcttcccaggtcgccacagcctatgagacactcccagcagctctgcaacgttccctctgcagaaagagccttctccacattaaaactgccaaaatgcaaagaaaaaaaaaaaaa

SEQ ID NO: 18304 - DNA, 284 bp, Homo sapiens
  misc_feature (1)...(284): n = A,T,C or G
ttcgcgaggnncattcttcgggtaananaanaagcctcaagtgagcctgcgtacaactccagtaaatacacagcacatgcagccccttcaagtgctggcaggccactgcacatggacaccccactccaagagaacaatcagggaagaaggaagtcaagactccagaagcatgacaacatataaagcccgaagtcaaaagttgttggtcaatcgcaatgcaagaaattaaagagaacattaaacttcaataaattttttttaatggaatgacaaaaaaaaaaaaa

SEQ ID NO: 18305 - DNA, 381 bp, Homo sapiens
  misc_feature (1)...(381): n = A,T,C or G
tctcggagtcatanaacaaaagtatgnaagnattctggnaaactcaggctgctgaaccaccttcatttggtttggctctgtgttcccacccaaatctcaccttgaattgtaatgatccccacgtgtcaagggcaggaccaggtggagataattgaatcatgggggcggttttccctatgctgttctcctgatagtgatcaagttctcacaagatctgatggttttataaggggcttcccccttcgcggggcactcattctctctcctgccaccctatgaagagatgccttctgccatgattgtcagtttcctgaggcctccccagccatgaagaactgtgtcaattaaacctcttttcggtgtaaattaaaaaaaaaaaaa

SEQ ID NO: 18306 - DNA, 1179 bp, Homo sapiens
  misc_feature (1)...(1179): n = A,T,C or G
gaaacgccaggggaataaaaaattaaagtaattcaacaaaagtttgcgggaataactgcgctgcttgaacacattacggaacaacagtacggtggactggacatacaggatccttactccagcgagaagttgctgccctcaaatcaccagggctgaagagctactgtggcagacccacatgatctaacaacacagcatactgcacaaacaggggaaatggtgcatgtttccggggagcaggtaaggaggacaacacccttgttgtgttagactcaacctgagcgatgacgaggagtgtagacgatacatgctgcatcctggcaagcaacgagagattgaggtgaactgccacttccaaaatccttagagcactagagcaacctggcatgcaacgggcctactgaggacatatgagttatagcattgatgtagggaagaatgaatagtttcagcattctatcaatgtaatataaagatgaatgcggaaatctgatgcctgcaacctgcacaaacaaaaaaaaaatagaatggacctactttcggcactaaaaacagatgagagactactgcggagcacgactttccactttaaggtggagggatcaaatcacatgcatgcctacagatcaacctggactgaaatgactactacgataacacacacgagtagatgaaaacgccgaaccacgcacataacctcaaaaggacggcgcgtgcccggctatttatcactataatgacgggggatcgacggcatggaaaaggaccatgtgttaggcctgtacgcccgtgctggaaggggtcattaacccccacgaaaaaaagcccagcaatagcatgcgagaagagtcccctcgngactccccgacaccgccggcagagagccgcacacatagtcacttccgttgttaacgcccagcgtagtcnttaacacactgtcgcaccgttaacctgctaccagtcgcgaacagctcgccggggaagttccacactaatacacctttacccatataacagacacttagcaatctcgaccggagaagcacgtgcgctctctcttagcacccctcacatataccagggcgcctgatttgctgaccactatgcccccgtagtagaggtacatctgacatggagcatgtatcgcagctacccgctacgcttctgcgattacaccag

SEQ ID NO: 18307 - DNA, 235 bp, Homo sapiens
  misc_feature (1)...(235): n = A,T,C or G
tttgcggggattgtacaccctggtaagcatgcagcccaatctttgccaccacaaaggaagataataaaacccatacgggnaaaaaacagagccacagatggagacagtcacattcctggtgacagtgtttgagcacctggatccagcccaacctgaggccattttctcctaggctttttagatctgtgaaccaataaatccccgctttaggagttgggccttaaaaaaaaaaaaa

SEQ ID NO: 18308 - DNA, 416 bp, Homo sapiens
cttcgtgttgccgtgtttccaaactttctttttcttcctcttatctcaaggctgaaagaagtttatcatattattagacaacagagcagaacaaaacaatacatcaagcctcagcacttggtattgctttgcagagaaaaccaggtaggacaaagaaagaaaaacagaatgcagaaagggaaaaataattggcgttttctgagaccaacaagttattctcaatttggctagcgtaaagaattcctgaaagagaggaggagcaacagtgagtggtctacctggaaacctcatcatagttataaaaagagaaggcaggtacattgggaataaaggaggagactgcagtggtgaagaattaggaatactatatgtaacattttgaataaaagatgtttttcttcacaaaaaaaaaaaaa

SEQ ID NO: 18309 - DNA, 296 bp, Homo sapiens
ttccggggagcatcctttgggtaaagcgaaaccttctccaaaccgcattcagtgatctttgccaatctctgactgagcctggtggcacatcacttctatctggccttgacctttgaggcagcaggatgactgcagggagtaggcagtgcttccatctgtgaatcacaaagcagatcaaccccaaagcagccacctgcacatgtggtacatcttctgcacctccatagacacttttacctaaggccagatgcatgtgcaataaacttaaatgcattgacttttcaaaaaaaaaaaaa

SEQ ID NO: 18310 - DNA, 371 bp, Homo sapiens
  misc_feature (1)...(371): n = A,T,C or G
ttttcgggagtggtncaccctcgnatncaatgnancacagnccaccaggggggctgacagctgtgtcatcatccaccaccacattcatatggctccacttggcagagaaggatacagagtgccactgcccatcgtttaatccagcacctggaggaaatacaatcagtcagagacgactctaaattatgagctctgtaaacactntgaaaacaatttgattcagatcactgaataagtcagagaagagtggtatttacatgttcatgtatcactgaaaaaaacattaaccacctatctttaatttaaaaatttcatttattatgaaaataacacatgaataaaaatattactctttctgaaaaaaaaaaaaa

SEQ ID NO: 18311 - DNA, 279 bp, Homo sapiens
  misc_feature (1)...(279): n = A,T,C or G
gaactcgttaccaannatcgttngggggngacancagaaacccggcatagcagagtgacagnanaaagaaggaaaagaagaagcagccggctgtcagagagaagcagtttgagctcagagggacagcttgatggtgggacctcggagaagagtttgtctgaactccaggggaataccaccttcccattccatccactttccagctccctatcccgctgttatttacttccatccctcaataaaatcctccacattcgctgcccttcaaaaaaaaaaaaa

SEQ ID NO: 18312 - DNA, 294 bp, Homo sapiens
  misc_feature (1)...(294): n = A,T,C or G
ggaccctgcctgntaanattggctatagccgcctggactaaggatctttccctaagnanaagagtgggngaggnaaaaatagggnaagatattgcatctattccaagcaaagtgtggcatgggacccaaagatcgaaatgtttggaattaacttatcctgacagtggttcctattcttttcaatttctggatctactcgtctcttttattatgtagcctatctcatattcttccattggatctaaatttccatgagaaataaaaatcaatttttacgtgctaaaaaaaaaaaaa

SEQ ID NO: 18313 - DNA, 341 bp, Homo sapiens
gccaggagggccgccaagcccgccggcccagtcttggaaaggggttcgagttacctcctgtttcaaagcgggacataccacatgaacatccaccgagaactctgctcatccatttttctcttggctgtccttgcactttggtctcactctatcagcaagactggagtgcagtggcacgatttcaattcactgcaacctctgcctcctgggttcaagtgattcttgtgcctcagcctcccaagatttaacatttgtttggatattttgtgtgtgaaacagtggaaatattatttaaatgtagactatgatcaagtaaatatgtatattggaagccttaaaaa

SEQ ID NO: 18314 - DNA, 467 bp, Homo sapiens
  misc_feature (1)...(467): n = A,T,C or G
cgaggcacttacccccaccagggaagcccatcagaacaatggcccaagcacattccgatggacaagtttgaggctcaacaaattcattgtcaacaactaggaagatggaataaaaatcagatgtccaagtctagattggcgagttgaaataaaaacaatcctattacacanctcacccaatgaaaaaaaattacccaagccatggtctacccagcatttttgttcattgtgcgaggtgtttggcaaagtgtaccaagatttttaaaaattcctatcaatttaccaactacttcctcttctagtaatttatcctaagtaaatcagtagagatttacttaggttcatgtacaaaatatcctatgcagaatattgtctattgacagtatcccaactatccgacaatatggataattgtaaaataaattataccaataagataaaatactattcatgcaaaaaaaaaaaaa

SEQ ID NO: 18315 - DNA, 513 bp, Homo sapiens
  misc_feature (1)...(513): n = A,T,C or G
ccgcaggaatctggctgtcacccagnctagnatgcagtggcaagatctcagctcactgcaacctccgcttcctgggttcaagcaattctcctgcctcagctttccaagtagctgtgattacagtagcctaccaccacgcctggctaatttttgtatttttagtagagatgggattttaccatgttggccaggctggtctcaaactcctgacctcaagtgatctgcctgcctcagcctcccaaagtgctgggattacaagtgtgagccactgctcccagccataactttctttacatctcttttattttcctggttccttttatattgttttaaacatgacctttaaataagctttgaattagacaaaaactattcatctttttaaaaatgacacactttttaaaaagaatgttttcttacaaatatatttttattggaaaatacccatataatgaaatatctattacttaatttaatataactttagattctaaattatgaaaaaaaaaaaaa

SEQ ID NO: 18316 - DNA, 325 bp, Homo sapiens
  misc_feature (1)...(325): n = A,T,C or G
ttccaaaattgtcatatttcccatatgctggnacataggcagnaaagtggaaacccaaanaacttgtgatatgacggacataagaagcttcagttggcctcaaatgtcaaatagaagtcacaagaagatctaagaaaaggcccaaatgtcagccatctgtggaccagacctgaaaatcttcctggaggagatgaaaacctctcatttcatagaactgaaaaagggccattgtatagaccagcagctgcggtgcagctcctccaggtctcaccactgaatcaggaatcctataaatatgcacctcaaccacataaaaaaaaaaaaa

SEQ ID NO: 18317 - DNA, 373 bp, Homo sapiens
  misc_feature (1)...(373): n = A,T,C or G
cagggccagtcttcagggnaaaataacagncccctctgtnagcctgnaggtccctcactgaacacagcattaggatgagtgaggtgtggaagtcagcctgggcaggagacttccacagagctgttctcagaccactgaatctacagtttcacagcaaatgagattggaaatttcaccttctatgcttgatctttaggtttaagacttttgtccttgtgaaaatgcaaatatcggctgggtgtagtggctcacacctgtaatcccagcactttgggaggccgaggcgggcagatcacctgagatcaggagttcaagactggcctggccgacatggcgaaaacttgtctctactaaaaatacaaaaaaaaaaaaa

SEQ ID NO: 18318 - DNA, 279 bp, Homo sapiens
  misc_feature (1)...(279): n = A,T,C or G
cagctactaancaatatccttcttcaaacgtggtcttctgtccttcccagcagatggtacagtggttggaaatctttacaggattcctgtagaaccaaagtcatagtgactttgatgcgtcattatgccaaggcccagaagctatggaacatattaccttaccatgaaaggcctgctttgcaatgctttggcacttgcaaaaatagtcttcacattgagagtcccagagtgtgccttacacagtaataaattacattaccaacagcaaaaaaaaaaaaa

SEQ ID NO: 18319 - DNA, 256 bp, Homo sapiens
caccaatgggctacttgacaggggctcccatgtgctcagcttgcaattggattcagccaccagagatccctggcaagagaataaagaacttaagttacaagacacatggattaccaaagactgatgcactcctgccttatatttttaaagccacctacaatgagttgaaagaagacctctaagccaatggttctcaaattttagtttgcatcacaataaagacttggtaaaacataggttgccaaaaaaaaaaaaa

SEQ ID NO: 18320 - DNA, 244 bp, Homo sapiens
  misc_feature (1)...(244): n = A,T,C or G
gtactttgattcgcaaagcctcactcctgtaatctcgacactttggngagccaagnagaagacaagtaaaatgttgaacaagaagaagaagtgtcttcttgcagttcctgtaagaaggcagaagtatttgcagaggggagaatgtggaagaaatagagaataattatctcttaccaaatgtaatggcttttgttgtgttttttctcttctaataaaatagtgttacctgctaaaaaaaaaaaaa

SEQ ID NO: 18321 - DNA, 351 bp, Homo sapiens
  misc_feature (1)...(351): n = A,T,C or G
ccagttatagccccttncttgnacgnanngtccacttccaaagtctccattctgctgttcaccatggacaccatacttccaattctgctgggcttctttcaatgaaacctacatttacagctctcgtttattagtctgttctcgcggtgctgtgaagaaatacccaagactgcgtaacttgtaaagaaaagagttttaattggctcatagttccccatgtctggggaggcctcaggaaacttacaattatggcagaaagcacctcttcacagggtggcaggagaaagaatgagaaccaagtgaagggggaaacccctaataaaaccatcaaatctcgtaaaaaaaaaaaaa

SEQ ID NO: 18322 - DNA, 258 bp, Homo sapiens
  misc_feature (1)...(258): n = A,T,C or G
tttcggattgaaaaaccctcttacagctcanaagctacccaaaagctatgcttctnaggcaaaaggattaaaagggagtgtgctcaacgctggcagtgaaggatgtcattgtctgacaaactacccagcaatttgagattcagcagtttcctttccatttaagaaagctgcattgtaaacaagaagctaaatcatgaagagatgcaagatttgtctaggaaattaaacgtatgttagagacactgaaaaaaaaaaaaa

SEQ ID NO: 18323 - DNA, 252 bp, Homo sapiens
  misc_feature (1)...(252): n = A,T,C or G
cactgttggaaagnanaanagcacactctctctctacagccaatagttccctgatcttctttccccaaggctgtcactgtcagtagaatctagaggactgagccatgagttgtccacaaacctaataacatccttgttgtcttcagcacaacaagtttacttactatgcaatgtcaacaaagttttatgataaaatatttggactgaaataaacacagtctcgcctgactttttcaaacaaaaaaaaaaaaa

SEQ ID NO: 18324 - DNA, 364 bp, Homo sapiens
  misc_feature (1)...(364): n = A,T,C or G
ttcggcttctgtcttcctgcttgtggtggnnaaccgaagatctcatgtaaccctgttccctagacaggtctgatatcttcttggccctgacactgagaactggtttagaatctggtttgtactgtccaaccttccagtttgggaagataagtcacaggacatcgtcttctaagcagcaagagtagcccctgggataaaattgctgacatctccgtggggcctcagggtcctgggactcatgcgagtgcaggaggctccatgtctttggaggctgcatcagacacattctggcctcaactgaatgaaacctctgagtttgattttacataactgctcttaatacttacttcgaaaaaaaaaaaaa

SEQ ID NO: 18325 - DNA, 420 bp, Homo sapiens
  misc_feature (1)...(420): n = A,T,C or G
cgccccccccagggcccccctcntcgcccaatgggccgacagaacgaggagtacctcctgtcttctggctgcaatgcagtggcatgatcttggaaccactgcaacctctgtctcctaggttcaaagtgattcaagcgattctcctgcctcagcctgcagaatagccaggactacagaaatctccccactcaggacagaagtagatgatgctgaacttcctgtgcttttttctctatgcattgctatggccagcaagattatggatttcctaggcaggacctttaacattgtgagcagggttgtattctcttttcacttacctgggtgaggataacataagatggtaaactgaagttaccattaaagtgagtggatgaatgacagcccaaaacaagaagaaaatgggctcgtgtgacctca

SEQ ID NO: 18326 - DNA, 401 bp, Homo sapiens
  misc_feature (1)...(401): n = A,T,C or G
agcccccccgccgggggaanngtctcgccaacaccaccggccacgccgtttcgagggtattaccccttgcttcactataaaagcaaacttcttgggccagacggtggctcacgcctgtagtcccagcactttgggaagccgaggcggcaggatcacgaggtcaggcagatcgagaccagactggccaacatggagcaaaccccgtctctaacaaaacatacaccaatcacctgcccatggcggcgcatgcctgcagacccagctacttgcgaagctgaggaaggacaattgcttgaacctgggagggggcaggctgcacctagacccgcatcgtgccactgcactccacccccgccgacacactacgacgccgtctgacaaccccaacacttgttaataac

SEQ ID NO: 18327 - DNA, 1205 bp, Homo sapiens
  misc_feature (1)...(1205): n = A,T,C or G
tgcttgctcgccaatgcagagcaagtccgaggcaaagcagcaatttcctgcgcaggcttttgctgctgagaattgcagaagctggcaccttctgacttgtacagaagaaaggtgatacctggctccttggcaagcagnaaaagctgcaccaacatnctngcagaatgcaagaatactgagtacacgctgagcagcacagtagcggcaaggagaaacctaccaattcaggatagatgggacagcgtagcactgctacagacacacttggaggacngaatgacaggtgtgtggggaaatggttgcgcatgcagctagacatgagtgtgagcgcgtgcccagcttacgacagacttcaagagaggttgacagtgtacaagatgtgattatgcgcaacctcttaatgaanctagtcatggctagagagcttgtctatntcttacgttgagctgcgttcgcctgtcttaacaagatgcanagatgttctcagcttnctggcgtgcgtcaagcaatcatgcatctatagctggtgacgagcacctgtgagaccgactgacgataatgggcggtgcactgacacgcgagctacgaacttacacagcatctagtgtgatgacacgcgcgatgcacgttgtacctacttagaagaagacatatatataaagaggggtgattatatggcgtagtagtgtgcggtatacgaggttagtcttattgtgtgtgcttgccggggtatagtggcgtcgtcccgagaggttcgacggtcggtgccctcccccgcccccagccgcccacaatcaaatggcacacatgctagcacttaccagcgccccaccctagtccagtgtgcgttaacttaggcgacatggcgggtcccgtacgcactgcacccctagcccccactacgggtgagagaatccgatcgcctacacaccagccaacagggccacctcaagcggatagaaagacagcacgacgaagcacctagagcgcgagcatgacgcaccggtgcacgacagtgctacacgggaccaganatctcataccagtcagaccctactagcacgaccacaaacatttgatgcgacactctctatttcgcactctacgtatcccccactccagcaaaccagcgcacgccgcattcttccgactnagcccaccttgcccagctngccacagaacgcatgccgnagctgtcgaactgc

SEQ ID NO: 18328 - DNA, 281 bp, Homo sapiens
aagctctcttgatgaagattaggaagagatttctcgagctttctctaaattcaaagtgccctctactgtcaaaaagtgtactgctctggaagagaaagtgacaaatctgaaatcaaaatctagacagtgagagacagacggaagaaaactacaataggtaatggcgctgcctctcagccctggggcgatgcagtttggaatgttccatcagtaaatagttacgctccccttcaaacttaaaagttacattaaaattatttggaacttcaaaaaaaaaaaaa

SEQ ID NO: 18329 - DNA, 1300 bp, Homo sapiens
  misc_feature (1)...(1300): n = A,T,C or G
gcatcaccctagcaagctagctcaagccaatacggcgtggagaggcatcaggatgccacatgcagatgggtgtgggaggacagagccggggagagagaagatggcgtgatgtcagatgagtgcngnaaagcgagcgctgctgtgtgcagagagtgagatgcaggtgagcgtagcgaggaatagcgccacagacgtgtaggagacnctccactataggagaagatgtgtgaaagcagatggggaagcaagtgcagagagggtggtagcagaggtgcagactcattgacaaagacacaaagaacgaaacgagatgacatagcatagaacacacaaaggtgacaccgatgagaatacaaccgtgttcacctgtggcgaaggagaggggcggggaggcgcgcacgatgggctggtggtcgacgtggagtagaagagggcacacgctaacagactggaggaggtggaactggagagacagctgagacgtgttaggaggagagaaggtgcagacagcgacgtgaaggtgtgtgggatggagctgagaaacaacacatgaaccgacaagacagcataccaacacacacatgacactactgaacacaaggagataggtgaagaagaagggccgtgcgtagagaagcggcgggcggcgcggggcggggcgggggagcgggagggtgttgaggtgcgggtgagatgagtgctgcgcagtagcgagggacagcaaggaggacngcaccagtctactctgcgcgcgccacgacacgaggtcaaacagnggcggcctaccagatcgaacctacagaacgacaagcagaaatcatgagtaaacgactacagggcttagacgagaggagggggcggcagagtgggaggcagggggtgaagctagactggaagtcggcctaacgacgcaccacccaaacttcaacacacacaacaataaacatcccacgccgtccaccccgacgctagcgccggaggacgacacacccccagccgcgccgacactgaatgcatcggcgtgaggtgcccgtccacgccctaggccacgcacacgtggtcgggccccgcctgtccatcctaaaaaccaggacacgaccagagatcgagccgtagacacacaataccacactcgcaatatcgagcacaactcactagaacatggcacggcacgcgaccacactaggtgcggaaatcgacccaaagtacaaagacccgacagcgaaacgtagagcgtgtgactcgatggggtcgacgctcgatgcccgcgctacgtatagagctacaatcccagatactt

SEQ ID NO: 18330 - DNA, 1325 bp, Homo sapiens
  misc_feature (1)...(1325): n = A,T,C or G
ccgcgcccctcccccgggggcaancgatcaacggcaataacactacgccccccgcgagcgccccctccgaggcaatactcagtcccattatgatgctgagactgagatgccagttaagccaacggctttggtacccccgagcataattgtattcagactctgttaacgaacaattagaccaagcgactcctgatacgcctggatgcgaagacatctgccaaagaattcagccacgctccatgagtcgcatcgtttttgcacttgtcaggatcgccacgtctcatatccatggtaggttctcgcacgcgacagcgtagtgtatgcaccttcttgcagatagacacgagcacattcgcgctaggctgtggccagattgtgccacgtagtagnacatcgatagacgcagcgttgccagccttctctactgcgctgatggacgaagccagtgactgacagatgtaccggaccagagacatcatgatctatcgcgtgcgtacccgagatgtcgtgtctccgccccactccaccccacccatcaccccagccgctcgcccatctccacacgccgccacctccatatatgtggtttactgtgaaagctggcgaagactccgcacggagcggtgccttgcgctctaatctctcccctcgcacacggagagagcactcatcagagccccgcttgacacctcctcgccacaccatcctcgcccttcggttccacgcccgcccccccccgtcgcacaccaacgctggcagcaccctatagatgttacatgactgaaattataccagcgcccccgcgcaccccatacacacatcaccccccatccccaactctagacgctcccaaccccgcgttacggccccttggtactcccaccgactccatcctccccgtcccagtagccccgggatcgcaggggacgcacgagccagccgcgccccctagcgcgcgtacgacgacgcaccgacagagcagcccaactaagcataaacacccctctccccccacctcacgcacacgggtagccacccaggtgacacccaacaatcacagaaattccttattatgacatgacccgcgccgctcccttccctctcataccgagtagcccccgtacccgcgcatagacccgcacaggccagtcctctgctacggcgcccgtaggcatgcagcacaccgcccccacgtaccggcatcgcccacccgcacacttcacccacaccctccncgtgcacgcatgccgatctatactgtgtctacgcatatcgtgagcagcagcgtgcctcatattattccgcctcctgcatgggtgagtgtg

SEQ ID NO: 18331 - DNA, 973 bp, Homo sapiens
agcaacctcagtggggtccctggcgtcgctggttttggtcaggggctttttcccgcttctacttcctgcgacaagaccacctgccatgctattaggcacgcacccacctggcccaaaaactagagacctgccaacaactgcgagaaactgaggcctctaacttatagccctgcgagcgagacaatttacaagtgaatcttcaagacccaggcagagccttgagatgactgcacccctagctgacatatgctgcactctgaagagagcatctgacccacaggcacctacgtgagacactcccagattcctaacccgcataagcctgcgggagacaatacatcctgcacgcccccccccaacacaaaagcaccgggctccctgacctcaccggaggagactctggggccgattccctttcaggcgcgctaacccatgatcctcaagtcactgactcgctacgctcgcgcgcaccgctgcccaccgcgcctactccccctcccggcccgccgccccacaccagccaacaccaccgcacgccccacgacccacctgaccccccaccgaccctcatagcgccctaaccccgccctggcccacctcctgcggccgcctccctacgccggccccccgatgccgacacatccgactcgacctcgcccccacccccaccgccactccacccccccccgcccacactcccaccacgccccgacccacccactacaagcgacgcccgtggcgtgatatgacgcccgcaataaagcatgccgccccctcctctacacccgctttcgccttccgcaagcattgcccgcctttccgtgatccccccgcgcatcgtcatagcgatgacccccgacgcgcgcactccccggcagacacccgcctcgactccgccacgccgcttgcccgacacgccactgccccagcccgattctcagcacctgcatcccaccaccgcaactatcgcccg

SEQ ID NO: 18332 - DNA, 1742 bp, Homo sapiens
  misc_feature (1)...(1742): n = A,T,C or G
gtgtgtatgtatttatagaaggggtagtagaaaacgaggcgcgatgcgagacggatggcgtgtgatcgcgttggattatcattcatcctactcggaggcgcctcagacgctggcgggcgcgcggacntccaccnaccacacacctttctttccctgtcctcatcagatgtctttatctctccatcgtgcgcttattcgactacaccaccacacacgacatcgtcggtaatgacccgtagcaactacgancttagtggtagagaggataataagtagcgacgagcgtntgtgcacacgctaagtntctcaattcgatcgagtcaatcatagcatcgtcgtcgtggtctcgcccgaggtgtgtacgcggagcgtgtgatgccacgccgctctgcggtcgtgcggctggacacgatggagctgtccggcgcgcgagcgcgacaaagcgactggccagacagtaggaagacgaggagtcagacctagggtacttatgcctggctctcgcggngcggcggcgacttgctacttaggacgatgtcggacgcggcttgccgcaccatcgattgacatcgaggaatgaggagttaagtggtatgagagagaagattagtgaggagtgaaggcagtgtgtatattggtgttggtgcggtacttgttattgttgatgttgaggtcgtagggaccgagggccagacgcgcacgaagcgtctagagttattgagagccggacggcatagagaccgaggcggatgcgcggtgggccatgttccgcgcccccgtggccgcccatcggccgccgctacggagcgtcttataggccataaacggtaacgcgcgataactacagtatgacagacccttctatacagtatcaatttgtgctgagcggatcgctatgagcacggcgacgttacagccaatgagatgcacgcaggtgatgggcgagtcgactccgcgcatgtgcatatggccacgacggtatgatgtgagttgtagcgcaggcgtaatctattgagataagctgtattgatacaagagttctactgtcagcagaagtcatggttccgaccgacgagacagcgaacaagctactacgagacgcaccagaagcacgtgcgacgcgtcgttcaccgtcgcacgacaccagcgcctaccgaccactgcgngtgacncgcagtaccgtntcacgctacgatcngatcgacatgctgncaggacgtacgggcgcgtaantgtagtgaagattgtgatggagaacgtagtnttctatgttttatatgttattgtggcatgtgaatactatgatgtgtaagtntatgtggtgaggaacgtgcgtacccgccaattgtgacgtatgtgntgaggaatcangcaggntggttcgactgatgtatgtaganatggtgtagtgatctagatgtagcactcgactcagttctcacacgtcagccactgtgngacgtaggagacgagcgantagacagagccgtgcaggtaatgagacgggngccatcgaggccgagagagatagacgcgcgagantgtgtgntatatacgcttacagattcnagcgaantcgcaatgttcgcgcttaagcgatatgctgcgcactcgcgctgagcatgtagggatacgagatgtatnacatgtgaggcgcacgagagatgcagtcgcttgcgtgtacgctactagacatgcatgtatatgtggcngngtggagagctgantggtgantactatgg

SEQ ID NO: 18333 - DNA, 573 bp, Homo sapiens
  misc_feature (1)...(573): n = A,T,C or G
cggcgcaacgaacgggaccgctcagactcagaaaaaaaaattgcnctttcgaggaataagggaaaaacttcctgggcaatagtttcttatcggcatgtcatgggaagaaaaagagactgtatgaatacattgctttggatgggaccaatatagggccaggaaagccttcgctgtgaaacatgcataaaaatgagcatttggataccaatgaagtgactttgtgaatgcttgccttcctaaatactaactgtcaggatcctggctctacctgcttaaaaacgcatgagtatatttttctcagtggcagatttgaataataatggttatatgcctatatcttaacattattgtgagaatcaaacagaataatggttaggaaataactttgagaatcattaatttatttatcaaacatatgttctgggcaaggtatatgtatattatagtgactattatacacaatttacgcatacttcataaccataatgctttttagcaactgacctactttatttcttgcaccatatacactttcaatttaagtgatatatttttctaacaaataaataaaat

SEQ ID NO: 18334 - DNA, 1464 bp, Homo sapiens
  misc_feature (1)...(1464): n = A,T,C or G
gaggggggtgagagacaagaggatatattaagaagagggaggaagggaaagtgaaggagcagaggtgagtttcgcggtgtgacnccccacgtaaactccacgacactatgcgtgacggagagatcacggccccacttctcgtttatatgctcgtaatcttagcacgcgngttctatcattgtatcgtaaacgagaccctccaatcantagtctcncgcgcgatgcagtacagtgacacattgcagntcggcgcgatgtcaccagacacataacancgcacggcgtaacagcagagaaacataaacaccgcatcgctatcatcgactcgtacactttctacgtggatgangcgngagaggagacggagatagtcgcgcattcgaggaacgcggacggctcgctctctaatctaccattataccaaacacagacgatgattataatagagatctattacacgcacggtcgctgcgggcattggcgctccggtctatagtttcgctagatggttagtctcgcctgcccgctataatctatgtcgatacttacgacctatacatgtcactacttttctattantacacgcggggatcgtgggcaaggggggcacaaggcccgatcgcaggaggtacgggaggggacagttgatgcgtcgacggctgcncgcaatttcgccgatttttatctattagagttgcggntgttggcatcgacgcgtgatactagtatgacgtattgttgagctgagccacgtactcccggncgcgtccacgatcacgaccgaatgcggcgctgtggagcggaggaagacgcgtcagtcacgctagagacgacgggggttaatagaccgatatcagtatgggtgtggacgcgtagcgcccatggcggattctttgctgcgatcgtcattcgccggtgtgatcggcttaatcaacagaataatacagtactagatataacgatgcgaagaagtattcgtcttgttacgcccgtatcatcacaaagatcaccgtccgcaacaagtaatccgctggctccccctacactcgcaccaattgcgggacgacatctaaccttgtactgctgttacatgaatgggtgtacgcgagatggaggcggttgatccgtcgacggtgcgcgtacggtccagttccactctgttaatatgttttacgtcttttctaaaagggcgggggataggatagttgttctcggcctcgctgcgcactttcaccgaagaacatctttcaacctttttgcatatcttattttataccctatccaattaatacggtttatcttcatccaataacgtaggtccatatgtatccagaggtgggcggggtgggtcgagactccatcgcgctatcgaatcatcgtccctctacacaatttgtgcactttcggcatagcaataatttccaacataacctcactaatgaccggagagcaccttgcaggcgg

SEQ ID NO: 18335 - DNA, 308 bp, Homo sapiens
  misc_feature (1)...(308): n = A,T,C or G
gccccggcatgaangccctgcactcggccgggttttccggnnaatttactgtnattactttnctncttggnaatcctctctctgtgnatgcaacctgcatttganagtaaataaactgcggngcatatgccggnatctcgtcagacgcccagttctcccgccagccgaggatgggagtgatgatgaatggtgccaggcccgctgcataatcttttctgttttaatactcgattatcatgtccctcatcttccctggacccaagactcaacacattaaaatctctttgtttcttccaaaaaaaaaaaaa

SEQ ID NO: 18336 - DNA, 1427 bp, Homo sapiens
  misc_feature (1)...(1427): n = A,T,C or G
agttatgtttattcttgagagttgttttataatatagtcataacagtatccgacaaaaaagataatattttattatatgcctctataatcactcctctttgtttgttgtgtttagtttgactaacaaggtcggcgtattttcctagtccgtgtcatgtgttggtctatagagtcatcatgtatcatatatcatagtcacgtatagcttcatccttaaatataataatcccaggatatatacatctgggcaaccaaagaataccagtcggatcgcgctcacgtattctgatatcagtatatatagatttattatacagttagttatctaattcacctattctaccgaattccttgtcgtatattcgattcgtttgtatctatgtgtttatagtacattatctctctcccttctttcctctctcctcttatttatctttgctcgtatcctcctccacccacccgcatactagcgcacgcgcgacgacagacgcaggcgagtacggcttnatctatactatcatgattctctgctgtgcatctcgtcgtttttcgccngacnttctgatgtagtgttatggtgtcaatacgacatgacacgagatccgaaaacnagatatgaatagagacaagcacacgagatggcgcagcgcgcgacgcgcgaaaaggagggacgaccggccggagggccaagagcggaaaccagtgcgctcgaggtgagccgcagatactccatccgccgcgcgggtgacgttcgcgatcgttctcaatgccgcatagttggaacgcgttccgcgctaccagaagagcatacaaatacgaacacccgcataagagcgacgggtatacatacgacgatgtatcgtcctctcctaagacaagcttgtaacactagaatgcggtagcatacacccacccaatacactcaccacaacgcaaaaataagacataagtgacagaaccgcgcgttacctgcaacacataatcacccaccagttactctaccgtacgtattgcgacttgcatccacttccgcctgactgacgcagttcgtatgttgtcagccgcgtgtgttgatgttgctgttcgcggccgatagttgtacagctctgtatccttacantcacctcttataagcacgacgtgcagtgcgattactttatctcatacatgttgagatgagtgggacntcgtgtcgactgagcgctcgcacagatcattcaagatctacacatgcgtcgcagtaatacataattacacgtattttactgaagacttctacatacgtggcttatcagcgctgcgtcgncttcatcgattatgattactctccgctacggttgtgatacagcgcantcgtcacatgcttccgagtgtgtcttcntgtcgtgtgcactccgtcgccgccatccacntntcgttcgtgtaat

SEQ ID NO: 18337 - DNA, 422 bp, Homo sapiens
  misc_feature (1)...(422): n = A,T,C or G
ggcgagcccgcaccgggccagccagctacgtcttttgaacgngattctgttttacaatctctnttgctgantaagnacacagccnacatatggcgactctacacttgttagnatgaaaatttccattttgaagaacaagttacctgcacctggcaggtgcagtgacctggcagctgcctcagaagtggcagctcttgctgccagctctgctctgatctatgcttctgcaagccatactgcctagtggatatgccagtgtggctgggttctcagctggtgtgtgttttcttcctctgtggattctgcccaccatcaagtatcatgtctcgcatatcatagacacagagaaataatagtcgctgaattgtaccatgctaaatctgatattaaaaatcattctttattcgtgaaaaaaaaaaaaa

SEQ ID NO: 18338 - DNA, 1553 bp, Homo sapiens
  misc_feature (1)...(1553): n = A,T,C or G
gaataaaacaaacttgtgcacccccaacaacaacacacccccaacccantccaagcgtccaaccccgaggctgtacaaaactgatctatgcgtgctgaactaatggacatgcacggcgcacattgatggaggcactgtgacactatggagagatgaacaatttgcatctgtgaagcaacagagattacacttgaaacacatgaacaggatagcagaagaacacatgacacagatatgacactaccaataaaaangagaaaacanatagtatagactagacacagaaatactngactacctagaacagtaatagagcataagtagacaancgacacatgagctcganactcagccagcacatcagtccgcccacgctgcctcaccctcgtaacaatactcacaaacatcggctagcagaggataacatacattaaactactagacgcgcatacactcgcccccacaccatgcacgagtcatcgaacggccgcgcgcgcgggtgcgagagtgaggcacaccaagcaactacaatcacgtccaccgaccactccgcacacacgcacgccantgcactcacagatcccagcgacgagcgtacgaggtacagttgatcttgtacacaaccgcacacactccgcgcacctccaaccgcaacactaaagaagacaccccccaaacccacgacactcacccacccacgccgagcacgtcacgacgtgcagcacggcgcgccccgaaagacacaagaaatccataccgtgtccacgtcgcgcgccgcgcatcacaaagccaccacgacactcaacagtagacaatgacccacacgtctccaccaccactaactcaccctccacaccaacccacgcccacacgacacacgacatcagcgcagcagtacaactcaatacagccacgagcaacggaatcataccacacgcgaccacagcantcagcaagacgcatcacacgcactacancactctactgaaccccacacaccaaccaagcaacaacagacgaccgccacgcccctccactataagaagacacctcaccacgccgcacccacgccnacgacagcaagagtggaagagagtngtatnacaactcacacctcacacacactatttatatcaataagcattcgaaccgcacaggctatgaaccaatcaccaatcacactcattataacaacacatagacatctcgctcaacgacgacagctcgtgnctacgtgtccgtagagtcagcatcacgtcatctctgcaacngntngacacngcatagggaanacgttagtcgccatcatnataccgcntcatacgtccgcgtgatgagaagagtcgcggcatcacatcgctacagagcnacgacacactangcacgacccnactccgcncagtccnactatacactcagtctccacacacacagacgtgcgangnagagggcacgatcaaacgagcgacgtgcgaacagctcgcacaccgacatggacacacgaacagctatcaacatatcgcccagatacacagacacnctcagcgcacacg

SEQ ID NO: 18339 - DNA, 501 bp, Homo sapiens
  misc_feature (1)...(501): n = A,T,C or G
taagacattccacacggggcatcaccccctgggcatcccaccccacaccgtcccccccttcaccccccccacgccgcgactagtataacgccgcgccctgcacactcgttccgcttgcacgagaatcctcggtctacttccagtccctcgcctcgactcattctctcggaccaactgcggccacgtttgcttaggagctcattctcttgcatcgggcatccacatctcgcatcccatcgtgtgccaccagaggccaaccacacatcgaacctatgtgccaacgccacccacaatgcanagcatctccaccacctcgaccccgatgcatgcagcccctgctgtcctattactgcgttgcacagcccttctcgccttcaccgcgcttccatcgatgcctgcactccgacatcctgcccatgccgtcttttcaaagccgtcaacgctcacccattccgcattccgctcacgctacggtttccatcccacgccatccccacccct

SEQ ID NO: 18340 - DNA, 2113 bp, Homo sapiens
  misc_feature (1)...(2113): n = A,T,C or G
ttttaaaattttttttgtgtgtaggtggtgttnnttgttnnttcgcgtggttggtgttattntgggtgntgtgacganatcaccnnatcattgtcttgtgatgtgatacttaccttcgtccatatctccgttagtacgcgtcgctgagtctgtccacgcgctcagatattggcggcgcgtgatgcagatcatgttatacttaanttctatatttgatacnagtctctgttatagtgcgcatcacacggcactacacgtgtgcnacgagganaggtgttagtacaacagggcgcgacgtagacaacancgcgaccatgagtcggtgatgatagctgatctgctcagtggtggtggagaggacgtgtgagaggcggtggcgctggtggtagtggggctatggtgggttgatggggacgaagcaacacaacataacnacccgaccgaagtctctaggatgattacacagattgccgattatacgncgcgcgatcgctcgcgcgctgtccagctgctttatctatcgagtattccttgtctgttttagcgcccataccacgttccccatttctacgactgactgctatatctcgcgcgtcgttgatattatcactcgccagcgtgcctagagagccactaccgcctccatagcgtgagatctgcaggcgtgcgaccactcgtcggctgccgctgattttccgttgcacgcgcacgtagtagagaggagaggtgtcgtagaatctatattacaatganttcngaattnatcatantcaatctactactaaccaacaatcactcantatccgacgctcgcgttagcagccatatttacgtaaggaagnatcgagatcggcgcgagattgtgtgtaggantggttatcgctcagcgaattcttggaggccgacggcaggcggtcctcgtgtgtgcgctctcatgcacacagcgacgctctgttgtctcgccgttatagtcttgtctctgcgcgtgagttagatatggtcgntcatgcacaatatgaggtnttatatgcactatgtaggcgttagccgatatacgcgtatatcgaatgtgatacacgagtattagtatgagagagcgcgcgaggtctatcacgtcgtcgcaataccggttgcgctataatngntcaagctcatcgcacgcaaggattatctgtgctacacgcacgatcgagcgacagatagtggtggacacagtggtgtgagcgtccgtcgcgccgtatgtatacgacagtcgtagtgcgattgtgtaacatactgcatgcgcgatcttcanatctcgatcgcacacgtcgtcagggtccgtgcgcgccgccagcgcntgtgaatgagaccctcgcgacaggtgtgcgcacagtcgcttcgatagcgagagtatagctttctgacnagcacatgagagatcaaacaagtccgtgatgnagactcatagcgtccgccgatagtagtagcgggacggtcagagactaccganagaggtngcgtgagagagagagacggcgcaggcgaggtgngacgcgtatggacacggagaagggcagtattcngtcagagaccagtgacacacnacagagaggtagattgananatatagcattatgagtagangacanatatntaccgntgatatgtagctnatgacgcagtgaggacgggtcgatngtatgaacggtgntgtnatgcgcagagnganagtgacatagtagatatgcggatgtcgcgtcttcanagcgatatnatggatcaatctgaggtgagcagagcangntatanacggttgtagtatatccatacaganactatgtgtatgagtaggaatgcatngaagatgcgttgaatttnatacatatcgcagtgagagtgtcgagtgntantcgacgntaggaagtagtagatggtcgcngtgtgtcnaggcgcanagagataacgtacgtactgngacgacncgngcatanctagtcgcagncataatgtgattgtatggagacgngacgcngcngcagtcaatggtcgttgatntntagatcgagacgcacgaaggttactagtcgtcggcgtantccgacngatcatctgtganacagctctggcagct

SEQ ID NO: 18341 - DNA, 1685 bp, Homo sapiens
  misc_feature (1)...(1685): n = A,T,C or G
tgtggtggggggggggtttntgnnnnnttatannnttntatgatagacggtacggtgcgngcgaaaatacgcnacccgacgaggagaggggcgtaccaatgaatacacacgaggagaagagcaagatagnggaggaggangaagnatataatataagagttaaataaattataatatatatatatnantgagagaagtaaggtggagtagatgagatatagaggagagaggagataagatatagaaatgagtggtgtagaaggctgatgaatataagtagagtgatatagtgataggtagtagaatgaagactngtgagtgtggatggtagttntggtgaagaacacagtacgaagagagtgatatttctcgttgtatatcgctactgtgtgtctcataattcatgtattgcaagtgtgantatgctacggatatgatatatgtattgccacaataagagatgacgtattgttgttcacacaattgctaatattatcatatgatctatactcgatatctatactgccgtatctctcttgagtcgtgacggtcgttgtgaaattatatcatatntangtagtgttgtagtataaggtggatgtacggtgttggatcagtatgatgagcgttagtgcgcgcgntggtggaggtggtcggggatgttaggtgagaggagaggagagcttgcctcgaggaggcgcacgtgtatgtcctaacgtattatcgcacgcaacgtcacgcacgacgtgatgaactaactagttnancagagtatgatataaacctcgaccacagacacagactctcccacattacacgatccgtcnatcgcacgatgtcacgaccgcgacaatcggcgcccaccgcgactgaaccactacgtgtagcaaggagcccatctgcgttggctatctatgcaccgacaacagagaatanaagatgtaggcagagatggacggtcggcgagacggttgacaattctagtcacataggctccgccgcaacggtccgtggtggttatgcgcggcgcgaaccgagaaggtcgtgtaagaatgggtacgtgtggaggcccgtacgaacgctagccatggacgttgcatctgtatgcgtccggagcgcagtgcgtcggtctgtggacggaatcaacgtgtagcgcctgcgcgcgctgtctacacagtcgaatcgacatgatcatggctctgcacgagaaggatcattcgtacggtgatatagtgtgcgccctcagtccgcgttcgttactgtggtgtagcttgggacgatcgtagtgctgaatagcggcgaagactgagcgcgcggtagcaggtgggtcggttatgttagtcgcgagatcgacactgcgttcgcgaaggacgcgacagagagcaggggcgatacgtgctcactgagatatgcacctgagtcggttaggagggttgtggggatgatgaagagccgtgcgatatggaacaggaagaccgaggggacgagggtggtgcgagagcgacggtcaacgcgcgagagtggtgcgctacgcgaaggtatggagcgaggagtaacacagaggattnacgcaggtgcgataacgtcaatgcacgacagagtggaggacagagaagcagagcggangtgctnagccgcgatggtagtgactgaagatggtttatagtattggtagacgctgcgcg

SEQ ID NO: 18342 - DNA, 521 bp, Homo sapiens
  misc_feature (1)...(521): n = A,T,C or G
ccaatacagtgtactgttacccggncatacctattccttcacagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaatcaaaaaaaaaaaaa

SEQ ID NO: 18343 - DNA, 875 bp, Homo sapiens
gctatgcactatttatttgcaattgccgcataatgaacaagtaggacttgatgcttgacagctcccacctggcacaaaatgcgaattgccctaccgccaaaagcaaaggctaattatatacacagatacagctacccccacctattatttaaatgaaccctatttttttaaatgaaccgaggtttttgatgacgctactacctcgcccctaactactgcccctgggaaccctgaatctcttctgacattgccagggcttggcttatcatccttatcgccgtcactgacggccccccgcaccgaccatccgtatagctctatggcgccgcggccatcccggcgtcctctaagagcgagccgtgccgccttccctccggcttggtatgtcgccgcctccgcagcgtcgccgtcgttgactgaggggccccatcgcgcccccaccggcggagccgctctcccaccccgccccaccccccccccggggcagcatccggccccgctcagatgtcggccccacgcgcccttgcgcgcagccgcccgctgcccccccgtcctggcccagcgccgcgccccccgcgcccgttcgcgccacgccacccccccacccccaccgccgccccggcgccggcccggccgcggcccgagcgcggagccgcggcgcggaccggcaggcaccccgcccgcgcgcgccgcgccgccgcagcctcggcgcagaggcggccgacccggccccgcggccgacgcgccccgccgcccaccgcggcaagccacgacccgccgccccccccaccacacaccgcccgtccgcacccgcgaccgccgccgcggcagcgggcgcgcgccacgccgcgccgagggcccgcgcgcccgcagcc

SEQ ID NO: 18344 - DNA, 1373 bp, Homo sapiens
  misc_feature (1)...(1373): n = A,T,C or G
ttggtttnnnnntnnnntttgggggggnnnnnnntntgnttnnnttttttttttntttttttntntgnngtnnttatttttttggagttnttgtttttatgattcggcgttgatgttttagtgttggtgtggtgtgtgggttatgtttcggtcgtgtnttatttcatgtgttatagttaatgaggtgtgttatttgtgtttgttctgtgttttgtngttttgttgttttgtaggtgacccagttcccccggtgtgtactccgcgtccacggccgattgcgcgcccgtcgactcgttccgtcctcgcttttggtagtgtttgagaggaccgtatgtggcgtttgcacacctcagtcactcccgactcttcctccctatttgatgggatggacaccgtctgtcttcgcaacactaagcccgcacacattctacacgtcgcgcgcattcgaatccgatttcgccatagtccgcgattgttcctttagaagaatataacgaaagaagaataagaggacgtagtttggtatcaatctacttctccatcctccggttccggacaccaaacgagtcgcgacaagagtaatagggttcgacatacatataagatcccagtcgtatcccactcttgtcctccatcgtacttaatatgttaagtgaagccacgacacggcgacggcacgcattaagccgcacagccgaaccaaatgcaagttagacggtgcgtaaccgcgacgaggcgtcgccgtccaatacgccaccccacgcttgcaaggcgccccgccgccacttctcctttccacccatccccgtcccccggccccgcgtcccgcgaccaaaatggacaatgcgtacgaactaaactaacagcatcggagagagccgacaccgaggacgcggttgccccgccacgaggcacgtgatatcctgccccccccagcacaaacacacccgcctccccatatgcggtcgccgccgcgtccccccacaccgccccgcaccccccccaccacacaggctcccaacacaagacagcataccccctggcgcgtcacgagtgcggcggtagcgcaaccaaccaccccccccttcaccacctcgcccgcgacgccccgcggtctcatagcacccgccttaccgagcgttaccatccgcatgccagctatggagagtgatattttgtagatggtaggtgattagtcataatatagttaaggcgtaagtctccacccaccccaacgccatctcaccgcctnctctaaaccatagaaccgcatcgacctgtatcctttcttacctgcataccataactatgatcgttaatctcttctcctcttcatttacaccactcgctaccaataccgttttatctctact

SEQ ID NO: 18345 - DNA, 1481 bp, Homo sapiens
  misc_feature (1)...(1481): n = A,T,C or G
gggcaannngggggannnnnnnnncnnccgccccgcgccgccccggcgcctcaccggcgggggagatgaccccgccagccatggagtattacttatttagaatttctttattttttattattttattatttttttttatttttttttntttttttctattactatatacttttatctattttcatctttttacatataatttatgtttataatttatatttatttattttctttaccaccacatcgtttcntttctcacttccccccttacactcctacaatacattacaccacacctattccctcccctcaattcctcccacatcccgaggcagcatcacaatggggacacgggtgctaaggggtgcttatctgctgcgcaccggtcctccaagcgggggggtcgttgagttattgggcgcgttgagctggcgcgtggaggggagggcggggaggggcggggggggggagcggagagaagtgattggggacgggggagggcggcggtgcgcccgtccaccccgagcccccggcacaccgcctgtcgtcacgtcgtcaccgacaccacacacatccatcaccacccctcaccccattatcccacacccacacgccataccaacccactcgacacccccatcccgcaccaactacacntccacatataactcactcttatctactcctgacaacatacacatacttatacagtgcctggaccgagggacggcggggccgagccgcggggtctacgatccagcgagcacttcgcagtgagcggagaaacggggtcacttgcgcggcgagcgcggtcccatcatcggtcgtgatcggtggcatgcgccagccgcgcgcgtcaccggggagcgacgcggcgaccgagtgtggagcaacacacgagactgtgtggtaggctgcgcggtcgtctagttatacggtaccgagtggtcatgagaccctcatcctgtcgaccacgcgcacgagacgacgcccgcgagcgaggtacagcggggagtacggcagagttacccatcacgtacgggctcgccaagcgacgtgcgccgcgacaggtcggaacagcttggagctgcgtcttgactccggagaggagacgacggtacgacgtcacaagatgcgcgggcgctcgcagcggcgactcggcgcgccgcattgtcgagcggcgagtcgtgggagaactcgcgtctcagcccgccggctctccgtctcggcaggcagaccgagacgcacgtgtatccgtcgacgatcgcngacgccccaacgtccgcggtggacgantccagcacatatatngtggcaggctgaccaagaactgcgctcgcagcggagcgggtcaatcgtacgcgtccgcgatacgagcgcgcgctctcgactgatcggaacatgtatctgcgcgctccgagcggaggcgacgaactaagcgagacggtagagagatcccgcgcggatgtctgagccatatg

SEQ ID NO: 18346 - DNA, 1747 bp, Homo sapiens
  misc_feature (1)...(1747): n = A,T,C or G
cacgacgcgcctcgccactanatgatacgcgaagctgtggncananaggacactgtatgtagaganctagagacaccagatatgtggctggngctgcgatttngggngcgatcgcgntcgagagagcagagagagcagngaagatggagcctggntgagagagatctgtnggtgccagatcagagggncagagcgagcggagtgtgtagacgtgtgtgtgcgatacgagtgcatgcagcgactataggagagagagcacgctggnctgctcacctgtggagggtgcaggaccagggagtgaagtgtcccgagtcgacgcgtgatngccgcgcgagcacagtcgtgcagtgtcacagcagcgagggagcgacgtcgcgtgtgcgtagcacatcagagagacgagtgtggggcacgtaggcgtaacattggcacgcactgcacagnagcncgagtcgcacgagagccagcgtggcgcgtgcgtggcgcggcgtcaccggacgcgcgacggccgcgcaagtgtcatcgtccgtcgcancggccaaccgccagcgcgtcgccacgcacgcaatctgtcaccctctgctcgtcgctctctcgtccagccagccaaccaccgcaccgcgcttcggccgcgtcagcggcctcaccgcgccgccttggctaccacccggcgcaagcgcgcggccgccaagcacgagacgtagcgtgtgtagagtgagaggaggagcggcggtcgcgcgcggcgggcgcgtggcggagtgtgcagcgcgcggccgagcggcncgcgcgtgcgcgtacgcaggcgctcnccgccncgtccacgggtgcgcgaccggcggcaaacagcgcgcgtacggccatagccgcccggacgcgagcggcggtgacacggtggcgcagcggtgcgcggcaaacctcgcccgacccccacagccgaccgcacgcgtcactcaatcgccgcgaccgcaccaacancgaggacccagaccacattcgtcccccgccggacacccaacgacgcacgtcccacccactgacagcatccgcacacggcatgcgacgccgccagcagcgccgctccactcaagcgactcangacacnccgacacaccactacacgtctcctcaatgtcccctcacgcgtaacntacnacagctcgtacaaccaggccgcagcctccgcgtcgcgacacatgctctctatcaccactctactcgcgcacacgcaacgcaccactacncggcgcacaccaccaccgaccnctgcgtccgatccgatgcagagctgtatcatctcgcntatagtgacgcgctagcacaccgaacagngcgcgtcacacgcgcacagacaccaaacctcnctacctgcgagctgcgcgtcgacactgcgacagcaacagcntacatggntcgctggactcagagacgcatgcacctnatcatacatatcantcgagtacagcagtcacgacgncgtactacgcaggtcacatcgcgcaagncacaatatccgctcagagccangtnntcatgtacgcgctntcnacgccgccccagcccctcagcgccgccgcacacacncnctcncacgctacgtcgtactcgcctctcangccggcgcaacacgcaccctcgntcncgcacccccnncacactgagtactctctcgcctcagactcgaacagcncacactcgagaccgatcgtacgcagactctagccacactagtagcttgnacacgcacnac

SEQ ID NO: 18347 - DNA, 1647 bp, Homo sapiens
  misc_feature (1)...(1647): n = A,T,C or G
ttgtttttttttttgttggtgtttatgtggtattgtgtttgttttggtttgtttgtaagnnannaggntgaggtgttattannntaatagggaggtggcnagaaggagagtttgaggcgatattgtatttttgtggtgttattttggcagtgttgatggatgtgatgttggtgtttgtgttgagtgatatatttcgtngtgtattagtagagcgggtaatactaagcttcacgcgcacacctcccttctcctagtggtttcagggtcgagagccgcggcatatcatggtgtcctatcgtgcgtgcgcgtttgtctttctcgtgtttattactctcctgcgtcgcgtctgttgtcgcgcgcgtctgcgcgtctcacagcccgcgtcttatccccctcgctacgtctttctttattaacatcatcactcgtacgcgccatacgatccaccgtcgcgtccattctcctacttctctcgattgtcacgcgttccccgccgccggctacccgtttaccatcgtttgattgtcgtgtatctgagaagtaaaatatttacataatatgattgttcgttgtgtttgttttcttaactcggtagggttggggcgcggctcctgccgaccgtgttttggctgcgtcttgtggaaacgagggcctgcgagcgagataggcagcatccgcagtcgaaccgcagattactggcaaccgcgtcagacaacgccgaacatactacgccccgggncagccatcagacaacgggttcgtcgaatacaacacgagaccgtagaaactgcatatttatctcctccgcccctacacgaacagatgcgccgagtgttgaactagtggtgaaatacactccatcgcgtgtagttttacagccgtgtgtccgactcgcgccctactcaacaaaacctcctgcggcccacgccgacttcatgacccatcgacttcacgactaacactctaccacggctcactagttgagcacgcgccaagtcgccgcagaccactcactcaccacaccgcccgcgcatcggcgagcgaggtagccgcgacgcgacgccccactgcngcacacacaccgcgcccgggtgccgttgacacaccccggcgcgccgtcacacatcgcctcgtccactaccgggatacgcagcgaatgatgagacgagacgagcgccaccgcacacgcccgcgaagagcttacagtgatgncgcgcgttacaccacgactcgtcgcgacgactcgangactgttctatatagtcgtatacccaacactcgtaacaacatacgacaccnttccaccctgcccacacttcctgcgcagctatgcacacacgcggagtgcagacattacatactgatgtggatgtatacgatgagatcgagttaccaatcatgacagtatgtatacaagcatactgcgaaagacacaagaacagccaacagcagaccacatacaagatccgcgcgacacccctatctcatantncacacactgctcgcnctcanatacttatattatctacacgttactccactataactatgctcatatagacaacgtaagacacgagtgccactaatcacatcatacattgtccatatttcgcctatcgctctntctcactcantactctctatccc

SEQ ID NO: 18348 - DNA, 1581 bp, Homo sapiens
  misc_feature (1)...(1581): n = A,T,C or G
ccagtggcgctaaggtgcgcntngntcaaanatnanagnngaagntgtngngaganaggtggctgtgtagtgagagctaagaagacagaatgaggagctagagctgncatataggcgagatgccgcggagcgacgaganaagacagagcaataggagcatcgcgcgagcaggatgcgagacggtcaaatcacaggagtagagagagcgcgtcgtgggcggcgggtgtggagtaagatgcgtcgcgcaacagatggcagagacacacacccatagacgcgccacatcgtaccacgacagacgagcgagacacaggcatcagcacagatgagcacgtgagtgggcgacgagncacgatctgcggatctgcagagcagagngcacgacatagcagtacgcgatcacacactccngttcgcacgcttcgntgcagcgaacacatcagtacacgatgttcgtcaaaacaccgtgcgananagcantcagatctacaantactaaactcgatctatatcgtagaacacaccgccgtcgccacaatcacaagaacgatatgctacggccgctagcacgagaccacatcagccgacggatgtcaacgacacggcgcagcacacccgcgcgcgtcactcactacgacgacagcagccgcacgccgcggcgcgaccgtgtcggcacngctcagcctcgcagctacacccatagactccaaacccatataaagaacgacaaacgaccntggcgtgcgcagaacgggcgaggcgacgggcgcccggcgcacgcgcgcgacgacggaacgactaaagccaaacatgacgacacggctcccacaactcaagagcaatcgccgcgcgcacgcaagaacgcacgcactgcacacacacaccaccacccactaccacacacacgaccacgccagccgcgcacgacagacagcgagcccgccacaaccacgcaagcgcgccaccagaccacccacttaatcgcacacgatctcacgctccaccacacgcgacaccgcaggagcacacgacagcatcgcgacgcgccgcagtacgcgaagactccacgtgcancggcacaatgctataaccatcgagcggacgacacaagacggagcaccacgcgngcgcaataccagnccgtggcggcgccgtcgcgccgtacaccggacgccacacgccgaccgcancgcangagacacgtaaaatacacgcaacacagcagcaacactctaccgagaaccatgcncacgcatacggcagcgacacgcggcagnatactaagacangaaagatgactacancgcaacagcgcactcgccgcgcaggacacagctgcgtacagaacgacagcaacgcgacacgagcaccgcacgacgtaccgacgtcaggctgccagcacgcagagtgcgagagcgacgagcgatacgcgcagaagagcacacacactacccgacnatagaagaacacacccacctacacgcacctctgccgaccatcaatacacgnangacaacatccaactagcgagaagcacaactcgctacgcgacgactcgacgcgacagcacagcacaccgcg

SEQ ID NO: 18349 - DNA, 676 bp, Homo sapiens
  misc_feature (1)...(676): n = A,T,C or G
cccctcggagntagggaagcccaaaagttgtgtgaagtcttttggctcggacatttctcctcattgccatcgtaaacaaaacagaatgactgtaaaatttgggaataaggaagagcatttgtttttcatcatctcgtcttgagggcacctgtctacttcagtagacagataatttcatacctatgtgtgaattcattaaagtggtactcttctccatcggtattggttgttcatgtaccaaaatatgcaaaaatgctttgtaatagaaataaaagaattattttcaggacacaaatcagagaaggaaaagctcccaagagagagaacaacctgacataaactagcaagccaacaggtgaagtttcgacacacctcctttaataaaggcccataaaagccctggattcagccagacgaggatacaatgggacggctagctgcggagagaagctacctgctcaagagtctcccttttgctgagagctgagtagatgacgaaacaacctgtgtggagagaggagctcctcactccagggtctcctctctgctcagagctgaacactcactgggacaccctggctgtggagaggagctaccctctgtgggtctcctctgagctgttctgtcacccaatanaactcctcttcaccttgctcaccctanaaaaaaaaaaaaa

SEQ ID NO: 18350 - DNA, 1455 bp, Homo sapiens
  misc_feature (1)...(1455): n = A,T,C or G
gtagagtatagaatgtgntatgatatgttgtnatattgntagntgtaaggagtgnngataatnttgattatgttgagacagtgttatattnatnttgtttgtatttattgntgttcatgtngtatgtntgtttagttgtatgattgatgtcaagtacaagacaagtgcgaacagancgcntgccacgagcctcacgcacgatcgtacgctcgcacgtcgaccactacgcgctctatcctactttatcttagatatcgccaaccgactctgtgtcttcatcttctacgcactcatacccggtatccccccacccgcgccactaacgcacaaacgaagtggacagacatgaggcgcgaacaacagaagcgtacgcagtgngcgcgcgtgttcgccactcctacagtgaccacaccgtgatcgcatcncaccacaacaccagaagaatatacgctagaactacatctgctaatgagaagatagaagcgtacataaggaaaggaaaaggagaaagcagaagagtacggtggcagcaacgcgaggaacaaaccantaatacatatagagataaacggcacgtcgcggacacacacgactcgagtgcaaatgagaggcagcaacgctaaaaagaacaaggacgacgacagagaaagataagcggacagataacgaaacaataacgagacagacccacaaaccccacaaaaaaagagacggaaaccctacatacagaaaatattaaatgtagcacgggaagtaagaaaagataagaacacccagtcaaacacaataaccgacccactaacgcgatcagcaaaagatagacacacagcactatgcgacagcagggtgaacgagagagccatcgtagacaaccagaacaaaacggacagagatgagacactcccacacaggacnccgcacgcacgaccacacacgtacacaacacacgaccacgcacgcgcccgantgccaccgaccgtacgtgcagacacacgtccaccaggaacgtgagagacaaaaagaacgaacaggtgagtacggcaagcagagaagactaatacaagacgcggcaggacactacgaaggaggaaacagagganttatgaacgttgcatagcgtagagagagaagtccccacctactcgcgcctctacacagcacaacagcagcgccacacgtacgacgactgagaaatatgtagagaggagtactcataaaatgagacagagatagtagttagatataaatgataaagagtanacgagaaaggancgaagagtaagaaagagggattagantcgagaaatgacagatagcacagtacacaaaataacgagaacacaactctaatacatatacagacacacgcaacggaatacacataagaccgcaaacacctggtacagtccacatatactaaagataatactcactatagtnattacataccaaacg

SEQ ID NO: 18351 - DNA, 2389 bp, Homo sapiens
  misc_feature (1)...(2389): n = A,T,C or G
ggggnnnnnnnnnngggnnnnnnnnnnnnnnnnnnnnnnnnggggnnnnnnnccaannnnnaannnnnngggngggtattnnnntggnggnngaaanggtgnngngacnngagagatcgcngtgggaccagaggncccnacnnggcgtcnanagcacagcggacgcngggntacgtnntggcgaccgccctccagcagngcatgnangancnaacggagnacactatcaacgatgtcacacgtgacttagctcggtttngnagatatggngagnagagcatatatagttacataatgtgtgtgagttgngtatgtgntggaagtggntctccgtcttntgatnaaacatatatgtgagntttngtagactagacaatcganatgatgcatttctcntgcacgccgtctcagcggacncgtctcntccagtcgattgtngtagttcctacacacacattcacagacgatacggagttgtgtgataaagcaagatgatagcgatagcgtgacanatgaatagctcctnctatccgccttattcaagtctcgcgagcggacttacatatgagcagccaccctcagcacatacagagtgacanacaagnaccnctcacacgctatcagtagtatgtgatataggtatgtgtgtatcgaaanatcgacagtctanacatcgatcagtagtcgagtagcatccatccatgtagatatatcacgaaacacactactacccacgagtacgcngtnctcgctgcgtgtcgctcattatatctcacatattcgccgcgctcgagataatcctattatttacacatgnacgcgatgtgaatcagttaatggatctagtagagagtacgagangtacgactcgcgctagnagtgccgccgtaccgcggtggcgcngtgtgagcacgtanggtatatctcacatnatacacgcagacaacgtgctntgtgttntcntcgccgccctcgagctgaccataacgagcgatccaattatgtgcgccatcagtatgtatctatcgtcgctcgacgtgnatnctctatgtgtcgagctagtgtacgcngtcacccaccgtcgactcgccccgagccgtcgtttgttgcgcacacacacactacgtcgttcgttagaagaagatcncgccatcatcgagatcngtnacagatcgtctagtnagacatcgcaacactgtngtatcctagntgatcacgacgagccgcaacaccaggcnctatctggtgtcaacgtnatgtatagttacgcacagcacatatgctatggacggacacacgcgtgccgtcgactcatagtcatcggcgtctcgtatcacacccacacaacactaacacggcgtaagtagagctatcacagcctgacatctccgcccgcctgacctatacaccgcgcattatgccgtcactatcctgagaacgtgacggctgtctcgtaccgagcacncnaggcattgccttagagataccngtttgacgatatagcatcggtcagaganattgtccngcgcncagtcgcgcatatacnatgcacgatagncngcgcgcgagttagacagnacacagtatagtgnaagctagcagagacacaggagtgcatgattctccgcgcccgacgctaagtatatatgatgtgatagtcgctatgcgagatcacgcgaactcattntacatgctntcagcgtatcttaatagcaatcaatataccacgcgagtctgntctnagtatcgcgctcgccgcatgtantatattactgttatccgtcgcagagtgcacgacgaactncatcaagtcgcatgaatagtacaggattcaagtcctctacatgccgctcataaccgttcagcatgacagatgatcgntatgcngctcggcgcggnctgtctaagcngagtccgngtgaanatataatgacangcgactcgctagcactgagtgtgatanttataatnttaacgacacgtggctgagcgntcaccaactctgtcgcgtgctcgctactatatntgtagttatactgacctttatgatagttcgngntgcnagctagaatgtagtaanagtanatgtgagcgcgcgncgtgaanagntanctcncgccgacgtgctgtagtcgagtagtgacagtagcggccgtgacgntcactatactcgctgcgacgactcacatcactcgtgntagtagcgtcaanagacacgccggacgatagtagatgagatgactgtgatcacatactctcgacagnctgcacatcgtgacactnatattagtacgctagatgatgctatantacganatgagttatgctgaccggggacgcgcgncgattgatgntcgggtacgcagctggtgtantgcgtcgatnacgt

SEQ ID NO: 18352 - DNA, 1865 bp, Homo sapiens
  misc_feature (1)...(1865): n = A,T,C or G
gtgtgatcggccggagacgcccccgctctaaagaaacataacaccaccacacagcaacacccgccagtttttttttaaacaaccccccaccacaacacccgaagagggtttcccagcggagcggggaagnacagtaccgccgccaattctatcgcacgccacgcaaggaatgcgaggccaacatcgcgtgcataggcgtagtatatatcaccaaacaaactggttgcatgtccgcagagcggagagataaggaaataagagagaaataaatgggagcgcaaggggagcaccagtaacgaccccncccacccccacactgcttataactgtcgtatgtacaaatatgtttatctcgnacttaccacatagtcgcgataacgagacgagccctgacgagcacgtatgtcaacactatacacaaacacaaacgacccgtgcgcgtggccgggccacacgaccccacaaacctgagctacgcacagcgaacgaagtgcgaacgacacacacgaaccggcgaagagttaaacagagcgagccccagcctcccgtgacgagctgatgacggcaatataatgaccggccacgtgnattaatatcaattggagcggaagagagaagcagggagtcaaacataaatcccgacacccttcttctgagcacacncgggaagatacatcacgcacatacatcgaagcgcaccgcgaacacatacacggtgggcggcaggggaggagaagatacgtgagatcgcaaccggcaccncgagtgcgatgtcatattncngttccgattcgtagataggaagcgcgatagaggcaatataagagcgatgagaggcataatataatagctcngcgagagtatcctaacgcgcactatatcacatacacggccgcgcgttatgnatanacgtcacagagaaatgcagagcgatagtcagagangtttcgaagagaagacgacggagatcaagcaaaagtataacacagagatgacgacacgcaacnaacgagctgcgcgcacgcancggaggtcgcgcgaggaagctcataccaccattcccacatcactaagtaccgccgcaagcagcgaggacagcactagaggactctgcttgacgagagcgacgcgataatcgacgtctgcgtaatgaggagggagcggatagacagtatgaaagccgtagtggggccgccaggcgcacgttgtacctaaaccgcgctcgagcgcaagtcgcacatgcgagtagtaagtcaccgtctaacgtgcgccgagcagttagacgacacgccgccgaatacgtatgagagactacatctctagagtgtatgtatcgcgagagcagtcngtntaactagaataatcncgaccgaccatatacatagagcacgtacntactgacgcacgacgcaccaactagcgcacagtcaatattcgcgtccgangacatatatcaacaagcggagtggatcatctgtcgcgggtcacagagtcacgtagatatgactctacagatagcccggcgcgcgcgcgcntctngctagcgcgagacagagcacgatatatatagcagtacgccggaacangngtggtgcgcggagatattactcatntccgcgcactcacagcgatcgacagcatggtatatacgaagccgccgcggcgtaatgcagctagaacacgcaccgatgtcgcgcgacgtataaattattaaagtgataaggtcgggtccgtgtcgacgacgcgtcacaccntaattcataaacgtgcgaccacgatctcacgcatatagcgacaagagataggatagcanacgtgcgctntgtcgtgcacgacgcntacgncgtgtgagtgnataccgatat

SEQ ID NO: 18353 - DNA, 1645 bp, Homo sapiens
  misc_feature (1)...(1645): n = A,T,C or G
ccccccgggcccnnnnnnnnnnnnnnnnnnnnnnnnncccccccctnnnnntnnttccatnnngcnatnnaacncctnatcccngcgaatctagcnntnntgtnancacannccaacaccantcaccccaacancacacnanntagnatctaactcncgcacacaccgacacacnagctacacaccacgcgccactcgttcgcgacccgtatgaccgccggcacccnccagctgcagcacgtggcgtccgtggtgttgtgatttattgatattatctcgacttgttaagtttgtcacgccgacttgtgccgcgcgcggcacctatcttcccatgtaccctatctttctcatacacacatcctggtcgggacagnggagagagnaagagaagacgacgtatgtcggcggttatgcagctgtatacgcgtccgtcccggtccgtccgcctcgacgccagcnacacacaccgagctgtgatctcngtgtgacgtcgtagtacaccgacccgagcctaacgcacgatcacctcacgcacgcctggcgcgatgagtcgcgtttacgccgcctctccctctatgcagatcccgctcgcagtgnaggcgccgaatcatacgatacngcgcgccggnctggtcagttttaccatatagacgccgtcgcgcgccgacaccactcagactcctacgatatagcatcttattatatatgagccccaagatttatgaccatagatatttttatccccgcgccttccgtcttattaccaggtcccccatctcggagcaacccagtaaacatatctcctccccggcattagacgaattctacctcctcgcgcgcctagtgctagtcatcccacaaccacgacggtgtatttacacttgatatttcgccgcagtttccccactcctctattacccccagccgccttatgtttccaccaccccccccccgcccggttcatgtgatgcccgcggtaagggccgatagccgcgagatggaaatagattaggacgtggtagcgcgatggaggagcatttcgctcgcgggcattatgccccggtaatggagcgatgatgacgtgttgcagaaagtcgcgtaggcctggatatcgcctggttcgccatccaacgcaagtggtcctcgcggccacagccaacgcgatatcaacgcgatgcttattgactatgcagcaatcgcnaggaactcactctctattatcaccagtagccgcctattgcggccacccacatcttctcgagcaccttggtcgccgagatgactcaatcggcatatactcgtgatacgcctcgctataggccacgatacgtccctatcttatcccggacgaccccgctttctttatgtcctgtatactgcctgtctctgccaccgccgcttcagcgcgcgtgagctggagtactatctcgcttggagagaactgtacccgcacncgcatcctagtcgatgatgacgcgagtctcgccgctctgctntagcgcgcacgtcaccgccttcggagagtgtgncgtcaatccgtatctgcgaacccgacggcganccgacgtggtgtttcaggagcgcgctcgcccctcgtgatgcgccgtgattntaattaggtgccgcataagtatcacgtaccgct

SEQ ID NO: 18354 - DNA, 2435 bp, Homo sapiens
  misc_feature (1)...(2435): n = A,T,C or G
cccgggggggnnnnnnnnnnnnnnnnnnnnncncnncccnnnntnnncngtnnnccggggccggacnnnncnccacaatcanntcngggtagnccnngccaccacganaactcacatcacaccacacgancacatgcacagcctcgacgccgcnacacagcgagacacctcacgcgcgacatacactnataaacnacantntacatatgcgcacacacacaacgctacagcacacgacgcgacgacggtcatatatntatntattaatatcatttcgtcctanctataccacatacnccccacccnactntcacatctctaccgcnctcncnnactatgtaccaccttnataccatgtgctcttgtcanatncggacaatcntcgcaggaggagagtcgantatgatgtganagtgtatgagagatgatgnatatatatagangtgagtgtatatatgtagagaataatancacgagancnatgncgcacganagcagagcagcagcgcggncgagagtatgcanatatgagtaataagtgtatatatgaggacgatgatatngtgatcatagganagataggagcgangtgtctataggntacgcctatctcagacatggcagtctacgcagncgcaagcgcagagtatgnaggagcagtgatgaacggccnganagatgtncgctacntctatatcaatnatacagnatcgtacatgatactacacacgcgaatatacagatacagctancgcagagatncacgcagatntacangatcatataatgccgatagtatgtcngcacacgncacgactgcacgngtgtgcngcgcagagtgatgatctngatagtagagcatactagtagttcagctataanctcacgtanagggactctcagtantgtcacgntacccgntcattntgctcntctgcgtcgcgcgtccggtgcgngtgcactntatgtatcagtctgtcgcgcattcgcgccagcagtcctgtcgcttagtnagtacactggatgtactcgctactctccntcagatcanacgtgnacgcagtagcagatatagcgtgagattaanacgtnatcantagatcaacgacncgctgcntatngantcagcactancaaccaagatgatgcagtcgatagagtaacgtgcagcgctcgngnatacgcgaacgcatcagagatgtgtatagtacngtatanancagnatagttgtatcagatagctgtcgtcgcacgntgcagttcacgcnagctgcagcncacagatatatcattgntgtntagccntccccagcgcnacctncgtgtggatnatcgatgatctgtgatcgacactcgtctgcgcgatctcgcgcnactctcaccgcgtcgtctntnatatcgtntagttnaccgcagcgcacaggcatgtaggcggtcgcncagctgtagtagcagtcgcgcagntgnanacnagtcntantgantacnattncgctggagctatgtctgtcctgtnantcccagcgacgatagtcgtgtagacgtgcacatctactcgactagatntcgtcagcgancgtcgtnagtgctancgcagcgcgtgcacatgcatatagatcggcttncagtgcggactcactgtcgtcgcgcgagncntaggatggagntatagcgngctgncgacgcaggtaagntcggattgtgtagcnangaaacgcacgcnacgtcacgattatgatatcagagncaatntgntttgcacgatgtgcatatcagcgcggtnatcgatacgagaactagacgctgagtatagatatacattgtgcngttgtcgtgacacatgaggntatatgcagacactagagagtgatagactgcgcatgcacgaggatgaagttgtgtngggacgacgtgncgntgtgttgtcagatgccctcatagatcgagcgtcgagcagcagctcgttcgtacgtgcggntnatnagtgtanagtatattcacaccacgtcgtgatacgnctgcacacgacgcatcgacacgcgtantgtgtgcacgctactacagaacgcacacacatttcattgtcattcgagtatgacgaccgcagngcgcgaagatcgtcaacagtcacgaagcaatcgtcaatagtagacacagacagtacntagtntcagcacacgttatgcaganacaggagtgacatctacacacncacncgagtagtngaagtaacnctatgatcncgatacatcgacgntcgcgtacttntctccgtatacgccacagncgcgtcgttagtctgcgttggtgattcnccgtctgaggcgcgcctcgcacgcatgacatgtcgtggtgttagagtcgttaatatgacatacacagacgacacataagtttagcagtatatcaccactgataantgacgatagcgcacc

SEQ ID NO: 18355 - DNA, 1217 bp, Homo sapiens
  misc_feature (1)...(1217): n = A,T,C or G
agcgaagtttcggggagagagaaaatactgagaggtcctggcggttgccgcccaggaagggaactgtttgtttgtgtaacagtgagcctatacagttgtgcgccactggaatcaatgcaccaattgtgcattagattagcacacctagcaaggccttaccaggttccgttaagctcaggggcagggacgtgcacaccacccctgctgtcacagcgaccagcaactgcgagttgtgttaatgtatggcggggtggtggagggggaggggcatggagtgggggcgagtgcggacggctggagcgggggggcgcgtggcatggtgggtaggagccgcgggtggtggtacgcgtggtaggaggcggggtgggggctcgcccctccgtgcgcgccaccgcaagactccgccacgcgcgccgcccgcagttgcccgggcgcgcgttgacgggggcatcgcccgccgatgcgcttatacggggcgcgccgcgcccgcggataccggccggcgaggcgagattggatcgatacgaggcatccacggcacggcgccgcaccacccccgtctcgatcttctctctactacataacgggctacgccacagcgcgcggggcgctgtaatcacgccaacgcaaaacacgcgacgagagggcatacagaactgatggtccacgacaccaacacgcggtatcggcgggaggaactcgaataaatggggaaggcgcgcgcgcgggggatattcgaggcgaagtcgacagtcgcatagtgtgtgcggcgccggagaattgtcccgcgccgacatcacgcgtagcacctatccacgcacgctcgcccgcgttaacacacctctcaattatccacgccgcgacgcacgaatcgacccctctacgtcgcgcccaccactcgccccaaacgccgcccatcttaatttacatccacgcgccggccgcgtatgcggccgcgcaacgtataataacgtcacgcgcaccacgccgcagcgaattgatttacctacaacgacccgcgcccgatanatggcggcagcgggcntcccgaacagtatttacgacacgcggcgcgcacatatgtagtaccgtactcgtcgatcatgagcgcgacacacgcgcatcagtgaactggatcgcggccgacctccactcgtcgcgctaataagtggatacaccgcgcgaccagtctcgcgcancgtagcatgtcgagcgat

SEQ ID NO: 18356 - DNA, 1784 bp, Homo sapiens
  misc_feature (1)...(1784): n = A,T,C or G
tttttaatatgaggtannaggagaggaatcnttggttgagaatagttgaagcgttgtgttttgtgttttttgctgtgtgtgnagagtgctaaagaaagcaatgaccaggactcatatagacantgnagagaaanagcacagtgtaaggcccaacaatatatcaccaccacacaagtgctgangtagttcacttagagacataagtaatgctattagtatgtcgctgatgataaagcacgtgttaagactgcacaggtgtggtgacacactctcataaccatcccaatancgtctgagacgcttcgagcgtgttgtggttagnacagcacaagacacgacgcgaggtgancactacaaaggacaaaacgttacacagctgtgtgacacgagtcgatgcgctggcgcaaaataagctctttaggccagaagagaccaaaccaacacataaagttattaagtttgcacctcaatgtccagggatctaataaactgtatttcgaggacgaagccccatatgaaagtagaattcgtcgagatcttcctctcctccttctatgttgcaacgcgcgtaagcgttgatgaggtgaagatagagggatatacgcacacacaccgacaccgacgaagcgttcgagagtgaggaaacggtgtcgtgcgccnatctgtagatctttcntcacttatggctagaaaggactctggttacgccgagagatgatacctccacgcaatatagtaagtaatagaaagaggcgcccgccgtcgcgacgcgatgggcaaataagaggggaaaagaagaccgaacataatcgaagctacgataacttaaaatgatacgtgcacacaccccacgtgagcgtcgctcatggtgtcaaagaacggaggtagggacgacacaggcgattacgcggaatcgagacggacacagttccggcacgggagtaatctgtttcacgcatgggtaccaaccgacggtttagcgcatacaggtcagcacctcagaaacgtgagtgagatgcatatatcacagtatgaactttgtggagtatgggcgcggaggaggaacagttgggatatgcagtgttagacaactcatgacnaacgcgtgagtaaacatagtcaatgtcgccgcgcgtaaataganataaattaagatgagagagtatgtcgcgtgacaagcatacatggtgattgctctctatacgagggcatatatgcgcgctcgttgtatgtgtatgtgccacggtcagcgtatctttgtaattgtccggattgtcggccgcgcacgtagtgtatttgtaattagggatcaactctgtaggcgccaganggtctgtgattaatagtaaatgcagtcagcgcggatatgaggctctttgcgtaagatatagagctcacgcgtggtagagcgaatnagtgagacaattgaacggacggctgagccgcagagcgacggtgcagcgcaggtctcaacattatgaagacttncatcacaggatgtactgcctggngngcgcatctacgtagagcatcgantcgccgaaagcgancgatgcgnggtgcggaggtcngagtaatagtataatgcgagttgcgatgagcagagcgcgcggagattacacggacggtgtgcgtcgtgcgccgcnctatatagctcactcgtcacgtctcacgtgcgcgactgcggtnattggntngatgtagtgtgagnacgacatcangaaggatgtgactagcgatccgaagntntaatacagctatcgaacactccgattactgnangc

SEQ ID NO: 18357 - DNA, 1560 bp, Homo sapiens
  misc_feature (1)...(1560): n = A,T,C or G
ttttnnnnnnnnnnnnnnnnnnnnnnnnnnnnnnnnnnncccgttnnnaannnaagnnnaatngnacganannntngtgacaagncgaaacaataacgaaaagcaganagcgaggacgtgccgcagcgccgctgtcacggtgcgcctgggtcgagcggattacgcgcagcacacttgaagcaagtcatggttnagtaagatatgaataacacagaggggcggcgtcgcaccgtctcactgccctgactgtatctcccttacactaattaaatatggagatccggtgtagcagngagttagttgaaaggataatatgtacaacaatatataaaaaaataattactccttgctggcccgcgcccgggcacgagtggaatatatatgtaatggaagtaggatataaaaatatgagcgtccgcgatgcccccagcgcagaatctagcgtcatacgggcttcacctcactccttccgattcccttatttgccgttttatgttccgaatacctctactcatctacatatgccgagacgcacgccgcacggaatgtatagagaagagtatatttgtgtagcacctcttattcacccacacctattcaacacccccctctcatatttttgtcctatcctccatgtgtgcgtgtaatatagcatcaaccggccggcgtcgcatgcacaatatctactacaaacttcatagcacgcatcagtgatgcgcccgctgcaacccgtccgggttttatcaaccagatatactataacgcacgaattccgtctcaccgactatgttataacaccagccgcatatttatatatacttccccccctgcccccacagtttgatatagtcaccccatattacgcgcgaccacccacgctaacatcagagtcactttatgtttgagttccgcacattgaaggtgtttgattgatgcccggacttattcacacgtgttagttaaatgtaacaccataatgcgagattcacgagattacaacgatgtatatgtggtcagaccaaccaacacaatttattaatcatgtcctgttacacacagagatgtaaggatcgtagtatagttctgatcgcccagatatattctttatttcgttgaggatccggcttatagattaagaccaccacgcacttctgataccaaattacgttcaatgctgcgtgatttacgaacactctacnagattcacatagtgtacgagagctacgttagtcccccgtatgcgtgcgcgccactagcgngttagtgtacacatatcgcacantgtttatgctcaccaacatacttcgtctcgtaganagtcactgaccattgatcacagatagccatctgagtcacacacggcgcatcatcatattagctctaaatgtttgtaattcactnatctacacatatatgacactcgtgctgtggatgctatgacctagattccgtccacataacagctataatacagcgtagtatcagtcgtcactactcgtatccaacctatagatacacantagtcgtgcttnatgagaccatatgganagcgacaccacg

SEQ ID NO: 18358 - DNA, 1363 bp, Homo sapiens
  misc_feature (1)...(1363): n = A,T,C or G
tgtgggtgtggggtctgcccgtgtttgttgtccttacccccgcacttattaagtccttcnttatgtttgttattatcgtccaattctatctctttatctgacagaaacctagcgcggttgcgcccattgctcccgtctagnctatgccgcacaccgcggggatcagtgtctcgtagtgttaccacgatcacatcgttgtatattaatcacatagacacaaattaataagacccaccaggcatgcgtgacgtggtcttntgtgggtattccactattcgaatgtacacgtcgcagattcaaatatagctcacgccacagtcgacgcatttacagtcgttatattgagatgtacactttatacctacttacgattattacgcatttaaatgttttgcttattgctgggcgtagtgtgaccgaggttgtttacacntctacacagcaactacttctgatctcagcgaaacaagatgccactcgacncaacataccgttagatgcccgatatataacattagagagatagctatatcagagcgtggcgtaatatatattagtcaagtgagggatacagctcagtacggatcgtaaactgacatctaataacatactcccaatgaataacataatttacgcgtgcaacgagaggcggcgaataatatacattacgggccggatttaatgataaggtcgtacaattgaacataaacgacgatagcgatcagcatcgcagtactaatatagcgcaggttgcggcgcggtagagagattgttcgtcggagttaggatcccgctgcggagtaaattatagatcaaataaggtgtaactaaggacgatgataataggaacacgtgctccaatataactggcgcagctccgcatcaccagcttatcgcagctcgccccgactagaaagtattgacgatttaaatactatgtcagagcagaataagaagacgaagatagagtgcgagcgagancacactacgactaaagtgtcacacgtcnataacacgctggtgcacatgaatcgagtacggcggaaccagatccattagaacgattagcagctgagagacaccacaccatcagaggtcgttggtagatgttgagcacgatgtgaacacgcacggacattatatcgagacaacacgcgggagantgtcanatcgaggtctatcatggggagctcagagtagcactgaattaaatagtaataccagacgtanagatcgaaagatttcagtaatgaagatccttaacgcgtgtcatatattataacagtccgccgcgtatcatatttagatataaagataatatactacctcaggcggcgagcgttatagatattcacgacgacga

SEQ ID NO: 18359 - DNA, 1635 bp, Homo sapiens
  misc_feature (1)...(1635): n = A,T,C or G
gggggggccnnnnnnnnnnnnnnnnannnnncgcccnnnnnntnntnnncangaagaaaacaccccnaccnntntnntaccacaataacaacaataacgnaaacacacgacatnagacgtaagaagatccgcgtgctcttctccgcgcggcagggacttgatcaatgtttccgcacgcgacaccatcgagacgcggcatgattggagatatataattgtgtagctggtttacctacactcaccacgtcgcccataccatcacaagtatatcacactaacagagtagtaaatgaacaagtcgagtatgtaattggttaggttataattgattgttgtttcgagaggtatggagagtaactatacaacttgcgccgcgcccgcataactataggttagtatataatttcgctctcatggcggctcaggagtcgtgactgcagatcggcgaggatcagcttcgcgcgttatcatcagaatacgtcgcgtttgaccgatcatcgtcgcgtctttcgaggtatgagcccctatcngaggacgcacataccgagatatcttcaatacccaaattgcgcgagacgcccgcacgcgcccattgtctgatgcaaagtntgtatataatacgcccagagagagtagcgcaagagaagaagaaactcgccaggcagatgaagtatgagccgatagcagacgcttgagttgttagtttgagtttatatatacgtcagcacgtgttctgtccctaatacatacaactcttatacgtaccgagtgagcgagatgacagtcgtgctagacgacgcacagtttatgtagataagcantattatctatgaacacgcgctagtcgcagccaccccagtgttgtatgtccccgatgtcaagtagtatatagtttaacgaacacccaccaccgccgaaattagtagttttccgacgccatagtagtgcgtcatctcacttattagctctgtatagttcatacactagcatccccgacgaactacgaggaatatgcagaagcccaggcagcagtgacgccgaagtgtattatagtattatacaccgcaataacgagcgtgagtacgaatattgtacagagtgtattatgtcggtcgtagacggcgcgcgagtatgttgtgcacagttgcaggactaagccgggagatagtattatggatgtgagaagtatacaggctaacaaagaacgtacgaaggcaattatatggatgaagagcgagttatagaggtactcccgtatntattgctccacttatcgcgacaacggtggatagctcggtcggttggcactattacgcgagtgtggatggctggacacgcatcgcataggtatgtacactccgaacccgctgctattcaacgtatatcagtattatnagatatcaccgagagagacagtggtagtgtacaagagtantacgaacagcaatcatgcgagctcgcgacccacgatctaatcagtagagccagcccacgcgcagcgtccgccgcacgctccctcctcggtcgtatgtcagacatccgagtgaacgagcgcagccgagcaaggagaatggttccatcgttgacgccagtagtacgcagctaaggatcgctcaccagtttcagcatagaacc

SEQ ID NO: 18360 - DNA, 1626 bp, Homo sapiens
  misc_feature (1)...(1626): n = A,T,C or G
gtgtgtccgttccccgggttttttttcctggcattatatttcggtggttgcagattgacaagtctccctgttacttctttgaaagatgccattccactccttttcacaaaagagataatgggtttgtcggtcatatgtatgattgataacaggtgtgtatccctacccaagtgcgattatgttatatttgtgtgataaatagtattcgggttgtggtccctttacccgcaccctcaccacccggagatcgtacatgtttggaatgtgtataggcatagacccgcttaatccttaatttcagtcgtttatacagattttcacgcaccaaagcgaaaaataaagaaacagttttcacatccatgaaaaatctatttgtgaataatatgtgctgatagacaaccctacagcgaaggattataagattgaaggcgatcacagggtagaacgatgggagagaaantnaacagacaaatattaatcgcagacgcgagcgcaatgatcggcacgcattatattntgtgtgcacgcccacaatgaatggataatttaattaagttgagaggttgcggattggtggctgcgacgtacgttaacggagcggaggccaggcatcatcacatacgtcacagtaccaacaccgtcgtgtacgtaacaaatcaatttaatagtcaattacaagtagactatcaagcattatcctcagagaatgacacaggatcaggacgatgacgataatacaacggtgacacgaaagctgaacgcactgatataaaaatgaataggttattacacttagtagtttacggactctgtgatatgagtttaggtgatagtacggtaattagccctggatccatagtagacactgtgtaagtaattatcagttcatatcaaccatccgcagtactggttcgtagacattcgattagagtgtgtggggtgagcgtatttacagtgaggtagcgctcgggttgcatatggtatcgtatttactcgcttcagtaccagcggtaacccactatgcnaggtgtgcctatctcacttgccgagtagtgtttcaaggatgccggccggtttagactaccgtcgcgccgcattatgaagagatttatgntcattgaatctcaatactctgtcngctgcatgatttattataacaccagcatgtcatagtagtgatgctggcgcgactatcgcattaccgccgttantacacaggagtgaagatcaggtgtgagctgtctatagggctatagagtcatatatactgtagagacatgcggccgcgagcgctatgtggtcacacaatcatcatatatatacatctccacggacaggcggatgtggagagattaatgaattttaacacagactcangatagcacgacgaattaattgacaacgacagcatgcgagcacacctcgtatatactctcgcacgagttacacatatgtttggtataagccgccgtgtcgcgcatcgcagctgtctgcgtcatcctcgactataattntacaacatgtcgcgtcgtcaccagcatctcatcacgcgtgcgtntcatcatgtattacgccgccagctcgcacgttcgnctgatgatagagtcttatatagtaatctgtatt

SEQ ID NO: 18361 - DNA, 2195 bp, Homo sapiens
  misc_feature (1)...(2195): n = A,T,C or G
gttttttgtgtgtgtntannntgngnntnnttantgnagtatcggtannaananngnaggcgaagattaangtgaataatangaagtacagaatgatatnacgcgtgacaagagggnattatagatcagnctgaatgtaganatgaaagtngtatnatgacancattatatgtcatagnttcgctctcgcgtcatgtaggantgtgtnacctctcgccaatgtnatctgtatatcatgcatgtgtgtacagacgagntgtcaactngcttgtgcttatcagncatnngtcgaccggtgacgggagtgntnagtgttgatgtcgcgtgatcgaccactggacagngcacgacactcgtccacagcagtaacactcgtgccgtagttgtgacncgagtgatacgatatatcattcatttatacacacttacanattatattcncatatctanatgatggtcagagaggagtcattgatatgatagactaaatattatntaatanatatatatcnctatcgcntcgcgctgtacatagcgacacnctctactcgtattacatatagtacanatagtatagttagatagtgcgaatagngtgacgtatcagtcgatgagagtctgacttcacagacagcagacgtgccgtcgctgcaccgcaccttcacgcgagtgtcgcgctcattatactagcgtcaccgtgtntggcgcgtgtctcgtcccgtactgcgngtatatgacgtgatcatatatccacgcganatccgttgacgtatcacacacacagccngntacatgcacatagctgactccatataatacacaccagttctcgcatcacatcgcacacgcgtcatgtgataatcatatatatgcattatatgtgtgttanttangacgcccgacacgttataagctagtacgaattatattacatagtactantcgatcncncncgactctgtcntgantacttgctgtcagccattcatccaaccgcgctaccgtagtctatgtcgtgatacgtttagttactgtactanctatactcacaatgcacgccntagttncttcngtgncggtcagcatcgcnatcactcgcgacagcaggacactagccagcgctccgatcatatactgctacagcccactcacgagtctccgcnacggcncatgtatgtgtgttgtgatcgacacgctctactcttgatattcactccgcaccgtccatcacgctcgctccgacgcgctngtcatgtgatataccgccgcgcgtnccacggtgattgactatatcttctccaccgcgtacaccgctccgccgccngatgatgtcgtgttactttcaccgcgttctactccatctccattatccgccacgtacgtcatatccgtgttcgtgtgagtcgttatantcacacaacgcattcatacatcattgatatacactaccgcggacggtatggcacccgacgttactcgatgtcggtcgggcccacttgtaagtcagtgcgtggtcgggtgatgtctaaatggagtagaggcgtcccagacaccgacccgatattcttaaaccgtatacccttattatatgcgtcaaacatgatggagagtcacacgttaggacataacgatactacgaagcacaaccatcggcggtgcgacttatgcggagtagccacgccgatacaattgtgaggacagcgcangacgtatgctcacccaacataacgtaatacagcgcgcagatagttaactncgtcacatgatgttntattcacgatactgttgttccgtcacctattcgacaatcacgatnactctcgaccatctctccaccacgatatgntcttatcacatatacagcgcaccactacaagagcagcgccacgactatcacacgccgtattagaccactgaattntctgaatgcgaaatgttagtatagcgagatcgcgcgcgacagcctcatagtatacatctcttccacagatactcatcgactanacttatgagcgacgcacntctactctcagtcagtcatatgattgtcatacactacacgcaagcgccgtagacgcacacgccgacgcgcggctactctgtgctagtantacctctcattgcatccncgcgcctcgtgtactgcatacagtgtnntatctagttgccacgatgtagtacgacgatagctcacc

SEQ ID NO: 18362 - DNA, 1733 bp, Homo sapiens
  misc_feature (1)...(1733): n = A,T,C or G
atacgatatcngtgatgcactcatacaattatgaatatctataattaccntcggtcattcatttnatccgcgcgcggccgtgtgtgtgtatgggttgcttgaagatggttatcgccgtttgtgatacttagggagttgtgttggagnatttttacacattttatatcccacactgatgatgtaaatcgtgaaatagacttcacgggcaccgcgggcangtacatgcggcgccggtagtatcagcgacgccccatacagcgagaaatgataagatgcagcggtatattatcatggggtgggattggatcaaattattcgccgcccgccgaccgcaatggtgtttgtatgataatctttgtgtactattgaagataccccatttactttaatatcccagtaactttactacttgattgtaccataactttctatttgcaccacttttttcgcattgagacttaggttggggtgcgtgtgtgtcgccaccttatccaccataattatattatatcaagtaatgatagtatgatgcggatttaatatctccgctcgtgctcatttaaggtctgtattcaacacaccgtatatttcatttcgtccgctataatattttaactgtttttatatagtgatgatgtatggcggacgcgtctattactatagagatattaacgaggtatatattgatcgtatggatcgcccatccgtgcgtcttgattatgagttacgatcgtgagcgcatactcaggcggatgtacagcagatatgcagtgtaatttaggtcggcgcaggtcgctacgttcaatttttccgctccgtggcctatatctatatcggtatagtatgatcgatatactgtcggtgtgaatctgtagtattccgtatatttattgatctantacctatttatatgagaatatcgagaggcaatacagcgtcgcgcgtgtgtatttatatagtcgatacaatgacaatttctcggttacgtgttggattgtatagtaatcaatgcaggcacaccacgatattaagactagtatcgcgatagtaatatagaatgtaggacaggaggggtgcgcggtttggtaataatgtcggcatttattaaatcatcttataattctacctaagcccagcagttaatataaccgtccgcactattttgttataagaaatgtatctgactcttcgtgtacactgtagtatattcagccgctgactagttaatatctgcaagcgcgggcggtgtggcgagataaagacagcgcataataggtgcggttgcgttacgcgtttatggcagattatctggtcgttgcggatatatgttnattagtatgcacattgtcgcggcgcgcntctgcgcgtcacatctctcgcgcagttattgtagtgatttatatatactcacgcgtgacgcgcgcgtcggcgcgctatngttatagtttcgacagtagtacatgccgacncccatcgcgatntgttgagtatgcagacgtacncgcgctaacgtcattatatgataatgcctcgagagtgtcgtgatattatattatctntaatgacantgtagacgtcantcgtgantcttgtaatantctctcactcgatataatatatgttgatattacatactcgcaccagcaccgtagacttnttttgggtgacgagtatctacctggntctctattacacatcgatacgtatatatcgagatatcggtatccgtaatt

SEQ ID NO: 18363 - DNA, 2025 bp, Homo sapiens
  misc_feature (1)...(2025): n = A,T,C or G
ccccgggcggcncnntnnnnnnnnnnnnnccnnncnnccgcgcgnnnncgannncctacgagaaccncgaacccaggnttaacaaccacagaaacactcacacaccacccaacagaaacgcacccgcgtaaaaaccggcggcaaacacttccgcgtcttcccgaccacaccccctcactcgcgccgacggtagttgtgtttgctatactcctcataaacctacacaccatantaacccatccctcacccgatcatcacatatgcangttgtgcgaaagaggcatgacgggggcgcgtgtactggtgtaatagagtatgtaattataacagatattatagaaaaatagaagatagcacagatcaatcgcgagcacgcgcgtaacagtaccgtagagangtcagtgngcggtgactagtagaacgatgcggtcngctaaagacagtgnatgtatgatagacctggcagcaaatagagcgcgtatagcggcacagctgtcgngatatcacgcatcgcactacaggagtaganacgcgcgttgcgttgccgtgcggcgataccacgtctctttctattattcgatatatgacgccctcacagcggacacgaacagaactgtcatagccgcattgagaagtgttattcaatagacgcgagagagataagtatcgcggantatagtngtgtaatcgcgcacacgtgatagtatgatagcgacgcggcgtgctcgcgcggccgttgtgtgagtagatcatcgactacacatacaccaggaggaacntgtgcgcgacgcccatagtctgtaccgcacaacgcatataccgccatgtcgaccatgatccgtgtagcagcttcatatcgacctcacacntatagtagtanacttgcgtactactatgacatagacacagcgtagattgccagcgcgcgcacggtngcgtgaagaaccagccgcgcccgccagcgaggtatgtttgttgcgtcgacccgagcatacagcgcacactacgcggtgatagttgtaatgacggcgacatctaaagtacgcggtgcgacttatccgcagagcnagacgcacagactgcgtanagtattgtagctgttctaaatatcgccgcagcgcattatctgtgtnatancgtataactgtaaccgncgagtcgtatgcggcgggtgtcacgtgtatttgtntctaatctccaacagctgtagcgctgttagctancgaggtattcgagctatcaanatgtatacgatagtgattacaacgacaccacagacacnttaagtcttgtactatcgcactngcgnatgangtagcgcgcgcgctntgcacgtacggcgttcgacgngcgtcagagtgtcgtgaggcgcgtagccacggtaccntacgagccgctgtgtactgctgngcacatagggcctcgcgatctagtgngagagcggatacgcagtgtaggtagcggagtcccacgagntcgcgcagncngtcgcngaacgantagatatgctgatcnganacganagngntgtacacagacgcacagcacgtaangagcgangagtgtcggcagggtcacctgtngtatcgcgangtgtagtcgcacgcgcagacgatnttcgtgagattagtatgatgtngnacagagtcgtgctntgagtccnacgacagtgctangatcgtatanacgngtagtactgnctcggaaccatgtggaatagaactganacgacngcttcgcgctagatctctacgcgacgcgcgntgntacantncattancaacatgacgacacatgtcgtangnacgcgaagtantntctcgtcgaccacgcactgcacaacgacgagtgtgatattagacgntagtggtcgcgaacnnatcagtcgcgacnagcgcactacacagcgtangatatgantctgcanttngtagtgatatnangcgtgaacgagcgagcgagatcgcagcatggngatagatgatgaagtacacagcgtggtnantagtacgnagatacgatact

SEQ ID NO: 18364 - DNA, 1291 bp, Homo sapiens
  misc_feature (1)...(1291): n = A,T,C or G
tgtgtgcgctccatgatcctgtcgcctagatgctattatacgcgctggcgtcagaagaatgcatccagaggtagaagngaacagttgaagaggaagcgaaatagagatgtagctcagcgatcatgtagagagaagataaccatcacttggtgagagagatagtgtgctgtatacgtgacacagaagatgcggggagcactcgtgtgcaagtacaagagcggaacgtgtcgcgacagacccctgcagagccatgtaagtcgtggaggcgatcacgtgatgggatggagcgtgttgacgatctgcaagaatgcaggatgatgacgggctggtgggagtcggcatgcgagcggagcgcgcacccgccggtcgtaggtgtggtagatgtagcggggcgtccgcgccgcttctgtggaggagatggagggggtaggtgaaggtcgccgtctctcgggtcgcgcgcgcgccccgctaggggggtgggccgggtgcgtcccgccacgaggcgggggagccgtggcgggggcaggggagtctctaccactacccatcgtcccccttccataacccgcaccgttggtgatccccgccgcccgcgggatgaccctgtaaccccagcgacaccgaccccccatcgccgcgacccccccaacccctgccacatcatccaacatacttccccaaccggcccccccgtcgccccctctttccacccccgtgtccctcgaccaccgccctccccacgaatcgatatatccgtccccacccaccgcccatgccccccttttgcccccccccactcctttccttttattaccttccacctatccccactaacacctccgcctaccccccccccccctctacattcctctcgccccattattcccntccaacaccccgcccccacactgtcagtgacccacccggcaacaatcaacgcgcccgcacccgcgcagtccgagattcaccgcgccccaccacacccacatgtccccctagttctacccaacaatgtgatggggtgtgagccaccccaatactcccgctcgcagctccctaccgcgagacgagccacggccgcccntgcactcacnctgcacccgcccgcctctgctctcactgctcccgccctcgcttcgcccatcgtcttatccacattgaggaccaccctcgatactgagcacgcaagctcgagtgggtcgcagaacaccacacccgcagcgcgccgccccgcagagtacctacgncgtcacacgtgcgtacacagatgctcgaagacgcacctccagcg

SEQ ID NO: 18365 - DNA, 467 bp, Homo sapiens
caaggtcattttcctatatcttctgtcttttcctggccaaaatgatcaagtaaagaacattaaagaagaaataaattactacatattaaaaatacatactgtaagatgttctttgtacaaaaatgtgacaacttcaataagagtaacttggacaacctgaggcattaattgaggatcaatatgatgactttacattgagaatcacatataccctctgaatagatttaaaaaatgaaattttttaattttcattaaaaattaaatttttttgagtgatgaaaatactcaatcacattattttcaaattgttgataagcatggaaattatcagagaaccagaatattcaaggtttatcttccctgtttttgtcttaaatcacaactatgtgttaaataatttgtatgacctatttcagtggcagtaggttaaataaaattctgtttgtatctcctgaaaaaaaaaaaaa

SEQ ID NO: 18366 - DNA, 238 bp, Homo sapiens
cagaataccttcctgaagtgccttgcctatagcaggatagcagtcgctccctaatgacgtgaagcttgagctgaacaataggcatgtatgagtgcaaatgatattagcatgcccagattcaaggtgctactttagattgggcgctggaatgaagacaagatgaagcagattataggtgggcaaaataagacattaatgcgaacaagaaataaactggcttgctgcaaaaaaaaaaaaa

SEQ ID NO: 18367 - DNA, 968 bp, Homo sapiens
gaaagagagcgggccccgccccccccccccccccccacgcccgaagaacctacctaagatacctgctgatgagaggtatagagtgctgcgtgatggacgagagcttgaagctgacaataggctgtgtgaggggaaaggaattagaatgcgcaggataggggggagtgctttgagatgggggctgggacggagcacagcagcaccgaggaggtgggcggggcgggctaagacggtaatgcgcacaagcaccccgattggtttgatcgcacaacaaccacaaacagacctaaacaaacacaccacacgaggagtctagccgacggaacacttaaaagcagcgccgcacgctgacaccccggccctaactcaccccacccaccaaccgcgcagcggccgcccgacaacacatgccgccccctcccgaccccgccaagcaccacggccgccctcccccacccacgccccgacgccccccccgcctgagccccccccggagtgactaccagacaccgtcacgagcccccccgcaccgccaatccccctctcgccaacaacgccccgccgggcccgacacgaccgccaccaccgtaaccccccacacacatcccaccaccaccaaacccccgggatcgggccggggggccgcacttcaccctcccccctccaaccgacggcccgcccgcatccgacctccgtacacactatcccccacccacccccacggccgcccaacaccccgcggcacccgcccccccgacgaaccccaaccatcctcccgaccgcacccgcaccccacccgttgttagagacgactggaccgtgcccgcctgcccgcacacgagataccacccatatcgtcccatccgcgtgcattcccgcccagatcaagattcactaccagcgcccccacgccgcagccaccgcaccccgccctgctcgaatgtcgacctcagtcaccccgcccacgg

SEQ ID NO: 18368 - DNA, 1684 bp, Homo sapiens
  misc_feature (1)...(1684): n = A,T,C or G
accccncnnnnnnnaaannaacataaatactcatcataaatgtcgngaggtgtggtgacaccgnagagagactangtgagagggagganatatatantagatagtantatgtagtgtgtatagatgagaagcgcancgtaggaatgagtgctgcgggtaggggataanagatagtgacacantgtaagaatatgatagtacataatataagtacacnctccagacccacagagtaanacagcgggtggtgaaacgcaacgataatacanacacntagtacgtgcacacagatatgaagtacacagaaacagcacgatcataacanatatcatgtgtgccgcaagatgacgacagcaacggaagatgtaaagcctcgcgcagtcaatgctgcgtcgcgcagataccggccgtgtacgcgagcgacgtcgccacgccacaccatatattatccagctctacgtctcacctccattgtatacaccgcaccacccaataagttaaagccgacacagcgagcccgtgtgactggggntanagggtcggtccgcgcgnccgaagtgtagcgccgctcgagtgtgtgagtggccgcgcgtcctagtccagtgtgtgngttggccaccgagtctcgtgcgacgcccttctacggtgacgcgagggatacgttgtantgtggtaggtgcactgtttagtatattctcgacacgcaattttttgcacctaccacacgcaccgaccgctcggctatattcacggaacgtggcgcaagtagagtacgcggagagaaaaagaggagggaccccaccgaagaaccccgtcacacacacacggtgtgattctagttgtaattatattgttaccccatggtgaattatttgttggcccccccgcacacgccccatgcttactacgcgtgcgctgatgtgtgaccacaacgccaggctgatggaacatttcacgcgccacacccggcccctaaaaatccgcgtcgcagagatgtgtctaatgtttcgtctatgatcatatcccttcggcgcgcgtgcacacagatggagtgagtgtgcgctatcgcagtgaccatactanactatacgttattaagatatgcgttctctctatgtaccacatattacacataacgccaccccgtacagtagataggagtaggatacctgtaagtgtgtgagggtgcacgccatcacacgtggtgtcacacattatacgcccacggcatgagtgagtagtgttgtgtcgtaacgattggtgtggaaacatacgagtacgtagacagcgctctgctagttgccaacgatacataaatgtgccagacgtgtgcacacgccacctagttgtgttgttgtggccaccgagcccgcaccccccacacggttgggtgtccccagacatctcagcagcgtcacgcattgtgaagttatgttgcacgcaaaattcgaccctagttgtagtgccacacacgagatgaggataggccatgatgtatgcagccatcgcncacgtcacgccatctattcacccacaccttacgtagancggcttacgagataggaatctcagagcgactgcgcgcgaggtggtgtgcacgagacgactacattaaggtcgatcaatcaaccgtttgataacatagaatattgttgagaagtgtgcgctatcgcgagcagatccg

SEQ ID NO: 18369 - DNA, 280 bp, Homo sapiens
  misc_feature (1)...(280): n = A,T,C or G
cgggagggcccgacctggcccgccagggtaggtattttnnggncgttcgggacagacgcttgcttgttgtccagctggcctcaactcctgcattcaagcaatcctccttacctcagcctctggatctatatttaagtttctgagtagctgccagactgatttacaaagcggcattaccattttacattcttcccagcaatgtatgagggttttaatttctccacatcctggttacaatgtattatctactgttgcatcatgaggtttaaaaaaaaaaaaa

SEQ ID NO: 18370 - DNA, 787 bp, Homo sapiens
  misc_feature (1)...(787): n = A,T,C or G
tttcggtatgtgagcacccattcactgtctttggacagnactggccctgctggatgcctgctcctgccctgataaaccacccaggtgcccggagagtcttacaagaaaacacnntgccactgaaatagccatcaatgtgaaggcgctgtataatgaaacagaatctttgctagttggcagggttcctttgaaaatgccacctttggggcatcctttgctctgagaagagaagctgaaaggctgcatgaaagccatcgctctttacctaccttcgccaagaaaagctttaaaaaggtgatttaagaaatggaccagcagctaaccacgcgctggccttgagataagcaatattaaacaattgccagctcatcccacccagccagaagcttggacttaaacttggaggggcccccccttggtttccccaaaggccccaaaaaatcccccgtttttgtttggaaaaaaaaaaaaggggggtcccaaatatttttttttctcccgcgggagaaaacaccccccccccaaaagagtctttttttttcccccccccccgatgaaacaaaaagaaatgggggggtttttttaaggagggggccctcttcttttttttcggtgggctacccattttttttaaaaaaaaagagaggggcctgtcctctctaaaacattattaatcccgcgagggggggggggccccccccccccccccgggggggagagaagaggataaccatttggttttagcacgnanccgcgcctctttcttttctttttctaccactctata

SEQ ID NO: 18371 - DNA, 399 bp, Homo sapiens
  misc_feature (1)...(399): n = A,T,C or G
cggcgggcccgcaccgggtcngtnntgttnnngtnttnnccccgccttttcgaatggngatagngatccctctctgtcacccaggcanaatgcagtggcgcagtcttggctcagtgcaacctctgcctcctgggttcaacggattctcctgcctcaccctccttagtagctgggtttacagcccgtctaattttcgtattttttagtagagaggggggtttcaccatgttgaccaggctggtcttgaacccctgacctcaagtgatccacctgccctggccttccaaagtgctgggatacaggctagagccactgtgcctggcctaaatttcatactatacgcatttaccctctatttaatataatacaccaaataaaggtatagaatatcaaaaaaag

SEQ ID NO: 18372 - DNA, 1003 bp, Homo sapiens
  misc_feature (1)...(1003): n = A,T,C or G
ggcggcgcgcccggcatgtaggttggtactggngggcctttcgatantatattagacattggnctggnagcaccatctacacgtgtgtgtggctgaagaaagagaactcaaagtctgattctttcaggatcctaaggaggctctccagcatctgaaagttgagaaaacaccactaagaacgttcatggttcatgggaggaggtcaagtatcaaccttaaaaggaacttgggaagaagttgcttccaactctcatggaaggacgttcgacgactctcaagaactttggtggagcgaagttcacctgcaaataaaatcggccccctacactcaacacttcaatcagcttccaccctggtaagctgcgcaagcacatatttggcgtagcccggaccctcttccaattaaaaaaaataccacccccctcgcccgcttagcaagatcagccaccggacattcctcccaactacacctcctgcgcgaccgcagccagcgctccctacatataatcaatgaccacccgccatcctcataaaacatacangattattcccccacctcactccacccccccaatttttcgccccaccttcttttttctccccctgtctactgccacctcaccaaaacacgcatagtaagcccacctctttacatctaggagtccccaccccccctccacaccgcattgcggcggtacataacccccccacattgctgcgggagggggcgctgacattcgggcccagcatcgcgtacattaacgcgtatgttggtgcgcgttcgcgcactcagccccccacttactcgcatcgccgcccgcccaattctcgactgcgcagccctcacactaaccacaggcgagcacatctcagcttgcactttacgaagcatcggaccggtgttcaagctcgggccggtatagcgtattaaagagcagagcgacgagacacgagatctacgctcaacatgaacgcagcggtctgtgtgtcgcgaccgtcacgg

SEQ ID NO: 18373 - DNA, 867 bp, Homo sapiens
  misc_feature (1)...(867): n = A,T,C or G
tttccggtnacacttccaaagagggtaactgnagaaaatatttaatgaaagggnaattgtnatgtaagaaacatgnagcagnagtaaagggaaaaccaacaaaaaaaagaatactccctggtccccacccataggcatgaaagaataaacaaatgggactatgcaaactcacaagcttctgcatagcaaaggaagcaattaacagagtgaaaagacaacctacagaacaggagaaaatatttgcaagctagtcatctgacaggggattaatatccagaatatacaaagaactcaaacatctctacagcaaaaaacaaacaaacaaacaaacaaaaaagtaaaacacccaaacaatccaatttaaaaatggccaaatgatctgaactgatatttctcaaaagaagacatacatcaggccaaaaaatgcatttaaaaatgttcagtatcactcatcatcagggaactgcanatcaacacaacaatgtggtatcatcttaccccatttaggatggcaattatcaaaaataaaataaaataaccacagggggcttgtgccttagtcccagctactcaggaggctgaagctggaggattgctggagctcaggngctcaaggctgcagtgagccatgatcatgctactgcagtccagcctggggtgacagagcaagattctgtctcttaaaataccaataaaaaagacagaaaataacaaaggctgatgacgaggatgtggaaaaaaagaaagctcttgtacactattggtggaggattaagttggttacagccactaatggagaacatggggaagagttcctcaaaaactaccatatggacctcccctttgaacccagcaatgcaactactg

SEQ ID NO: 18374 - DNA, 1297 bp, Homo sapiens
  misc_feature (1)...(1297): n = A,T,C or G
tggcgtaggcggccccccgcgaccctnncgacaccccacgcccagnggacaacacgggctcacctatggannanggggctcgttgtacgtgtagggatacctaggaacacctgtgtgtgtncaaagaaagatnatagctactggtagactagcaccatggccnaagttgtnatcattatggtgtgtacacaatcagncttgcatncgagcgaaaaggaagtgatccgctgggggnaaacgccgttgctccccagcgatgcataagtcctgtctgcagccaaataatgattggccaaatgaagatagaagcaaggagctgcctgtggtcactcaaagcaaattgcaagcagtacacaaaagtgctgtctcgttagctcttcacaaaatgcaggcaggcacaaatgcacaaattccgcatttcctccagctccagcaggaatcccggcggaagcagcagctattgaaatcgtcgacagtgtgatgtatgcgtagttacaacaaaatgctgccgttgagatttagttagacttcctatggatgatatcgtcgcatgccaggtgatgctcaatgtcggcatcctcaacactccggacaagatgtttggagaaccatccatatgcttctgctcgctccgaggaccctaagcaaccgatcttgcccctacatgactcaactgcctggacatggcgcactgagtcgcctccccagcaggcttccgccacccttggtacgccttgcgcagcccttcccccaccagtgaaggtcgccctttatgtgccctcgctgcggagtcccaccgccggtgttacgtgtcccccctccagctcgctttagctcgcccgctttgtccgtcccccttgccccatccccccgcgccgaaggacggggggaatcgacgaaggatgggccacgcccccctccctccgcgcccacgcccacggtagtgatgttccaacacaacactctccacataatcacaaactcacagtcaacccgcagcaccgcgtggacaccccacgtcacccctcccatccanaccgagaccgtcgccgaatggcttggcgcatcccgccctccgcgcgcgctagcccagtaagctccganaacccatgttcgcaaacgcgcaagttccgcaacactgacgacaatacaaccctaggttcccccgcccacgacaatgtcgactgcagtctcaagttcgtaatggatgcacgccacagcgcgctcgacccgaagacgagaaccganatcgtgccactcacccccagattcttgcacgcgccgctccacgccccct

SEQ ID NO: 18375 - DNA, 224 bp, Homo sapiens
  misc_feature (1)...(224): n = A,T,C or G
aggagggcccgccctgccaagnagagannggaattggnccgcttttgcgaagtgnaganaacanncgttcccccctctggnaaagctgcaataaggcgccattttggaagcagagagcagccatcaccagacaactgagcctgctggcactttgttcttggacttccggccttcagaggtgtgagaaataaatttctattgttgataagttaaaaaaaaaaaaa

SEQ ID NO: 18376 - DNA, 926 bp, Homo sapiens
  misc_feature (1)...(926): n = A,T,C or G
cgccggcgggccgccctggcccgcagggttttgttttttgccgggttgtgcggagtattnctncacaaatttnataacggnatgtgtnatggccagtatnaaaatgcacctacctcggnattcaaaaactgactgcacanaacagccatgcaatgccattttgggtaatgctcatctgtaaaaaatatgtagacctttccanaagattgagggagaaggtgatatattaagaaaaagagatgaatgaaattatgaaaacccagaaagaatgacttcaggttttttataaaagcagagcactgaaggagttaaaatgatgccaccgcaaaatatgctgccattctggcatattgactattttgagttaagagtacttcgaaaaacagcaggtgcaacaagatcactttgagattccttctctttcttaacaacaggtgatgacagtcccacatgaaagatgtcctccctgtaccagaaggaaggcaatattattatgaccaaggacaggaacttgaaacccagagaattctgtgcagaccttgttagaacaatatgtatctttcttttagccttcccagataatttagtcactttttcacaacttcctactatttgcccaaatcaatatgtcagcattccaactcttaaggcatttttgggcctttattttcttaagaaggctcctgtgccatatgataccttggattaactaaaattttcatgccttttctccctcgtgaatctgaccttcccccaactttaacttgacgggcctaggaaaaaaaccccccaatcttaacacgagtcaaaacccaaaatttgtacctctacccttacaataccccaattaattattcaaaatacggccaaccgcgcatcttgaaaatcccaagacaccctttagtcttgaacgggggaagaggggg

SEQ ID NO: 18377 - DNA, 914 bp, Homo sapiens
  misc_feature (1)...(914): n = A,T,C or G
gggggggcgcccggcccgccggccagtattttnnnggttttccgggttaagaaccgctccaactccanaagaaagcctgccccgnccttgcctggctctcagnactgnaaaacccaagtctctgggctctagatccagtgctctttctacgacatcactcctgcctcccttggacttggttagagcccaatactgatgaggactccccatcacacccacctccattttaactcttcaatctctgcatggactcagcacctctgactgtggtctctgagcaacccctcaaatcttcccatgccttcccatccccagcctccaagagctccccaagggttgcaccaccctggaatctgaactctaaatccagcatgaactttacatcatagggttagaggctgtgaaacaggaagcgttcttcgaggtgacccatttcattcccatcccgagaggaagaaatggagctccactggtgcccagtgacttactcaaaggagttcctggactagaatgaaagggtttctccctccttcaaaccccaggcggaccctgacccacctccccccagctggggatcttcccgggcatctccccaaacaggtgagggacccccggcctctccaagcaaggttgttggtggggggggggcaagagcctaaattaactttgcctcgggcaaggggtttttttgtgggggtccctcccccagaaaagtgtagaacccccccgggccaggggctgggggctctgcccccctggcccttcacatcaggggggaagcccccacctggggacaccggtgggggagacaaaaaaaccccacctaaagttcctgaaggcgcccttgcttgggaaccccccgcgcggacccttatcccactgagcccccacctctcgcgcccctacactctggg

SEQ ID NO: 18378 - DNA, 937 bp, Homo sapiens
  misc_feature (1)...(937): n = A,T,C or G
cggggaggcgacagaaaattggggaagaaggaaatttgtccttttttnnnnngccttcnggtaancaaaaaccaggctctgaggncaaaataaaacaacgacatactgnataccgaacaggaatacaacgctaaacactgtcaaaagaggagggggcttcctgacaaaggcctcaccctcaagtccggatacctgcggacctaaatgagaacaggcattcctgttttcacacccaaatgctgtcttttggcctgccacaccccctatcttgcacccatataaactctgaataccaagcttttttttggagcagcaagccagcacaacagcataaaacacagaacaacacagcacagaaagggagatgaggaagaacatctgaatgcagagaatagctcagctaggagcatctggagaggagtctggccgctgggcagacccactctgagggaggatcgccttcccacttcattacccctttgcagcttctcatccatccctctgaaagccacctacaccactcaataaaacctcgcattcatccttcgagaccatgtgtgccccaatttttacaggatgctggacaatatcttgggatacacaaagctgtcacactggacttctgccctttggaaaatgcagagagtccattgagctggttaacactcaagccatctgcatgcagcaaagctgaaagagttttgtaacactgtggttgaaggcaaccacacctagacactaccaaagggccagagctcatagaactcattccaccctctgtacccatctgtctgcatgctacccgtccccgcagagggtttgagcatgcaggacgaccatactggaaaactacacgcctggtacatgtcctgcgaggtgaatatcaaggcactncccccattncaatatgaaattatatatggctaacaatacagtg

SEQ ID NO: 18379 - DNA, 812 bp, Homo sapiens
  misc_feature (1)...(812): n = A,T,C or G
ttttgcgggctacaaagccgtatgtgcttgccttgtctcactagaaatttggacttgngacttctgattaatgctggaaatgactgggggcctttgggggactgttggagaaagcataattcgtattgaaatgtgaaaaggacataagatttgggagaggccaggagttgaataatatgtcttggctctgtatccccacccaaatctcatctcaaattgtaacccccatgtgtcaagagagggagcgggggggcaggtgattgcatcatgggggcagtttcccccatgctcttgttgtaatagaattatcacacgatctggttgtttgataaatgtgggggtcttcccctttgctcttctctgtctcctgtcatcttgtgaagaggtgcctgctcccctgtcaccttcagccatgattgtaagttttctgaagcctccccagccatgcagaaccataagtcagttaaacctcctttctttataaattactcagtctcagagagcatgtttatggcagtgtgaagacaggctaatgcaatgactcacctataatccatgtaagaaattgagcaaagggtacacctgtattttaagggtaatatatggttggttcccaggggctgtgagcatggagaaataagtgacttccctaanacaaggtagaattggggtggcgcatcttaggacacaccattttttttcaccacaatcctggctatgaaggaatgtaacaccttcaaattaactggcgcgttcaatatcccaatgggggtattttctataagcctacttccagctctgaaaacatcctt

SEQ ID NO: 18380 - DNA, 827 bp, Homo sapiens
  misc_feature (1)...(827): n = A,T,C or G
gtcgggtttcactatctgtattggnagnaacctcccttcaaacctatggattgcccaagctgatcttgaattttagcctccagtgatcctcccatctcagcctcccaaagcactggaattagaggcataagctaacacacctggtctcaacctgtaaatcattaagtctacaggtgtatccagcagctccgaagagacagcgaccagtgagaatgggccataatgacgatgtcagttttgtcaaaaagaaaagggggatatgtagggaaaagaaagagagatcagactgttactgtgtctatgtagaaaaggaagacataagaaactacattttgatctgtactaagaaatttgttttgccttgagatgctgttaatccgtaactttagccccaaccctgtgctcacagaaacatgtgctgtatggaatcaaggtttaagggatctaggactgtgcaggatatgccttgttaacaatatgtttgcaggcagtatgcttggtaaaggtcattgccattctccattctcgattaaccaggggcacaatgcactgcggaaagctgtggggacctctgcccaagagagtctgggtattgtccaaggttttcccccattgagacagcctgagatgtggccctgtgggaagggaaagaactgactgacccccagcccaacacccataaagggtctgtgctgaggaggattagtaaaaagagaaagcctcttgcagttgagaaaagaggaagggctccatctcctgcatgtccctgggaaaggaagtcacagtggaaaacccgaccgacattctttttattttagaaaggagag

SEQ ID NO: 18381 - DNA, 357 bp, Homo sapiens
  misc_feature (1)...(357): n = A,T,C or G
ggggtgcgcccggccctgggcanggcggggttctcgtcttttcannngnnngtgcggggtgacactgaccctggtttagagagcaactgccatgtctgnaggaacacaagcagcactctggnaaanattacgtggtgagaaactgaagcctccagctaaaagccacatggatgagcttagaagaagattcctccaatcgcagtcaagtctttagatgactacaatcctggacaacatcttgattgtaatctcatcaaggactgtgagcctgaacatctagctaagatgctcctcaattcttgactctcccaaactgggataataaatgttggttgttttaagtcaaaaaaaaaaaaa

SEQ ID NO: 18382 - DNA, 811 bp, Homo sapiens
atggatgatcccccacttgtttcactgggtgctttccttccctgctggttttgatgctctgccacgtcctgggcctccccctacccacatggtgcctaactgaactgaatgaccttggactgaattgtaaaagagaaggggagaggaagaggaagaaaatgccaagtaatttgatttttttttttatgaccaaaccttgtcttggaattgattatcatttccatgggctacttatgctccgtactgtttgtgtagcagctggtgaaaatgaataaggcactgcactcactaaaaataaaaaaagaaccatagtatcattcttttctacacatcgccttttttctatcacgtgggcccgcctccctcgttcctcagttttatttattgttcttcttgccctttgtgtgcgcgtcgtgccctttctttttttggggctctctgttttcttctgttttctccttcattccccccttttttccccccttccttttctcctttttcttctctttcctcccccttttcttttgtcttttgtgtttagtccctccttaccccccgtggcctgtgttccatttcctcggcttcttcttccctccccgccgttcatttcctttttccctctccatccacgcccccgcacctctatccttctgctccccctccccctttccaccgttccccccctagtcccctattttgttctattgtctttccatccgcccccctctttctcctctctcccctcctctttctcctccccccttccctacttctgtttaccccctcctcccatctccctccaccccccccg

SEQ ID NO: 18383 - DNA, 120 bp, Homo sapiens
tcaggtttattctaagtattttatatttctgatactattataaatgacactctctatttcactttctgattgttcattgttaatcatataaatgaaattgactttttaaaaaaaaaaaaa

SEQ ID NO: 18384 - DNA, 711 bp, Homo sapiens
  misc_feature (1)...(711): n = A,T,C or G
ggtgccgccgcccgggccagccggccccgtctttttnnnggctgttccgatgctncngataaaaaatgccatttagaagttattcagtggnagcatctgaacctgagtggacccaaccaaccaccccaaatccatctgagatactaaagtggggtggcagcagacggcatcttccaggccaccagctgcaccactcacttcctggaaggaagagggcacagaatggggagcttgaggcctggttcagagtccggtaccagcactgaccagccatgacttggttaagtgactgaacctccctgattctgctttctcatgcataaaataaaattctaaaatattctgcttcgaggtaaattgtatttcaatgggtataaagttacgattacacaagatgaggatgttccagagagatgctggacaatgtagtatgtagagtttgaaatgaggtattgtatacttaataatgtgttaagaaggtggatttcatgcagtgttaataccataaaaaaaaaagaagggacacaaaaaatttgaagaggtgatagacgtacttattatctgcattggggagagagtaacatgagttgtatacatttgtccaaactcaccaatttagatacattattatgcgcagttctttgatatactaattatacttcaataaagtggaggaaaaaattcatgaagaataaaatattccactccaaa

SEQ ID NO: 18385 - DNA, 263 bp, Homo sapiens
  misc_feature (1)...(263): n = A,T,C or G
gggaggggccgacctgggcccgccgggctccgttttttaacagcatttttcggcttnttattcccatggagattcaaaacgaggccttgctgccaactatttgcccagctgtgcagtaattgtcttaaatgtgaactgatggaaaaaaaacaaacaatgagagactttgtcctcaaccccanacactgacaatgaaaccatccaaagcaaaaatgacattgagagtgaaaataaaacctagcccaacctgaaaaaaaaaaaaa

SEQ ID NO: 18386 - DNA, 884 bp, Homo sapiens
  misc_feature (1)...(884): n = A,T,C or G
ctttctngggnngctttgttccgtaattgtncaaaacttggnaagcaaccatgaatgccgatatccttcagcaagtgaacagataaattaactgtggtacgtcctgacaatggaatattattcagcgctaaaaagaaatgtgctatcaagccatgaaaagccatggaggaaacttaaatgcatattactaagtgatagaagccaatctgaagaggttacatactctgtattccaagtatatgacatctggaaatgacaaaactatggacaccataaaaagatcagtggttaccangggttggggattgggggatggatacctggagcacagaggatttttaaggcagtgaaactagtctatatgacactataaaaatggatacgtgtcattatacatttgtcaaagctcataggatgtacaacaacaatagcaaactctaatgtaaactgtggactttgagtgattatgatgtgtcaacataggttcatcggctgttaacaaatggacccctctgatggagctataaatatgtgacaacttgaattctgcttaatggacttcctttctttcttaattcctttctttctttctttcttttttcttttttttttttttttggttggtttcttgcatcttatgttatctctatggtaggtttagctaaatgaanaattcccaggattgtaaactgattgattaaaaattatttgaattttcctttatttcatctttatggtaactttttaaagacccagtcaaggaacatttttcatatgatgtgccgggattccatagaaatatttcatggctgcttattgcagtttagcctatgcctttaaaatgcctggcttttataaaaaagaacgttatttttcttagaaca

SEQ ID NO: 18387 - DNA, 875 bp, Homo sapiens
  misc_feature (1)...(875): n = A,T,C or G
ggggggcgcctggccggaggcttggttttttaagntgttctgagataaaaacctcttttcccangaactctanaaaaactctcncctcttctggngaattacttttgctgcaagaaaaaaaagttttctctttatctcttcatggcagacctaagtgtgagaaaaagttgctggtgatttaccacaccacagcctgagtacacccaggcacgcatccttaaaacatgcccaaagatatctctgtgaaatgtattcagtagtggattccagtattcacagccttcatttacacagttcactttatttaatttgtacttactggtaatattaagtaatcagagttcatatccttgggaaaattctcccctgaaggccaattcattcgtaataaaaaccacattttgagcagtgagtgaatccagctggttgcactagtaagccatcttcattttttatagcacatttcagcttttcaagtattgcatatttgtatgggagaaatgttttttgaagtcaagctttatgaaacatgatgtcaatgatatatgcaaacatctatttattcctctgcttgcctggaaggntttgtccagaaaacacttttgcttattagagaattgaccacaagcatggctattaacattctgggatcaaattaaacccccccccgagaaagaagaaatgcaacacttacagccctgaagccctccaccctggagaatctcccccccaaggggaaccgtggctaaaatcacaacaaattgacttaagcaccacttgataaccaggcccttggttaactttccccttttttggggccgacctctaaacttgtttttggaataacagtccttttaggctcgcgataaaaaccc

SEQ ID NO: 18388 - DNA, 911 bp, Homo sapiens
  misc_feature (1)...(911): n = A,T,C or G
cgggtggcgaccgcacctgggacagaaagagattaggttccttaaanngnngacttctggttnnctgaacaaangtanggaaacatcaatatatcacctaccatcatttcattacttgtatggatcagaagctcaagaagacaccagagaagcctatgatgacaagcaggtggtcacagagatcatggcgagatgttttattccaactctgataacaactacttcctgggaaagttttcattttattggtcatgagattcgaattactgaggccatggattgttatggtgctgttgtttggccatcggtatattttcatacagaatttgttacattccaattatttttccagccggttttattcattattatgttctatttggtagaagataacaggttccatattccttctttgtgacctcaaatagtactatgttttagaaatcatgtgactaggaaattatttctcccaattaattctgtaattctatttcttttcttttctttttttttgagacagagtcttgctctgtcacccgggctggagtgctgtggcttgatctcagctcactgcaacctctgcctcctgggtttaaatgattcccctgctgcagcctcctgagtagctgggactacaggcatgcaccaccacaccaagctaatttttgtaattttggtgggaatggggtttcagccacgttggccaggctggttttgaactncttgcctcagtaatccatccacctccacctcccaggtgctggggatacaggcataagctaccacgctgggcctcaattaatctatttctgactttattggaattgtaagaataatacaagggggtgtttactttcttcagtttttaaaataagagtttaaggcaggaaacatttttatattcccctttt

SEQ ID NO: 18389 - DNA, 897 bp, Homo sapiens
  misc_feature (1)...(897): n = A,T,C or G
cgggaccgcactggacgaagggtggtcttaaaagngtccttgtttataagcnacctggggagnagagaagacanaggtatctggtggaagaattgctaagcggcaaacattcaagagaacagacataaaatttggaaaatttgcaacttgacaatgtcatagaaaaggaaaaaaatttctggagagaaattaaagcctgctgcagaaatttgtgcccagaggtccaggagggagaaattgtttcctgtgccagaccgagggtcttcctgttttgtgcagtctcaggacatgatgccctgcatcccagctgcttcagctccagccatggctaaaaggggccaaggtacagctcaggccattgcatcagagggtataagccccaagccttggtggtttccacttggtgttgagccagtgggtgcacaaaagtcaagaattgaggtttgggaacctccaactagatttcagaggatatatggaaatgcctctatgttcaggcaaaagtttgctgcaggggtagagccctcatggagaagccctgctagggcagtgcagaagggaaactctgtacaaaccccccacacagagtccctacttgggcactgcctagtggagctatgagaagagggccacagtcttccagatcccagaatagtagatccaccaacaacttgcaccatgtgccacaaaaagccacagacactcaataccagcttgtgaaagcagccaaaggtgggggggctgtaccctgcaaaggcaccagagcagagctgnccaaagccagggagcccatctcttgcattcatgtgaactgggatgtgagacatggaataaagggagatcatttgggaacttcaaagtttatggacctgccttatggtatttgggacttccatg

SEQ ID NO: 18390 - DNA, 643 bp, Homo sapiens
gattttgcaaacagtaaggaaaatgacagtagcactatcctaagaaagtgtgattaaatgtaaacgttccaagtcctgtaaacaactgtgtttcatctctaccccctaacagcttactggaatgaaaagtaaaaccagcataaagccagagataaaagggagctgccttgaactccattcagtcctgtatcccgatctcctgcaatactctgtccttcctctaccatggaaagaagatgtgtagaagataaaagaaatgtggtgaggttattcacatctaagttttgcctctattctgtgagcctgtagcatcaaatttttattttgctcaatactgatctacatgccccctcactgaagctgcatccatgtttttttgcccttatgggaatagcccagaagccggcaggtggcttatgaagggttgagatgtgcttcggtatttttttaacgtgggctctattcactgcctgatttttttttggttatgaaccatctggaattttcaatctgttttaggattttgctttacatggtatttcggctttagcaggaactattggtcggaatttcttcctatgtgacaaacaaggggggagggtagaatttttgaaattctccccttaaatgcttataagggcca

SEQ ID NO: 18391 - DNA, 951 bp, Homo sapiens
  misc_feature (1)...(951): n = A,T,C or G
ggggcggggcccgccccggggcccgccgggnttnggttttttgnnngggtgtttcgaggacaccctgccntttaaataccaataaactgggaaaggacctntgnanaanacaaagtctgctgtccagtctcagcaaacccccaggctacagccagcaacaagtgccagccatgtcatccagatgtcttgatgtttcagccttcaatccttcaagtgaacacagttccagnaaaacagtacatgaagaagaaagactatgcagctgttctaagtcaatctgaaagtaataccataaagtgacacttcggttttcagccactaagttttgagtcatttggcatgcagcaaaaacagataatagaaatacattcaattttctaaatattcttctatttttctccatagaatatttttatagtcatgttaaataatggagggagcatgcaatacttaagcaattgttaaataatatgttttaatataaattaagacatgaaggtgaaaagaagtccagcaagtttcaatcccaagccaaaaacctgaaaacttcattatggcttatttcaaggaatctattggtacctgggaatgaatagaggctaggaaaaaattcattgaaccaaaatattttattcttgggcaaattttacccttaaaatacctaaaaactattcaacatttttcctagggaccgggccggaattgaactaataaaacctccaaatccagtttaaaaggggaaccctgaagtaattaaaattatggtgcgtggacctttttcctaaaagaatccttattagcaattctttgatccaagccttttatttgaatttcctggaggagcttcttgcccacttcttttagaggaaaggggaagaattaccccgatttgcctatttgggatttgtcccacgggtaacccctgggcattgggctttttcttccccggag

SEQ ID NO: 18392 - DNA, 911 bp, Homo sapiens
  misc_feature (1)...(911): n = A,T,C or G
gggagagcccgccctggaaagaaggagtttggtttttttaaangnngcttccgtntatataaatctnccgtttggccanganactctnanaaaanactctctacctcttcatgggnaatatacttttgctgcaagaaataaaagttttctctttatttcttcatggcagacctaagtgtgagaaaaagttgctggtgatttaccacaccacagcctgagtacacccaggcacgcatctttaaaacatgcccaaagatatctctgtgaaatgtattcagtagtggattccagtattcacagccttcatttacacagttcactttatttaatttgtacttactggtaatattaagtaatcagagttcatatccttgggaaaattctcccctgaaggccaattcattcgtaataaaaaccacattttgagcagtgagtgaatccagctggttgcactagtaagccattttcattttttatagcacgtttcagctttccaagtattgcatatttgtatgggagaaatgttttctgaagtcaagcttaatgaaacatgaagtcaatgatatatgcaaacatctatttattcctctgctgtctgggaagttttgatcaagaaaacacttctgttcattagagaattgaccagatgcagtgctattaacatttctgtgatcaaataaagctcacccagatgaaagaagaattgcaacactaacagcctggaagcactcaaccgtggagatattacccccaaagtgaagcatgctaagaatcaaaacaaaccgacttcagcacatctgatttacatggcccattgttactttcccactacttgggcagactttaaacctggctagggtaaacagtcttatgatgcttgtattagaaccttcttttatttcagngtaatt

SEQ ID NO: 18393 - DNA, 294 bp, Homo sapiens
  misc_feature (1)...(294): n = A,T,C or G
gggagggacgacctggaaagaagaaatggttcttttnngnttacttgtaaaatancnccttgaggtnccgncctaccttgctgcccctactttatattatgctccaaaatgagagtgtgggaagcgagcagaacaaacataattgcctgagatttaacttcagaaagcaaaactaagtttccaaaatatcaaaaatattttaagtgttgttgtatttgttgttatattaatacatgatttggttttattgaaataaaataataaatttttttttttggggtaaaaaaaaaaaaa

SEQ ID NO: 18394 - DNA, 887 bp, Homo sapiens
  misc_feature (1)...(887): n = A,T,C or G
ggcctttccgatnccgtgtccagatttttggngaccaaaccaggttgcagnaaggttataaattgcagnattgtgtcttccctggtacatttgtcaccanagccaaaggagcagcgaaggactgggagccccacggaggaagctgagcctagggagcggagggccttccctggttgctgcccacctacgtcccactgggatgcatgtgagaaactctggtgtgtaatcctctgagatttgagagctgtttgttacggcagttagcctattctacaaatatgtcttttgccagttgcagtataaaagcaaacagggctgttactgccttaactaatgtgcttatgacatgcagtaccataaactagaagctcatgtgtcaacttgcacttttaatgataccacgggcaacaagccggtataatcaaattggagcaattacatttctgactccctttacataatatgaaccacatggggtggagagggtatatatggaacacgagaagatgaatagattttctcaacaaactgcaccatccaagtcttatcccagatggatcggctcacaaaaccagaaacccttttctggctgggtctggccttagagaactggagaaaaccacaagagcgctctctgtggggcttttcacacccctgtgccccaagaaaacctttcttgtttcccaaaacggcgctcaacagttcccaacccccgctccattttgccttttaaaaccgcccgccctctcccgcaaaaaaccctcgatcttataggcgaataggccccgcggcattctcgaaagcgactagtagagacaccaccctcctccgccgccgctactagaagcacgcagctagactcatacctcagaatctccacccacccg

SEQ ID NO: 18395 - DNA, 924 bp, Homo sapiens
  misc_feature (1)...(924): n = A,T,C or G
agggtaacggagggctncactaatgcccttttcttgtgatttacagntatnaaaacctgncttttttttgcattgcagcaacagtcagtgttgcattttactacaaggacagccgttgttgcctgctgtgaaagacctactgcagtcatttgtcagtcaacaatgtaagtcaacacagttatgaatttagatgtggagtgaatgaagtgtcctgccttcgttagatactcaagaaatactgacggagcagatgtccttgcacataattcacaccttaagaccaaatataatgcaatgagtttttaaaataataaaactatataatcttcaaaaaaagaagaataatacgtatcctaccgtatattcacctcacccgaagcgatcttacaaattggcctcatcggcctttatgggtgggctttggggccagttccctttttcgaggggtaattagtgatccttactaacttgctaaatgaactcggttcccaacgttgacggtcaggtatatcacctacctcagagggggtttgatcggtttctcccacattcatgggttcccttttggaaaccccccttcccttatttgccctttttcgggcccctatcccccccccaggctccactactcggtactcttcttgggctccctcccccccggtacctttcgtccatcccccctcaacattacgggggatgaccctgcctggactcttcaacccccgtataatttcccgcgtgatcacacattaaagatccatacctgtacaactttgcccttttgcaagaaatcccatacatctctctactcttccagttaatcacccgtcggcacctctattttcatcatctaattaacgacgaccgcccccaagacacttaattagttgtgacctaggcgcgtcgttactcctatgagtcgcg

SEQ ID NO: 18396 - DNA, 298 bp, Homo sapiens
  misc_feature (1)...(298): n = A,T,C or G
cccgggggcgcccggacgagggaaagttttgaaagnngactcgttgaaacgctgtttgttgtccagctggcctcaactcctgcattcaagcaatcctccttacctcagcctctggatctatatttaagtttctgagtagctgccagactgatttacaaagcggcattaccattttacattcttcccagcaatgtatgagggttttaatttctccacatcctggttacaatgtattatctactgtagcatcatgaggtttaaaaaaaaaaaagaaggagagaaaagaaaaaaaaaaaaa

SEQ ID NO: 18397 - DNA, 450 bp, Homo sapiens
  misc_feature (1)...(450): n = A,T,C or G
cttccctactcatatgaatggagaaagtaaaactaaaatacctacatttcatccagatgaggagaaaggagtgtattcctagcacaagcagactttatagatattattgttattgacaaagtacagtgcatagagaagggattggccatggttctgctactaagattggtcacgttatctgttcaagggaagacagaagttttaccaaacttttctggcacaacagcggcataaaacaaaaggtgtgcttgataacttcaaaatattctctggactatataaaaaaatttgatgcagtcataaatctttttgtaacatttagaagttatgaatttcccctncttagcacatgtaatggatcaatatttctaaagcatattcctaacaaccaaatgtttcctaggaattaaaatatagacatataccctacattctaaaaattgactataa

SEQ ID NO: 18398 - DNA, 1521 bp, Homo sapiens
  misc_feature (1)...(1521): n = A,T,C or G
acaattgtttatatttagttataattaaacaatctatatagattatannttctntatattaatttattatatttattaacgataattnattnantatttttttatcataacactccatatctatacacactctccgantcctnttcttatatatatctataatcttctgtttatcttctttatttttcatttcaccattcctatttcttatttcattttttacttattatatnttcatctttatataatccctattttctatattattttatccccttttccttcttgtttctctcttctacgctcacaggctcctgccagcacatacgtgcgcactaccaccatgttattccaatgcgtatntaactcatcgcaatcagcctcaccactcgatccgcactcacaacgcatgacccccagcctgcgttacggcgacgcgcaacacgtttcgctcacttcctcgtgttgtatacagaccaccgacgcaccccgtcgaagtgactcctcgtcgcacggcncatcgtatcagcgtgcgacgctatcactacactcagcgactaactaactcgtgatgtcccctccaatatcatgatctcaagcaactgcacgagtcaccgcctccatccgtccgtctcaatactgcacaatgtccctacgcacgccttttacccgcgcgatcaccgnaggtcagcatatcnccgcgacttagtccgntcacgcgtccatggtctcactgacatctcaccatcaaacatgatgttgtacgtgataccagcaactgccgtgccctactccaccgctatcactatccaactcgtatatctgtccacattactagttgtccttaccaattatatgtgttattgtttgcacgtaacaactcacggttcatctccgctacgacgagcgcatcgtcgatcatgccgcgatgcctaatcactatccgacatatgtatactttatcgcctccaatcacctatctgctgtttcgctgacgatcatctcttcgcgcctccccacgcaccccattacgcatctacgacacccaacctactgccgccgtgacatacacggacgaactccacatattggatggacgtctctcgatatccgcacacatcatattcccgttgatgctctattatggatgcgcgtccccatagcgccatccgtatcccctgtctcacgctcacgcgtatgggctagtgtaggatacatatatcatataacataataattcaactattccactatacgtatcatactactcaatgcttcagcacctaaatccacacgccataccgtcccctatcatgtccnaccgctaatcgacaatcgtcatatattatgcaacgtatatccacatcgtatacaagctcacacaccgcgcgaccatgcttgcgcgcaccacatatgattttcccgcgatatgattgcaccacatccccgtcttatacgcctcgcgtcattacggctacatatacatatatcgggccgacctttacactatagccactttct

SEQ ID NO: 18399 - DNA, 796 bp, Homo sapiens
ccgggggtagtagagcggtgcgagcaagggacaaccatgctacttctggctccacggaagcggaaccagtggctgaatacaacagggggaaccgacagcatctgaggctacagcgaagacacaggattggcttccgctacccagcagaggggaccgctggccacattcgagaactccacaccggcgactgaaaggaatagaacactatagaaaacaaaaataataattattttgatgtgctaccatcccccccccgctccgaaccacaccgtgcctccacgctatatatcaacacaaacacaaagaaagggccaccacccctcatctacataagcgcactccccagacaaccgccgagcacccacccccccagcgaccaccccccgcagaccccgcccacccgcccaccacagctggccgcacccaaacccacacgcccccgagcggcacccccgccgcccccaagccaccaacgcgttcactcacaccaatcgctacacgcggcgaggccaccatcgcaacagaccccatccgccccacccgtcacacacgaccaacacacacacacgagcaaacaaccaccacatcgcgccacacccaccacacacgccccgccggctcgcacaaaccgcctccgcaacaccaccaacccgccccaccccatccaacccacccaccccccccgctcccccacactcatccacagcgtcgcgccacactccaccctccccgaccccccaccacgcgcacaaggcggatgatgccggcacgaccggcgagaccggtcccccccccg

SEQ ID NO: 18400 - DNA, 1317 bp, Homo sapiens
  misc_feature (1)...(1317): n = A,T,C or G
agtatggagggataggaggagaggagggaaattaatatgaatatagaagaataaagtagaatataagaataaaaattgagagttaaggagggtagcacagaaaagataagcagagaggaaaagatattgtagcaagctcgggtttgtgttgtcatgggggaggggagcggagagggggaggggcgaaggaggaaatgagaacaagacaatatcacattaacataataccgaaatcatgcggacggcggagcgcgtgccgagccacagcgcgggaaagtgagaaatcccatatctcccataatacggcatcacaagaacctccggaactcacacatgtatcagcgccccgaaacccccaccaacccgcccgcttcggtttgtacgtctgcgtggagtgccgcgccggccgaggactgcgccgttccgcctgtcgtccacaccagccgcgccctcgaccaccaatgccatcggagccgggaggggcccgtcactcggcaccactcatgtcgggatcgagcgtgaagtatgccgggtatccactccaatgcatcacgcccttaggcttgcagcgcccaggagcacggggcggaggcgcatggctgaatgccagaagcacgacggcgagagccacccccaaaggacgcgcgctgaatacgcccagacgtctgactatgcgaggcgtgcgacggggggggtacaacaatcgacaccgcaaacgcgcatatccatcaagcactgcaatccgccgtcgcactcgagaggctgtaggagcgccgccccgccggacagcgtgcgcgcgggcgcacggccgcaccccagacggggcgcacgggtgcggctctcgaaccgctccagcggcgagaggtagagccaacaggacgccggatctattgagacacacacgtatactcacagtagataatggcctcataaacccgaaactcccaatcaccgcccgaacccactacctcgccacattcacgggcccgcgttcgccacgctgcagcggtgagcgcctgcgtcagggccgcaacacaccgaccgaacacgttctacgagtccgcgcagctgctagagaagcgcgcagagaacggtccgttgtcgcgcgcagcgagcggcgccggatcgactgagcgttgcgggggactcagacgacgataatatgaggagctgaggtgggttcccacacaccgtcacaataaccgaccatagcgcgccgacgtcacgcgcactcttcggcaccactcgtaatatcacacgaccgacgaaacactgacacataagcgcatgcancagcgcacaagacacacgatgccg

SEQ ID NO: 18401 - DNA, 824 bp, Homo sapiens
  misc_feature (1)...(824): n = A,T,C or G
caggctggaaaaccctctgccagaacttctgttgaagcttaaggngactattaaaaagattattctaaaacatctatagttgcaagactgtagaaggaactgaagaggaaagagtggtagcagaacctgctgatgtcctgggcacatggctttcaggctttaccatctcagggcatgccagcccaactgccacctgctaccaacggaatgaagaagtgcctgagaaccttctctggctgaaggctactgtgacagctttgatagatctaaagtactgggatcaacacgcgctgagagcaggcttcaacccatgaccgaaagcagcgaggctggtataggagccccacgtgaccaagagcggatgaactaaaacgaacacaatggatatgatgggataactaacagactgggtgacttaacttactgattaaactatactgaacctactgaagagctcctgggatggccccccaagaccacctccccccttccctgccccttgaatgcacgtgactcatccacacgcacgccatcatacaacaaaacgcccacaacacatgacccgcccccgtcgcatccccagactcccacggattcttccttaaaatgagctccacacctcataccccctcccccgtccacgtcacccatcccttccccccgaaccgcaccccaccccacccaccccttccccgccccccgccagcacccacgtccgaccccccaaaaactctccacgcccggccgcgtacagcatccaactcaccccgcacctcctgaccgctggaatacgttctccccacaagggagcctgcgccgccccg

SEQ ID NO: 18402 - DNA, 1177 bp, Homo sapiens
  misc_feature (1)...(1177): n = A,T,C or G
ataattttnctataaattataaataaattattatttttagannanaaaaanaataatataataaaaataaatataattataaatcagaaaacccaaataacacaaccccaatattatntacnataaatatattcttttaaattatatactttatcattcattttttttaaatttatttcatatttttttatttttctttattactctccttctcacaaacaaacaaataataacaacgatttattattattatactttctcatttataagtttaaaaaacaacttatacccgacacacccaacaacgcacgttcgcagcctcgcccgcttgtttacttgtatagttagtattcttatagtatcttaaatgaaaatggagcccgacatctcagccgcatcaaacctcgaagcaaacaaccaattcctatcaataatcattacctcatttccactaatcgcactgacttatcccccaatcaacaagcaatattaatacccatatgaccatcaacaccaatccacgaaaaaatcaagttaatactatgtcaataacatatcgtagagcaaatagtcacacgtatgtatcgccatcagtacatctctgagagtacattgtaaaaaaataaaacaaggctcatacgtatagtcgtacgtgctcagctgttgtcgcgaaagatgtgtccatcatgcccatcgcagaactgttgaatgggcgttataatacgtagcccgaacgtgtacctttgcattagttcaccgtcagcgccgaggatcatacggaagaggccaggtacggcgaaataatacgacgtagagtgcacaatgaaagtcgaggcgaccagaaggtgaatgatggagagaccgagtagtcgtaaaaatacctattgacagttggcacgagtcagcgctggagtatccaagcgataggcatatagcgcgctagtcactcaagtggcgagcggtagtgtgagtgcatgcgtagcggtgtacagcagagtagaacactgcagattagtccacagatccctgtagttccgcaatagggaaagcgaacgatagtctccacagacttaaggtcgaagctgcagtacgacgaggactnatttgtaacccagtcataacaagctaccaaatgcaatgaaacaatgaggacggtatcgtgttagaacatgaatac

SEQ ID NO: 18403 - DNA, 1183 bp, Homo sapiens
  misc_feature (1)...(1183): n = A,T,C or G
ccaacccaaaccttgggctacccaacccctcccccatcccctccgtcgtcctcgcctcccctccacagcaaccaagtatcctggatacctatgttacaggtacaataagcacttgtaatcacaagggtactgagaaaggtaacagacacatttatatatgtggaaccaggaatctttctgatgactttcagaagggtggacatacaaataaaaatcatccttcttcttggtgaggatttgaccctggatacatattaacccaagaagctgtataagcacagaacgctgcgagtaacagatttattatagcagaatgataacgaactggtgacttaatacacattgaaatgtactatgacgtgaagcaggaagagaaatgatattgactctaatctgcaaccacatagattaagcaaacctactgagctagacattgaacatgcatcagcacgcgcgctgtcgctgaccagagataattccccacccccgcctggcctctacacgtcgcaactacactataaacagaaacacaacatacaataacaacataacgctatacaatgcaggaccacctccccacctcacatactacaggtaaacgtaaaggtcgacnctacccaccactactccatccagtcactctactctaacatactcctacctgcantctctcccaccctcacgcccgacccacacccaccctaccacaccccccacctccctaccgccctcccagcattcattccgccgactccgtcccgacccacaccagacagcaaccatcgcccttacctccacaaccaactcacccacgacctccgacacatgacttgtatcctaacaatcnatacttcgttccgttctcctcgcaaccacgcatgtcgaccaagcccgactacctcgtacacagctcccacatgtcactcctccatacacgtcatgctacttgctcacaatatctatcactccttaacgtcgcgttcttgatccgcactctctacgactagtgtatctgacctanaccacgtgatcaattgcgaatcatcttatctgatcattgataatgtagttcttagacacggcgcgctgtctctatgattccctcagttccacacacactacacgataccgtctcctcattcacagacgacctacaccacacttgatgtgcacgcatccaccg

SEQ ID NO: 18404 - DNA, 1251 bp, Homo sapiens
  misc_feature (1)...(1251): n = A,T,C or G
attttaagacttggaacatggcgagaagcagaagacagaaaccnctttacagacttgctgtggccaagagaagaaagagctcctctccagcccatgactaaggaaggggtgatggggggccagaccttaggcaatcacgcaggcatacaaacgagtagctgcaatgcgcacacagtcgagaggagaccgaagacatgacaaggggctatcgtgctgcgcgaccctcccgctctcatcatagatcctcagcaactgaggagccatcatgcgccatcccggaatccaccacgcaacaccggacaaaccccccaatccaccagaaggctagacgngggaacgcgccgcgcggaccccgcacgacccacacgcccggccgtaatcgactcccgcatgtacagaaggcggcacgcaggccgagccggccgccgccgccgcggggtgagagacgagcaggacacaacgccctcctcggtctcgagcaggtaggagcatacgcagcggcaggcagtcccgcggatcaccacgcgccgagacctccagccccgcggttccgggccaagcagccgcacgaggaagtcggcgcgcccagacgcaagagctcacctccgacagcatgcgaagccgagacagcaacgcgagagaacangtacggaccgccaggcgtccgccagcgacaccagggcatccccgccgagaagcagcagagcccgccagcaccccaccaactaccagcccacacaacaccaccaggccgcggcaaccgcgcctacccaccccacgtgacgatnaaggcgctcagtacgcaagagcgaacgagagccggcctcaccataccaactaccatcacccgccacgcaaccacggtcatcactagtagacaactacgccgaacggcagtgcacgccgaatgagcggatcacgcaggatcnactaccccgcacccaagantgccaaagcgacgcagaacgagagaacggagccgactagacagcgttgcgcccactacaccccaccgngcccaacgcgtatgttacgcacgcctgcaccgatgacccgacacaccgcgcacgcgtcagcgaccggtcggtgcacacacgcacagacgnagcgtgcctctcagcgacctaacgatctacaaccgcaaccaggtccgaacccacgcggnaatatngccgcccacgcgacacgacacaataacggcatacgcatacacagtcaggccgggcgnccgcagcgtacagaacgcgccgg

SEQ ID NO: 18405 - DNA, 312 bp, Homo sapiens
gctgtggtaagtcatgagtggctcctctccagttattactaagaatttctcatttgggcagacctttggatatttgctggataaatcgactagtctctgttagtcatgagtgttacccctgtatttcagtcctatcttgttcttcagttctaatattatcatgagctcctcactgtggtgtattatcccattctgaatctgcatgaagtctgaatttttcctaacagatctatgactgtaagctggtgattcaaataatgctgtcataatccaataaatgtaaatgacatccttcccacaaaaaaaaaaaaa

SEQ ID NO: 18406 - DNA, 1779 bp, Homo sapiens
  misc_feature (1)...(1779): n = A,T,C or G
tttattttttatttttgtnnntnantnnnttntttttatttaatantntaattttatttnttaatatttattattattatttatttatttatatatatttatttttagtattaattaaaatnnaataaataaaataatatnataatatattaaatatgtaattttnatatatatttaaatacaataaaaccctttatcacagtcgtcatcctataatttaaagtgttttattcttattattttatatactatattttattattccatatccacttattatatcttccattttttttattttatttttcttttttataattgtcatatttaatccttaccatattaaactattatatctcatccaagacctacgatagagagtggatagtaggaaagtcggtcacgtgccgcgaaaataggtaanccgtgtagtgtgcgtgccgtgaagcaaccggcaggcgccgcccaacggtcgtgtgacgctgcgggtactgacagttcactggtatgatccgcgtggcagctagcgacacgcgaggcaacgaccccgagagaacgcagtngagtagcatggacgcagcgcagcacgcgtgggactacgagacgacaagccatccactcactcgtccagacgcatgcattcgatgaccccatgcccagagggccgcagaacacaggcaggtgatgcgtcgcagagagcgtgcaggtgctgagcgcaagagatgactctcaatgacgatgaaacaggacgcagccgacggagtggcgacacgcgcgggacgaagtgcgtgagcgatgagccgtcgaagggagcatgacggtccgcgagcgtgcgcgtgagtggcattagcggcgtagagccagccggagcggtgcgcaacgtcacgtgcgatcaggtagcataggcttgttcagcgtccgatcatgtacgaacgtagaactcagacgaggatcgcgtcgcagtggcttgcgcgcantggtctctcagagcagcgtgcggatncggcgcgccgtgcgggagcggtgtacagccggcntcgtgtcggagcagtgtcaggtcagcacacaagagtatgtcagtgacgcgaggtntctatgcgcgcgtgcgatgaggctgattaggcgacgcggacgtagngtgtgatancgtgtcagagagaatagaagtatgntgcactggagagtctgcgcanacgattatctcccgagagcagagtggacgcggtatatagcgtctacagagagaaggaagcacgggtatgngcacgatgtcgaccgcgcgagacgcgcgcagcgcgnggcagagtcgacataaacgctgaacgcgcncacacgtcgcgcacgcgttangcgcgactgaggcgagagnntcgtgtncagtncacctactanacgtactacgcgtcgtgctcaacgtgagccgatcgattgtgacgtcacatcgtaacaattggtgatcgnctgngcntcnacgnatcatcagtcgcgcacgcgagagagaacncgncagggcgtccgacncgtcgtcgtacgcacatcanaccggacgncgtagagcncgactagagacggcgaacgtgtgcngaagcgagcgacgactgcacaccgtngatcacncgacgcgtagagcagcgncagtctgcgtgcagggngcgtctatctgaccgcgcgnacgacgtcatcantgtgagcgaggcatacagtcagntcacgcgcgtancgcnnacgacgagggcagcatntataccagcnccgacagatgaaganacgtctcgaagg

SEQ ID NO: 18407 - DNA, 833 bp, Homo sapiens
agatgtttggagttcagtggtcaagggaaaccccgatgactgcacttctgtgaattttgaagtcttcatcagtatatccatgtaaaaaggagagacaaaaaccaaaataaaataattatgggctgacaggacaactggattaaaataagcatgagtttgagcaaaaagggctaacttgaagcataaatcttttgaagataaattttgacaccaattctttagaggatctaaagtgaccttggtggacaatgaaagaaatggcaaggatgggattgctgggaataagaatgtattggctttgaatggtgtgatggctgatggtgcgtgcgcgcggggggaggagggcgcgtttttgtgctggggggaagcaaagaagcgaagcaaggcgacggagcaggggagcgagcgtctcagtctacgctgtccgcctcctagctttccacaacctctatactaagaccccaccaacagtaacctataagtcggattcaccccaacccacctcctctcgcggcccccccatctgcgccttccgcccaacccaccccatctcccctcccctcctccccctcccaacctagcccagcacccctctctccctcactatccccgcagccaacccgaccacactgcaattaccacgcccccccccccagcctcctctctcccccctccatccgcctcaatcttccccccacgtccccctcctgcctccgccctttaacgtaacctcaccaccgtgtttttcactacgcactaattcacacgtccacccagaacggctacaacagtccataacaacccatcccccttcccctcccaccaccaccaca

SEQ ID NO: 18408 - DNA, 157 bp, Homo sapiens
cagtctcaacgacggcacattccctttcaagcttactggtgacaaacttctcctgaacaacagaattccttcctttcatccttttctgcagttacctgcatgatgactagtcaatcaataaattagaaaaggattttcaactgtaaaaaaaaaaaaa

SEQ ID NO: 18409 - DNA, 1299 bp, Homo sapiens
  misc_feature (1)...(1299): n = A,T,C or G
aatctgatcgtactaggtgtatatatatcaccncaccaccccaccctcctccctcacctcgtcctttccccgaggtttnttncagagccaagtcnaccaantatctgcctcttttgtaaaactcatgttgacagctctgggaagcagcaaaggtggtaacactttggatatacggccggactggaacccctgaaacttaatactgagagaactactatactgagcagcagcactgaaatgctaaggtataactcgtttagctcatccatacaaaaggtcagttcgaagttcagattcacaaaatcgacgtgtgataaaacaaaaagaaaagaatgcgctctgtgtatcggaacataaaacagaatgagtaaactgatgacaggaacagcatataccgttataaagagagaggatataaagtggagtagatacactgcaactgaacatagaactgcaagatgaatctacagaaacaatcaattacctagaagagacaagaccgacacatacaatactacgactgcaacgtggtacgtgggacatgcgtgtaccatcgcatctacgaagcggtctgttgcacgccgcccgcccggtagttctagcagcttcccgaagcctctactatactctctcgctatcgtccctaatcaccactctgctattagtacactgatacgaactccgtatactactccacgtactcactctctagcccccactcatcctcaattaattctcaacccaatagcgaaccaccccctatctccgcacctcggttctcctgtgacataaacaccaaaatcccgctatctatcactatacgctgttcancactcccctctttttccctttcccccatcctcccaaccctaccctgatacactcacgcctctctgcctatcgcctttccctctctcaatcccacctattgcattccacccctttaacccatactcacgcccatgatgtcatcccggtccctccttcccgacctatcacaccttcctctcccccatcactcccgtccacatacccttacccattccccgttatcaatatcctcgatcacccgtatttacctgctcaccaatcgcctccgtatatctcacatctcactcctatcccctagatatgttctccacaaccatnaactactcgctctccccattattcgcttccattatcccaccctttaaaacttcacaaaccatccttcccgctagtaccacctgccactccacntacaatatctgtccatttacctctcgcccattacccaacacaccccctatactcaat

SEQ ID NO: 18410 - DNA, 923 bp, Homo sapiens
  misc_feature (1)...(923): n = A,T,C or G
ccaatcacttgtncaactggtataccgtctttancatctacgtgtatggagcattccccgtgcagctggtctctgctgactagtcgacatcctactgatcatctccagcatcctggggtccgtttggctggcctacaagtcccccaagctgctacacacagcacgcgggcgtaggatcaagaagtgtgcgacacagctgtgtaggagatgcaagacggactgtcagatcagggccttaaacacagacagggcaggctcaaagcccccgggtacgccaccgaactcctcacggaggcaggtactgaccactgaggacggatcacaggaacccaaccgcttggcttggaatggggggtggtgttgcgtggtgggggagaaggagcggtggaataatatgaactaaatgaagaaactatgaaaacatttaccttaaaggaggaatgaaaggtggagctaaatagctggcaaggtgaactgagacgaaaaattgataataacaacatccttttcctctccggctatcgtggactttacaacggggttgtttggtagcggtgtttgtagctttctttttattgcccatctctatttattccatataccccgcgccatccatgccttcctctccttgccttttcttccccccttgcctttcccacgcagtgttcacgccttttgcccgcctatctcatctgcgccagccgcttcataacttgtgattgccactccacacctcttgcccgttgttacccgcgattgttctttatacccctcctcccttcccgttacattctcccttcccttccttcctcccgcgctattccctcgattcccacccatttattccaatcgaccgtccgaagatccctggtcgcgcgtacatctctccaatcctcccacatttcacctccctctttcctatt

SEQ ID NO: 18411 - DNA, 191 bp, Homo sapiens
  misc_feature (1)...(191): n = A,T,C or G
cggctattacttgtagtcatcatncctgaaacctgcagttgacaaccatcttcttctctactgatacagtgaaggaagcatctctccacatcatgcctacaactgtctctttcttcctacattgcccttcttaatgaatgctatcacatactttccatcaatgaagagcaaaatcaccaaaaaaaaaaaaa

SEQ ID NO: 18412 - DNA, 861 bp, Homo sapiens
cgaatatctatctttggagaagaggaaaggagaggaagatgccttgtgaccagaaatctttgctttttaaaaccaccaatgacctggtctaattatctctgcaaaaaactcatctgtgatgacatggggcgaaaccacagtgcaattttcaagaaaacattttatgcaaatatatctgctccaactgcatataaattaagataggagtaaattagatcctaaaagaataaatgcaatttaatatgtgctggtctccgtgaactgaatgaagaaacattacaaacaatgccctttagcgaggcctaataggtaaaactggagtcactgcctcgatagactcacacgtatcgaatgccgcaaacggtgtaagacactggggtgttgtactcgcatctatctcgttcccgtcgcctgcagaccctggtaatccgtccacgcccgatactatactattatcgaaccttacaacatccattctcaccctccatccctacactaaatcaatgcgtgaaatcaagggatcgtccagatctaatattccccttcctttttactccattcatccctccccatcctaccgtcctatcattcccttttcttcccccttatctgtcgcttcaatacgtccctgagctccctccgcctatgcgtagttctccacacataccactcctcagcttacccagtccatatctcataccgttattcgcccacacatagaacagacgcccccctccttccaaatattcaaccatcttttctccgcccccttttccctccttccaccgatataatcaatcctccccaagaccccctccctccaaattcctccttctccccatttccaaaaccctatctcat

SEQ ID NO: 18413 - DNA, 900 bp, Homo sapiens
  misc_feature (1)...(900): n = A,T,C or G
ccaggctcagtaccaaacattggcttatccttgaagtcttgcaaactgctgacttttagagtgaaacttacaccaccagctctcctggttctcaggcctcctgactcagattggaactacacattggctctctctggccactgcttcagcactgactgtacatnctgggactgctgagnctacgnattcaaagtggcctacacatctgtgaacttaacganctgagaatagtatagctaccaactatggagtatcaacgcaaagtagaacgagccatgattaacgcaaccactaaaggagacgtaagttatcattacgaaatcccgtagatatcacgctcggtggaggcataaagcatgatcaacttattatatcccctcacagatcacgaccactcccggcatgtatcccaacagatctaaacaacaccgccttacggccacgcacacactatccgggacaacgacaaaagcagctccattccctcataacaccatccggttccctaggtctatccgggacaaacaagagttcaccccaacaaaaaaacctcgcacagccttttacttgtcccgccatatttcacacaaataagcccaccgcctccgatccatcctcggcatcctctatgttccccctaatttatccacccagacttaccggcccacacccccaaacggcgcagacccacccccatcacatcatattaattgcggatcaaccacatccccatttatcccccccagattaacattgcccgctcgtataacccaataaaccgcacaaacttttccccccgccgatatccgccaatgccacccgttaatcgcaacaccacgcgggaagcgctgcgcccgaagtagtaaccaaccgtccgaatgtcaccacccactatccaat

SEQ ID NO: 18414 - DNA, 2279 bp, Homo sapiens
  misc_feature (1)...(2279): n = A,T,C or G
gttggggttnnnnngnngnnnngnngggnngggggggnnngnnngnngncnnnnnanngncgnnnggngngcnncngncgnnnnnggnnngcangccgngngcgnnngnggagcngncgcgcggtaggaggganggcgtgcgacgcngagcgnngaggtacgacacggtaggaccatcgnggtaccgcgagagtnagacagcgngagcgntgagtcaangcngnccanccgcacgtacgcgagcncgacangtgnactggtntggggngtgttcgttgtcngtgtntcgccgncccgttgaatattgcgttngtcaagatagtagcgacngcgcatacacgctctgacgncacgtaccgcgcgattgtataattcgcgcagcgccacagacagtgcatgtcgcatgtgtcacgatgtncgtcacgtcagctcacagatgacacgagcgctgcgcctcanagnagcagccacagcactnatcagtcactgagnagagtttcagcgtcattatgacgccctcctcgtngtcgccnatacgncagtacnntctcttnccgacttgcgattcacattcnagnatgcnntagaagtcngcgcgctgnctgtatatatngtgnctgcgatatgacgtgtattatcaacacacatcgntgtgactgtntcgatgagtcgacttangactgctatctatgatgatatnatctttatcgtgttctatctctgtacttcgcctggtttgtcgtgtttntatgaactctctagtatgcagtagatgctatatgctcntatatntgaccactattcctgtctgttagatctgcgatactatctctacgtagacgtgtatgatatcagctctnttcgatcacctctctctcacgacgtnntcttnttctatgtntatataatctcgtnatatntctctagtctcactggagtatcgttagcgatgtatgcatatactccatnantgtgtacgctccatactcatctcagctgttagctagagagtcgnacgntctaaatgcgcagtctatactgctcagctcctatanctatcgtcctctgatagantattcatttactgacatccacgattcgagtttcatcatgatacatgtcatgtcacgcatactagcttttctacgcatgtgatgatcttattcagtagtgattcagatgtacactgataccntatgcgnttactacatattgtcgntgctctcacttatgacctactgcgattataaccatgtatcgtctctttcgatcttatcgtacgatgcgtcatcagtgactctctnctttccgatttactggcgtctataccatatgtatcacacctcgtcagtgtncatctgncgacaatatgtctctgtgatcgatccgatanacacacattgtgtncttancgctacacgtactagatcatagctacggtacncacnctacattctanttntcatgntcgcctatcnatatattacgctatgtatccatacgccgtgccgtgaagantcttatttnacatctatcatatcccntctcttgantgantcgtctctagtctcattaccgacgnattcgcgtttagtatcacactatagatctcttaatgcattaccagtgctgcantcnatatacttctactnattctgtatgcgctanataccactctgctgtaatcattctctgtncgatgatattattcacttccgatcgctcatcanctcatgcacagactacacatgtatnctcatcccatgtacacangtatgctcgctctcgtatactctctctcntgtnttcgctattctatcattctataagatcagctcatatctcgcattgatctcatatactatcttgttacntgtattatctcatgtcgnatatgtagcgtgtagtgacgtanctntatctatcactactctcacgatcgtcgagtctgcagtctgacgctaacgcggtgtcacgactcatgtgagacataatgagtagaactatctctgtagaccgacgtacgataaactatatgatgacatatcatatgcgntggacgttntcangaagtactcatagtaatcgctactcgatgtgatcgatcaagtacattttccantcgaccattcacgcgtcggtctcgtgcctcgtcgagccatacgagagtgacacatattgatcagcatcgntaatagggattaaanaagaagcganataagtcttatagccatcgaataatcatacatgtagttgcaaattctactatacgcanacat

SEQ ID NO: 18415 - DNA, 1834 bp, Homo sapiens
  misc_feature (1)...(1834): n = A,T,C or G
gggggcggggnggccgggnggggggaaggngagngcgnnctantaacanatancagtannacaancacanacnacancagcagacggagcgccgacgagcanacagcatacagcagagtgcagagagagctgtgtagcagtgcagcgacagaggatnggatagacgagtgtacnatcagcagatcgataacngtgacgcagagtgacgcgagcagcgatactgcacatagatcacgnacataccatcgntagatcatatcgcaanaccnnacagtcanancgcagacggncgatnatccatcagatacacagcaatcacgaacagtgcgagagnacgacagcgtgacgagcgactgcgncgcgtcgagcgcgatcgacagatcggcgcagtctatatacaccgcatcgncgacaggaggcgctacggcgagcatcacacganctantgcatacgcctcgacataanacgcgntaatcatatctcacgttcattcatatacatcagactcaaggtgatgcactgtgtggagagagagtgcggtcgtagtgtatgagcgtgagtacgacctggtcagctgctctgtgacgttgagagacatcacctagtgacacacactacgttctagaacattcatacatctagcncancacctcatcgccaatctgatgcagttcgctatatcttcgcntatgtnacgccgatttgcntgactatggcacgtcctcgtctgcccgatctgtgcggcactagatcaggcacatcgcggcgagtgtcagtctcacagttcatcagatatgactacgtagatctcgtgtcgagtcgtaagctatgttcaagtggtggtcgtgtgtctgntcagtgaaacgattcgcgtcgtgccacgagtgtcgaggtaattgcacatcatagtcgtatacgatcagaaggcccggcctagatcgcaagacatgtcagaggcacgtagacgatgnagtntcataagtgtgagcggcgcggatgcagagnatgttacgcatagtctagttaatggcgntgtcgcgacattacgagcgtcgtgcnggtgcacaaacattaggccgagagagaggagcgacgcggttggtgtgtgaggtgagttagngatgtcagtgactacgtacgtagtcattatagatagcacactcacgatagatgttgcaagcataccaacagaancagattccgatatagtctagacggcgatgttctcgtctgttctgtantctagcgtcgttgcatatagatacantgtnatcataganctatcgttagtagcatctatctatcgatngtggcctacatgtatcatantaantggttatctcactactgtatatagtcgtgagagcgtaagacttgcgatcagagatcatcngttgatacganttngaagtncagctgcatctgatcatttgntnatcatnatctatactagcacgctagtatctctcatatgtgatggtagaccatctagtgtgtacgnagattgcatangtcagatcatgagatactgagtgagtnagtacgtgtatagtcatgtagtcnatatcgtatgcagtnagagcanaagtatgttgcgagctgcaancgagtagacgacagcagacacaatgcgntgancagaatcgttcagcatctggatcgtgcgcagctgtantatantgcanngcactgtcttgcgaagtcagatctcgaccgngncgtgttcgtanctgcatacgaccncagcgagcgtgtgacttctgcatcacatgngccagtngtacctcctganacntgntgtangcnatcgnatcaatctgtagtcgtcgcata

SEQ ID NO: 18416 - DNA, 149 bp, Homo sapiens
gcagtaaaagcacaggaaaaccgagtagtttttttcactctgcacactattgactctatattttctgaagcaaaaagcgatgttagttagcaagcgaaacagaaaaacattaaaaagttcattccttataacaaagaaaaaaaaaaaaa

SEQ ID NO: 18417 - DNA, 1936 bp, Homo sapiens
  misc_feature (1)...(1936): n = A,T,C or G
gtgagtagtacggcagcgnattgcgattanttattagnttgttgntgttgcgtttagcgagacgtgggcgagantnacgagattcggntcgagttaggttgttagtaggntgntagtggngaaattccgcgcgatgagacctagagtngagatgagtagngcagnttgtcagtacgatgangagggcgtgttgcagtttgttggcngctttgtcgagncgagcagacgagcaganatgagagagcagcagagatgagatcagtatagtagacagtatatcagcatagcatgatagcagcactncagatnatgatgcatcgatgagagtagctnacagcatgagcatagagcgtcagtacngtatatcagcagctgttctntgtagtagctnattagcatgagatctgatgagcagatctgctgcgcnagagctnctngctngcgntggntctctgctgggnctgctntgcgctgactcggcgactggagangcctgttcatgtnatagcagcncgtgncactgactaactcngngtngatcatacgacngtttcgtctagcacagntntaagttagacgactngtgatgatgtgtngtcgtcacgtcgagcacgaagacgacgtngcaagagacatacgctcanatgntatgctagtaacggacgagtatgtgatgagtcactgagcacgatgatgatatantgagtatgagtacagtanacgagatggagtatctacgagacatagatggagtatgatagngngtacggangaagntccncntacacgtatgagcgantcatgtntgattgagctgtnatcntaaggangatgtactacagatgatcgatctcnagcgtgatnacgtgagcatcgtacgctcatatgcgctgctagtncgtcatgctcgatgcgtncacactcgatagcagtttgactcatcgtactgctgtttncgcacgtaaaccatgatgctcgatgtctttatganacattnacagtcagtcagcatgcnttgtgtgcggtctgatgtgnantatacagcagctatgtcgtgngtattgcgttgtgtcatgagttgatgtcggtcagangtgnnttatgttntatcgncgcgatcnggntttcgcacttcngtatnaacgcagtaggatgantgtgcagtgatcggtgttgcgcgttgtntgcttttcgctattagtgtacattgactccatnatgcatgagtatgtgagttgcgtctgcgnctatgtntngtgtgttntgcgctcgtgangtgatgtgcatctcgagttatagatgtgctcgctgagtcatctgctgacgtgagtatgtcattcacgctncttattgtntatgctctgtcgnatgttcagatgttgtagattgngtaatatctgtgtacgtatgctagtgtcacntctagtgcacgtatggtgtgagctgtcgaggttgagtctnatagtcatacacgtatgcgcattctngctatgctgcgaagcagattgacgttcgtgtgtagctcagtgccagtacgagtgctgtcacgagctgatttggagtggtaggtnacntacggtgacaacagncagctatcgcgatgataagttcgacacgcgtgttatgatagtctccgtcatntagagnccatgtatatgtcgacgccgtcgcatcatgttgtctcctctnatcacatctttctctatgcttagagntgncacgtctgagatagctacatagtagtatcgtgacacatgncggantcagcatggctgttagcgagttgtgtgatcatcggtcgcgacatgtcgtgtcgtgtcggtcatntncagatcntcattcattttgctcagatcttatttnactgatagagtcagattgttagttacgacgatagtatgtgntagcgcagtgcacttcgacagatgcagtgtcg

SEQ ID NO: 18418 - DNA, 1417 bp, Homo sapiens
  misc_feature (1)...(1417): n = A,T,C or G
ttaatgagagagagngtgnncgagtgaaagagatagcaagaacatgccgtttattgtaatatgaaaatcataatattaattattaagaatgagtatgtccctctttgctttgccgcacgctttttgcaccctctcccacatccacaaaagccaaagggcgcgctgggtggggcgcgggccgcgagtcagggtcgtacctccacaggtgtcgtagcttcccgcaccatcaaacgttctagcacccaccccgacatcctttctttgtgaagtcttcataagtgcaatacatctcattacgtatagcatcagtgagtatacaaaggtgatatgacgactatactttgtggttctgttgatcttggactctatccgtgcgtttcccactaaacttatcgacgacatacctcggcccgtcatgattaaggtgtttggtcacgtagttggcacacaacacactgtaggtatatttatattactcctcgtaagatcgagttggctactttcaccatttaacatagtagtatgtgtcatcttttactcgctggtgctagatacgtttagagggcgtgttgtcaatgattattgagaccttactaatattgtgtatncacactcctcgataatgcgtgctgtcgctcaatacctcagttatcgtgatcgccgcgactagtaatggcacgttacgagtntgttcgcccttgtacgcgtgtgtccgagatgagggagaggatttcggagttcacgaattgtatccataattgcgctcgacctacttcggtcctcctggacgcagggattgctgttcatctttcgattagttacttattgtccggctattgtacatgttcgtaccaaactagtgtagtcgcactactatcgtgtgataattacttagtgatcggagagtgtataggcgaccaagatgcgtcggatggcgtagaacaatgtcctgtatctgaatagtggtacggtcagatacatacgtatgtccttaacagacaactggcgcgtcgtgtactanaatacggtcacgaatgagttccgcacacctgcaactcttcgaatggcatgtgataacacgaagccaatcgtagttgttgctattcgtttatgantcacatcatgctcgtactgcagagcatgcatagacacattacatcatgaaccgtgtcntattaagtnaggcgcacgtgtcttatgcgncnttactcatacgtcgctttcatgtcgtttgtctgatactgtcagacacaagagtgcagcgtatcaacgcacccgcgtgtcgtgagtgagcgtcgagcagaacaactacgcgtatnctgctctgtgtgtataacgtgttttcgtctacgctagtctacgtatgcagtttagntttatcnttcggtccatgtgcttattatantatnttcgacgc

SEQ ID NO: 18419 - DNA, 1629 bp, Homo sapiens
  misc_feature (1)...(1629): n = A,T,C or G
tcgaactgggccggcgtgccacagacgaggccggccgacgagccatgacactagccgacgccatcacgtcctatccagagtcgagcgccgacacatgtcgtatgtcgtggtaggccgtcgtctgcgctggcgcggctcggagcgcgggagcgtgcgtgagacgagtcgacgggttcggagggagatccgacgagaagccgcgtcgcgcgtggatgacgcgccgcggaggccgagacatagacagcgcgcgtagcgcatcgtcagtaccttcgtgccagacggcagatcctatcgtctgaccctcgttcggtccctctgtataccagtagtcatgagagcaagagaagccctcgatgtatggagtagtacagacagatcgagcaccatttggagagcataggaccgaagggagtagcgtgggcgatggacaaggagtatgggagagaggacgcgagtgtggcgagtcacgcgggcactaggaagatgagggagcacctagcactcgccgcgagcagctaagcttgagcgnaggaggcagcgactgacgtagacgtgtcgaggcccatattgccgacagacgcagcgtgcgacctggatagcaaacagagcgatcatgcccggttcggcacagaggcagagcgagcaggccaagagcgagtgagccgacgggataacggagcgatcggcagtggcacgtagagcgcaggataagcaggagattagaagagtagcaggtacgttacgtaggtttgtccagatgcgttcgagacggaatagaagcatgacaaagcatctgacacagcccgctacctccgcagctttctgacgctncgacggatgacgacacacgaagcagctatccgtcgacgcgtccccgacgcctatacctcacactcttcctccaccgcctacactgtatcctggtatgatgagagaccagccggatgcaggggagtggtcggatgcgtgcgctacgtagccacgcgacgacgtctgcgtaacgattcgaatgcgaagctgctgtgacgagncatgacactcgtctgcacgagtgacggtcatacgatgacatcangattgatacgtagccgctgcagaatnatgtatcgctgagtagtgnagacgctaccggattatnacgtctacaacgnacgcaatgatcagagatgagagaganagagataatacgatcgccattacgacgcacgtcccatgatgatgaatcagtgcacttccaagtatagcgnagcagcacgcagacggacgagatacctgatgacanagtaagtgtatacgacacagacactacgtgnagactcattagangagtcacggcacgacgtagngctgagcagttcagagtctnagcgatgagactcacggagtcatcgtccacacgngtgantnacgagcacacaantagacgcagtcacgctcacatcgcnnattgagtgcgntacgnagnatgtagagcgcacgaaatacgtagtcgcagacagcagtcgaacgcatctgtganatcaganctcgacagtgcgtatcntatgtcagccnatgacgcgcgcgtgtcatgaggctgcaccatggacaantcaacctattcacgcgagctncattcgcncgatcatc

SEQ ID NO: 18420 - DNA, 1682 bp, Homo sapiens
  misc_feature (1)...(1682): n = A,T,C or G
ttcccaaattcccnncnatgggtgnacgggannaactannttattatatataatgtcngacgaantcangataaaagcaatgcgcagaaagccaggcatcgacacgacaagcagtgcaagacatcgcagacctacaactatcattatgacgctcaatcatagcatacatagacattacagtcactttaataaccataccatcaacatacaataatttttcaccatgacatcatcaccacatgatcacaattcacgctgagttgtcgaaatcattgtcatcaattacccagcccgaatagcatcaggaaggccgacgcacctacgttcatcatacggtcattacaggtctctatattttgtatccttggactttattactatttatggctgagttgagaaagtgtcgtataccactatatcaagttgtatattagctgtatgatatatttgcatataggagataagtggaaaacattgcttttattaatcagtagtcatattttgataatataagattcatataataatatccctatacctcacccttttaaccttaatctctcctctttgtttctccttaattacaagttactgtcgggtcgtgcgcgtatctttcttgtgcgtcgctatattcacgtgtgttttctctttacgttgtgcgtgcgtggctttcggacgttagtgctgtcgacgcgcgtgacngcgtgaggctgtgcgcgtctacgtgagcattggtgtcagagtatcggtgatctacgcaaagcgtacacgttacgtcgtgtctctctatgtcggtgcgtgggacagtcattaccgtcccgtatacgagcgactcaagtatgtatntaacagttaatgagtttcaactatgcagtcangataactcgagtgagttcttctcatgtttgtaccacatgatcgagtcactgttaattgtctaactgtcctgcgtgctgacacagtatcgacatnttcgttccgagtgcgacaagagtcgagatacgcatacagacctcatgtgattctagtagactgtacgtatacatganatcatgagttgtcgcacttanactatatagcattacgtgaggtatcatcgcatatgcagggtaccgccacgtntccgattacancgcggaatatgacatgaactgtgcgatgatgagttcacactgtaacgcatcacacatagtggattatagttcacgactgtcagttgcaaacgataactattagtagctcactgttgagagcctgtcgatacaatttaatgagaatctcacagtcacgcacatgttcnattctgagtctaatgtacttcgctctacgttcactccagnttcgcaantctaccgccatctcgctatacgatgtccgactagcaccccgatgtgacattcatctcantcatccttatcatctacacatatatactgcacacacacgctaccttgtcagtctgtatcatattctgagatagtacggtaatctttgcactaatagatctatacatgtctcagcgtgtcattattgtcaccgcagaaatagtattcatgttgactcgtgtngtcntaccatatantaatcgcgcgcaggccctgtgcgcgtcatcagatgtacagtgnatacttctgntcatccatgtcactctagtntgatcangtgacattatgacagtgtac

SEQ ID NO: 18421 - DNA, 1967 bp, Homo sapiens
  misc_feature (1)...(1967): n = A,T,C or G
gggcgcgggtggggggggngnaggtgnggttcgaatcgagccgccctccggggggatagggttggtttgttattcaacttagttacgacctatgtatgcgagtcgcgtatgggttggctggtgcagttctctttgtttcgcgccgccgcgctcgtcgctgcagttttttgttccgtttgtattttcgccactcgctcgagcgatatccaccgactgtgcacagtcagcggccgcgccaccacgaacgggtcccaccgtggtatgatgttcagcagtctatatgagagcaagctataacggatcaagtgatcctatctgttgtcatgatagctttcctactcgcgctggcgcatgagtcatattcaatgtaagcaccgccggagaagttgatcattatgtgggacgatgtcagagatgtagaccgntgtgtagatagaggagtaatgtagtatgatcnacattagtaganatacgagacgcagctcatcatatgtacatatgtagtcgctctgtntcagcgcagatagaagntacgcgatggtaacgtgtgtangagacgtgtgtgatagtacttgtgcgctgcgacgcacatgtctgatatgaaccacgtatgtcttggagtgaactgtatgagtgagagtgtagcgcggacgccggcaagctcgcgtatatacgtcagagtcagcnacagagtagcgacgggtcaagagtagagtcggcacagcctattactgcgcgacgccacgcgctgtaccacatctcgacgcgcgagcgcgccatatagctgaacatgtngtgcgcgatcgtgtaccgtagtgtagatgaatncacgcgagtatcacgctgtcgataatgtacgactcaacatggtacgtgtctantgcgtcgtgatgtcgcgatgccntcgcgctcgcgncggtgcgtcgtgtcgacgnacgncagcacatcacgcgataggaggtacagttgtgtatgtcgctacgacccacaccgcgatacgtcgcccgactgacgagagttgtgtcagcagttctggtgggcgccgtgctatgtgtgatgacggtggacgctagtttaacgaccctgtcgcacttaaccgtctatcatgtccactcgcgcgcgcccgcgcanancgagctcatgtgtcgattgtcaaccgcgtgtcactgcgagtggacggagcgtagaggtatgtgttcacgcgtgtatcgtaatagctacccataatcagtcaccaatgagtacaagatacaaccacgataccccccgcccgcgtgtgtgatgagtgtgtcgatagtctgatgatagtatacagattactgtcattatcgacgatatgtcacctgcagcgcgtacgtacgaagtgtacggagatgtgggtatctgcttcgcaccagatacgacacacgatatgagattatgttccgacgcccactctgtaggccatgtgcgctcacgcctctcagcgcgcaagatcgtctccagcgcaggnacgcgtgagctnactatcgacgggcatcgcgcgtactaccgcatgcttgctccgcaacgctggacgcgcgtgctgtgcaccgcgcgcgcaccccgcggtcatatcgtacggccgccacgtagttcggagcgcgatgggcncacgccncgcaccgcgccatcgcgagagccactaagtggagatcgacagcgtggaaccgagtaagtaggcgtcacaacgtatatgcgcgtgngcgtgtaatattgtggtgcgagacgccgcccacagcacgtagtataagtgaagttctgaggtctagtcgacgatgaccacaancatcgtaatatatctaccgagaccgcgccaccgtcgtgtagnatagatgatactcagtctatagatagaagtgagacacgcgtcacagcagagttaagtttgtgttaactccgcacgatcgagtccccttggagcgtgtagtatatccancacgacgcgc

SEQ ID NO: 18422 - DNA, 1951 bp, Homo sapiens
  misc_feature (1)...(1951): n = A,T,C or G
tgagaacacagngaccgccnaganaanggaggagccaannanataacagaagatgaactagcatgatannnctngacgtagtgcgnntgacgccgccgacgcactctcgtgacagcgctaagacaggacgcaatcatcacgagtcgaggcgaagaagtcagcgtacgccatgtacgaccgcaccatctagactgcagagccatgcaatcagtcgcactgccncatcgacatacgcatctcacgaatctctctcccgcttgcagtccatccgtcgacgctcagttgtcgcgcgcgtgcgctcgcggtctacccgttctctcaccgtntagcccactgcctggttcccgcagcacgacatacatcacatttccgcaccgctgtatctccacgtaattttgcgttgcgttcgtctcgtgtgtagatcttgagtgctgagctgctcgcagagtgtatgtgattgtactctgtagtactcgcgtggataaggcgagggctggtggcttcattcatgtctactctggatgtagtgacgctgagtantagtcgtctgtacatcgacattctacatgcgtaagcgtaattaatactcgtgcctctcgacctgccacttccgcctacagagatgcatacctatacgagcgattgcaagcaccaagctccaattagacagcgcactatgcctatcactgtacatttacgtcactacgatggcgcatcagagatcactagaactaggtaagtgaagtgggatatgagcaggacatgggtagcaggtgagtgtagcgtgaggatcaacgtagctgtagaatggcgagntcggaagggntacacagctcgcgttgcaatctgacatgtctagcgtgactagttgcgacgctcgtgatgccaatgaagataagacaacaacgtgcagtagagtcgatgacagaatgagaacgacgaagcgcatagtctgacgataggtgaggctctaatatgccaggtaaagtaaagtagcgcctacggacnagatgacgtcagtgactatggagctgagacggcagtgtctcgcgacgacgacgaagcataggaggcaggaaggcgctagatgctgtgaactgacggtgattactgaccaggtgactgcacagacagatagtgccagcgcgagactcaatagtgagcagccgtcagcgtgagtcttgacccaaatgcctgatactagagcatacgatccatcgacgacgctgcgcgtncacngtatgtgccgtgcgatagcctgtgttagtccgtctagtatcccattatgctgcagtacgactatctcgatgcacgagtagtgagnatgtagtatcgagtgagtgaatcgtacccgatgcgagtcacgtgtacgacagttgagagtgtctgctatatatcgaccgtgatatgtgatgactaccatcatatanttagattntcatattcgacgtagtcgacttaactcctgttttgctattccatctcacgtatatgcctagagcacaagacagagcgatgaccgtatcaacacgtgatatcagacacaccaatgcgacacgtgatgtcacgtgaccagtcacgatgtgctggatgcacgcgtnggagtggangtccatcctaacatatgcagatgtgtanttacgcatgtgatagctatgtgcaccgtantctcagagagcgcgctggatgcaaacatgagactctccaggtatncanatcgctcttacacctcaatcactcaactgcactctatccacgaattacatgtatgtcgaccagtacatcacacacatagtattgacntttgagaccgtcgagatattgaatcaaggtagtcgntcgtgtcaccatggagatagttcagcgccacacttgatctagtgctgactgtagagttatgcntcgacttgtgcatcttgactatcaactctgttacacaaacagcnattct

SEQ ID NO: 18423 - DNA, 1090 bp, Homo sapiens
  misc_feature (1)...(1090): n = A,T,C or G
gggcngggggnctnngngggggnncnnccatcnnttgttggtgtgtcgtttcttccggcngtttttcgcgcggcgncntcgcagtctgctgttcacgtcttctggcactctgttcggccggtgtcctccctccgtcctcacctcctccattcntccgttccgtacttgcccgccatcttccttgacaacatatctcacctcttgatctttcaaccatcaccatacctatcctactatctcattactcgtactatctcccttagcccctctgtctagtcggtatcactgtcacgacgtccagcgctcccccatcagtttcgccgcgcagacgaatacgcacaagaccccactacccgattcacaccgcaccttctcgcccggcctgtctgctccccctccgtcaatgtgtatcatagtagctactccacaaccacgctcatagcttatagcaaccgtccatgacacgtacgatgcggcaacatgtggcgatggaagccaaacatgctgtatatccggagagatagacataagaccacaacggctcgagtcaaggacagaacaacgaacgcctaatataatactacatcacacgccccgtcaataatcagaggatcgcccgaaatacaacgaaggtacaagatcgggccagactgaaccggagaggctgaaccagactccaggacgcagtcaagtgatatacgacgaccaccacacaacaagtaactatacaatatccacaccaacgaaaagagcgtaagataaagacacgattcatgaaagtgaactaccctgtctgatagccagtactggaattaccaggtcgacttcacgggacgcccatgcaggtgtgtaactattacccaccacatccactcaccacaccacacagccatcataagcaaccgacacagacagacagccgacgaaaagagcacacagacgtagcgcacccccgaaggacatccatcagagataatgtgcacagaagtgcagcggaagccagcagccaagaggcacgaccagcacacatatgaccaccccacacagcacacgagaaaacagtaaggcatacaataaaacacataccaga

SEQ ID NO: 18424 - DNA, 342 bp, Homo sapiens
  misc_feature (1)...(342): n = A,T,C or G
gttccggnaaaccccccaaagttaaaagccaactgctatcacatanacctcggnagaagaagacctggggactgaactctggtctctgttcttcattctgcatttcttcctgaggggcctggagagaatcacacccttgggccaaaccaatgtctaacctccatgtattgatttatgatttttcctacaacttctgctctcctggaatgtatccttaccttgaaaaacccttgcttataagccatctgggagtttgggtcttaagcattagctgcccgtcctccttgcttggttggcaccatgcaataaatgccgttttctttaactgcaaaaaaaaaaaaa

SEQ ID NO: 18425 - DNA, 1752 bp, Homo sapiens
  misc_feature (1)...(1752): n = A,T,C or G
ccggacgcnncngataccccgagatgaatgnctgacaacaacaagacgacatccacgtcatatcactctncatccnatcatgatcatagnccaccgcacggagnggagtggagggcgtgaggtcgagcntgtggccacatgtatcggtggggaagagcagcggtcgcatgaaaggcgtcacgcgttggtaggccataggcgacgtccgtcatagacgagtgccaatcgcgcagtcacaacacgcgtgcactcgcctcggtcgatccgcgcgacagatactacaagaagcgccgatcgagcgantgattcgtctacatcgggagacttcgcagganaggcatgattcacagcgatttctatcttggttatgttgactgttaggctgaagattacatgtattagcgcgagagcgacacataattcattagaaagcgtgtctgtgtcgatttatttgtgtggaagatagtatgtaccattctcttctatactctcacagatcactcctcntactaantgtacatatatcgtattcattcatatcactattcttacactttctcttattctcttctgttattcgatatcatttcactctgcatatattatactcacattatatgtaccagcgtntgtatgcaactcgctacagattgtatctgatcatcctctcgtgaatgactctacggtactactcagcgctgatacatgttcagatgtctggtgacgtccgacgctcattgtttgtggtcggtattacggttgatgcgacgagatatatcgaggacgtatgtagcagtacatcgatataccgatcacatacanatgtcagtgatacatcgtagtcctagagcatntgtccatgcaaatgatgctcgttataccgtcactgtctatgtgcttgacatgtttcactcttnatcgttcggtttactatttcatcatgtttaacatgtctgcacatcatgtagtttacactcatctatacattaatctatatatctattgcttattcatatcatatattctaccaatggtcatccgcaagcatacgtatgttacagttgcgacgcatttgatatattctcgatacggtacagtcgtaactctgtatactgcgcattcactatgaatcgttagacgcatctagtactcgtcataatncactgcactccattaaagcagtcgagtcatattatacgcgtcatgtcgtcaacacaggtgttntactgcttcactctactacttattcacccacatgataatgtctatactcttatatgatgttttagatcttagtattcgactgtaatgcttatctctatgttctgagtatacgtatactatactaattatatatgcgtatagttatgtctatgatcgacagtaccagatacanatcatacttcagactgtacgnnttaacgctggttagcgtacgcagatgtcactacatgtcacgttanncacgcgctccgtgacgcgtcccgcgtctacacatcggtgcgtagtgctccactatctacattgcgtcgatctctattagtgctcgtacataancgcncgtgtccactgtatcgtcggtgcacctttactatcgttagtacacgatcagtatcaacacactatgtatcagcgtagtgtcnantggnananantancgnagtagcctagcacgtgtacatacaggtacgatacagtatacgagacgtgacagtatgtatacatnatggaggatagaatngtcagacgcgg

SEQ ID NO: 18426 - DNA, 1986 bp, Homo sapiens
  misc_feature (1)...(1986): n = A,T,C or G
ggtaatcaannacttaacgaacgngggtggacnntatncagtntatactgcacattatcanataatatatancatgagagngannncagagananatctggtacgtagcagacccaccttanccggaatgggagagngacnncgagctgntgcgtggntgacntctaataaatagatagagagcatagtatagantaagatancagagcgacgacagcaagcgagtgagcatagatcgtggcatatcgcagagcgacacgagtcnanctgcttcgtcnacgtgtccatagccgcagcagagcacgcacgcgagtgcagtatgagcnatgagagcgtagacaataccgatcgtactatatatatcttgcgctggattatggaacgagcgctgctgcacaattaaccaatagactcagcgatagatgtacagtggagacaggcgtgttctagtgacgtggtcgcgcgtatgtgctccctgctgcatatgatttagatcgctgatgctatcagatcgctttgctgcgctctccatacccgcacgctagatgcgagatcatcgtatgcacatattgatggagtatgagatcacacagcagacatggccacgtgcgactaatcctaatgaagacggttatacacgttgtgcggtgccgatctgcaagcgctacatcacgcatctgctctctacgtgtagatattaagatttggacataaacatagacgatcgcgtacanacctactataccctcgtacactaagtcgagagacttagcgtctatacgagacacgaaatgagatccgcgtccgacgacccacctggtccacagcctgcgcggaagtcgtacatcaacagtaagcatatcgagatgcagtgattcgatgtcattatagnagactaggagagtgcagcggaggcattatacacggtcaggtccgtgacgcgaaccaggtatcatatagcagacatgngtcatacnctacttacatattatactgntactanaacagtactgtacgagatagcagtgagtacacgaatacaatagtacgatagacgagtnantaccagcatacgtaacactacgcagatacggtcaagcagagtatgccacagagcgttggaccagatctgctatatacgtcacatgtacagtatctcatagtcgaatcactcgcgtcgcagacgagatcatcagatcaactcatcacagagatgctgagataatcgcatcagatgatacatattacagtgaacgtctatgcagtgttatcgaatcgatatcaacaatgtaacgtctcactaagctgtgtgagctgtcacggtagtcgtatngtatgatgcgncggcacgtatcagcaaccacgntccgctantagcaacagagctgacgtatgtaacacgactgcannantctntctctacatatacacagctatgcanattgtacgtacacgatcgtngcacagaactccatacagctagatgtgtcacacncactcactctacgacaagagcgctctatggntgagctgactagtgtgcatagntcagacagtcgctgtgcgctcagtgcancatgtgcgccagttcagtcgtgtcntatatatcntnctatagtgcatatctactacttgcgtctcatatagttcagccacgagngtcacttgttcgacctgtaaaggagatgagactacanctggtacacagagngtaggagtcagagatagacatcacagtcatancactactataagnagctgntatagataaacgagatcatcaaagatatctcgantacatccagataccatntgtgtttcgtaacacgtgnagangnnactagcgactatgtatcngtgtattcgctccgcatcgatcgtacgagtcgacgagacantggtcaacatgctacntatgagtnagatgtagtacntgatgtacatcatcacanaagtgcagaatagtctcacatggactcacgncac

SEQ ID NO: 18427 - DNA, 1236 bp, Homo sapiens
  misc_feature (1)...(1236): n = A,T,C or G
caagttaaaaagtcatgagggaacaccaggaggacgtttttgttgcaactgctgcacagctatgactctattattttctgaagcaaaaatgcatgtgttgtgtaggaatggtaaacaggaaaaacagttaaaaagatcattgcgcttaacaaggaaaaaaaaaagaaaagaaaaagaaaaaaaaagaataaaaggaaaaaaaacgaaaaataaaaaaaacgagaaagagaaaacgcaaagcaaagaaaaaccgaagaaaaagaacggacccaggaatagaccaacaaaaggagtaaataaaaaaaaacgcagagacacctacagagaagngagacaacaagaagaagagaccaaggagggtcaggggcaagaaaaaaagccagagtgaaagaaggagtacaagagaaagcagtagcaagaaggaggactaagagagggggaggaggggtcgcagccggggccgaagtacagagggggcagcgaagagagaccgagagggagagaaaccccacggtacaacacaacgatcacaggacagggtgggaggtcgcgagactcgagcgtaaagcatcacggatacaggcaagagagaagaaatgagcgagagagagagcagcgggcatgcgaaaggaccaggtgacgcggcaaacacaaaacaagcattaccaccacaagagaacaaacaataagtaccacactgaccgaggtaacacaccggccgccccagaggcaggaaacacgcgtacaaagggaaaaacatagacaagaaagaagaggcatgccaccaacacgagtatgcagagcaggcggatgagccacagagagagacattgatgtaaatcacaacacccaagcagccgaagcgctccccaccacaccacccacgacgagtgatagaccgacatggaaagatagagattaccccagcagcgaagcggtgccacccgacacgaaatccgcccccaccccgggaaaccaccgcacggccgatgagcaggatgcccaaagcgaacccacagagaacaaaggacagccccaccgacccatcgcgatgcaccaaggtcgcgcaagtgcaaaactccagacccccccacgcggctcatgtagatgaatgagactcacgagcactgaaacagcaaacacaccaccaccccgaccttatttccacacatgcttacacgccgcacaccgggtaggaaacgcgcacacccacaacgcaggttcgggcgccacgcg

SEQ ID NO: 18428 - DNA, 148 bp, Homo sapiens
  misc_feature (1)...(148): n = A,T,C or G
tataatgcgactaaaagncacgagnaaaccanganagtttttcttcaatctgcacactattgatctattatttctgaagcaaaaagcatgtttgttagaatggaaacagaaaaaattaaaaattcattccttaacaaaaaaaaaaaaa

SEQ ID NO: 18429 - DNA, 283 bp, Homo sapiens
  misc_feature (1)...(283): n = A,T,C or G
tttatgaaaaaaaaaaaatctgggcactcctanaagagaaaaggctgatgttgggaaggtggcatgcatgcagaatcaccaagggaggaaccagcctggggacaaagcagacagagaaaagtacatgtactttttgagggaggaaagtatggcaaaaaataagaagaagaagaagaaaaaagaataagagccactggatcaagctgaccctgaaagttacccaaacttgaatttccagctatgtcaataaatttcttattgtttaagctcaaaaaaaaaaaaa

SEQ ID NO: 18430 - DNA, 1813 bp, Homo sapiens
  misc_feature (1)...(1813): n = A,T,C or G
atacatctgaatcttactaacnggctncaccgaactgcgctgcgtactatggccgcaacgcacgtgtgatctggtcgacgaagcgtcgacgaacacgacgcacggtagcacgcgtccgacgacactgcggatcaacgacgatacgagactgttgacgacgacggtgagactacgtgagacgctcacagcgatgatgngagactatagcaatagtagccgctagctctagcgcattagtagtccgatgagcgcatgtgcactacgacgactacantcgacatatactgttatctancatatcgcgactacacggtctcctgatgtactccacggttcgttcatatattttatagcactgccttcgccgtgacgttgcttcgcgcctgcagtttgatagattcaactgcgtagcgatacagacagcagaccgatagtatgcaatgcatatcataaatcataatctactatcatgagatactgtcgatgtgatnatgatgcgacggnatagcttacgctcgcagatatgaagctacgacacagctgattcganatgaagtcagatgactgcgtgcggcgcgagtatcncatcggccgtcgtccgcgcacgtatncgnctgtcagtcatanaccgcgtcgagtctcataccacacagactacagcgaatcatatatggaacggtatggtacgacgagacggctcnatcaacgatacgaaggagcaacgctgcacagctagtatacgcctctcagnagtcatctcgccncaacctcgcgcagacatactatnaccgcatgcagattacatacatctaatgcgctcacgcactatattacgactgatccgaagtacaagttagagnatccgcatgttacgcgagcgatcatggctctaacgaatgacatgatttactacattgtctcgcatgtgctatgagcaatcgttccagatgctcagtagccacgagcgatcagagaacgatatgtatccgatgtatantagacatnttaagatcagttgattacagaagttagtacttcctataactgcattaatcgctgctcgcataagntactgacgagcaacaactgttgagttgaatagatcgacgcacattttatatgatgatgtctgtacaataacgccacgcagccactattataccagcagaagtacacacacttctgtgaaaatacattcagtgatatttccgtcagcaatcgcaagaatcgatagattatgccaagtcatcatataatatctgtctatgctagtgctaggtgggtagtataatgatctctcatcgataacgtttccattccacattagaatatcacagctcattnatacttccacatgttcgcaatctgatactctatcacgctagtcgctgcacgtcatcgccataccagccatatacnccgtcgcgagcgtgactcgatccacaatgangtcagtacacgccagtgagnccggagagtccaatgataggtnctacttcactcaagcaagttgcgtagtcnagatcgtngatccncggtgcagatgtttgacgtgtgtagaccatgacgccatcaagtacgatacctccgntagatgtatatcccaccagattgtgaaccttcgaccactagaacagttcatgcacatcttactgtatttccaccgcgagccccatatgcgctacttacatcgcatactcagttatcatgtatgtcaatgttcactcaaaggatgcatgactgccagtcattgtncgnactatatatgtctcttactctccgcgccttntaacgaaccgagtattaccncgat

SEQ ID NO: 18431 - DNA, 362 bp, Homo sapiens
  misc_feature (1)...(362): n = A,T,C or G
ggcggaaccgccgggacatgatttgattggtccatggctttgggtttganganaaaagnaccagattaaccaccgtggtngagctctgnaaacctccttggcatcctgagccgcatgtagaagcagcagcagccataatgtgtctccattccttctgctcagagcctgtggaaggggccatttcttggtccaggtgagctccttggaagccgaccagaaagtctcactaaagtgcctaagtaaacaacttgctgtttcatcgatgttactttagtataaatgccaacatgctccatcttacgttatattcaaaagtcactagaaatattaatacagagtaggcaccgtcaaaaaaaaaaaaa

SEQ ID NO: 18432 - DNA, 1066 bp, Homo sapiens
  misc_feature (1)...(1066): n = A,T,C or G
cttgctcaggtcgaacgcgaacacgagagaaggagagaggacagagngaggcgggggcgaggcaggacacgtggagaggcgcagacgagcgcgcccacacgcgagccctccaagtccgccacgacgagccggcgtgggcggcgctgtagccagcggggccgcgcgcatggcagatccggtctcgaatcagcaaacattagtgtttggatatgataatcaggctgaaaggagtataggaatgctcggggaagactagagcggatagcgagaagcagagagtcaaagcacgggccacacatacgagggggaaccaggagtagaggaggagtgtagaggagaaacgcacatctgatataccgtagccatcagggggagctagtagtgtgcaagccgtaagctcggtagcggagggagtgcgtataacaaggggtagttccatagcggagagagaagagacgcggagtcggtaggcgaccagaggtaagccgcgcggatacacaggcgtagaacgagagaccaaacgtgagccaacaaagaagcagttcatatatgtctctcggaggcgagaaggagagtaaacgctaagggcagagcagatgagtgaatcgatcgcagagtgggtgggnggcagcgccagtaagcatactgctgagagccaggtggcccgcggacgacatgtcggcagagtgtgatccgttattatagcacgatggatatgagtaacctgtagatactggtacgagagagctggagtgagagcagaaggtggagcgccacgtggagcagtgcgccagactaggcatgcggtgtaggtatgagatccgccgctacgtccacgcaagcagcnacgtcatggatggagcagtccggcagcgccagaatgccgaccggagnacaggagcgacactagctatggagcgcgngtagccgtgcagaactatccagtagacaagcaccgcgatatggtacccgagccgacggagggcatgagccggtcgccatattgaagcggcatgcagtgcctagttggaggcgtagatccagcgccgagcgtgacttgagnagc

SEQ ID NO: 18433 - DNA, 261 bp, Homo sapiens
  misc_feature (1)...(261): n = A,T,C or G
agcagcgcctgagcgggggggacgatgggcttgtacagataagtaaggaaggtttttcgtttnccggaacgtggntntgnaacagccgtcttgggtcctggagtggaagccatgtgtggaagatggagggcatcggttagaaggagtctagtccctgatggtcactgagctgcagaaccagcctgggctgcttcctgctggatgtcacttactagagagcgaaattaaatgtgcttcagctactgttgaaaaaaaaaaaaa

SEQ ID NO: 18434 - DNA, 2003 bp, Homo sapiens
  misc_feature (1)...(2003): n = A,T,C or G
tattagttatctttgtatctcgacgagagggaagagacncnccctccccccgtagctatttgatnttngttatataatctggttactaatgatgaggctcgtcacgcgttttctattgtgctgagcacagcagaatcagcaacgaacnataacgagagcataccgtctctgacatcgtcatataataatataagatatcacatatgttattggtatatcgcaattaaattagtcgcaatcgccatcaatccatccagcgtaagccgataccatcatgccaatgacagtgatgtattgtcccgcaatacactctctcttcgctcaggttgcgcaccgttgcgcgccgacgcgagcacgcgacgacctgtcgaagcgccagtgtcaccgccccgccactattgcggccgtcagcgtctctatgcgcggtcgttggttgagattgagggccgaacagaaccctcggtcatacctctcgaactgcgatcacaccgagcgtggttgaacgccaagtagtggtgccgatgcagaggcgtgaatccgcagcgcatggntcggatcgcgatacgcgccagtacgctggnatctcgcaacagtanaagagtgatatactgaagacacagtctgttaacgatattgttcgcatagatgtgtgtgccttatgtaagcgacatcctagaaaccgcaccggccacacatctaatcccacagacagtgcagaggagaggacgagatgacacgtcagtgatatgcataattcgtacatagtagctcaaggaatgagagcgaagcgagtaacgccggtgcgtcatacgaatggctactcgtgtgcgcgctgtgtctgcctatgacgttcgcgacacgcattgagaagacacaccgtggantgcgatgatacgtggagacacgtcaccgagtcatgatcagatatgtgatgccatattagtattcacgagaacatgcaagagagaccgtgacgaatcgatgtaccacagaggtgcagaagagtacagagctcacttctggtactgagagagccgtcgcacgagcagagacataaggatcatactagtcgtaaagangacgcgtgaaacggacgtgcgcaaagaaggtgtgcagagagaggagatggatatagatatatgtgcgcggactggacacagtgatgctagacagcagtgcataatagtgatccggtcaatgtgcagtagtacatatgaacagacagacgaagagtcaatacacatgtgagcggcgatccaaattcttctttcttgaagatatgaggacacgcggcgcaacngaggtacttactgcacaacaacgcaatgacaacntaagttaccatatcaacagtgtaacacagaataccgacgagaacacgatactgcagttgatcgagtgcgcagtagcgatgatgagatacatacagtgttacaccttagatatgaccgactgtacaacataacaacgagtgacacacatacgacgacatgaactgcctgtggccaccgtaccatgtaatgtgcgtataacaatatgtctgtacagatgacctgtcaanagagactactagacantgatactgananaagagcggantcgcccaccgcgaccatggccatgaggcgcggtgtgacacgcgtcacctntgacgtgtacccgtcgacatacatgtacgctancgaagntgacagagaccaccatgtccataacgcgttcgtcaccggcgagctctagtgcaccgtcatcntccattgctcatantgcgcagtaacacgcatcagcctgtgtagtgtctcaccactcangaataaatgacttttanagcgactagctcatacagactctgaacgatancgatggntctctgaatacacgcaccgagtantntgccgtagacacatacgcatcgacagtcgcacaatncatntctctgtacgacgacgattcatgactgcacattagtnctgagaatacgcactaacgnctactgcgcgcgtncg

SEQ ID NO: 18435 - DNA, 298 bp, Homo sapiens
  misc_feature (1)...(298): n = A,T,C or G
gcctgggacctgtgggcggcgggaccgcccgggaactgaaatgaatggaatttggaaggggtttcgagtacatatacccgaccttgcatncttnctgccttcancattnaagaaagnnactgcaaaacccagtaacagcacgtgccatgcttcctcactggnaattcatcaacctaaatgacccatacctttgcccccttttcacgaccctccacgctcttgtcacaagaagcctcccctcccagtgttattaagtaatatgacgattattgcttacaacctannaaaaaaaaaaaaa

SEQ ID NO: 18436 - DNA, 1672 bp, Homo sapiens
  misc_feature (1)...(1672): n = A,T,C or G
cccggggnnnnnnnnnggggnnnggggggnnnnnnnnnnnnnnnnntntttntnnnctnncgnnnnccnnngcgncccacgacannnncnnccnnncctnncncacgccacttcctgcnttcccatggcnggncggcccccatcctgtcntccgantnagccancacaggncagcgcantccagacccntgccntggcannccctcgncgatccagtttaagtgccccgagcgactcgtgccacgtattgcatcaagtcctncgtgcatgatatgcatcctttcgtgttgcatattccccgcaccatttattcaaaggctaactttctacgaccccgtgatcaagtgggtcagacgantcgacttattcgaggagtgcaganttgagccgcggcgtgtacatcacgcaacgatcgtgtctatgaagacgatantgagatgggcgggtcgagaccgcgtaggacatgcgggcgcaggtgtcgcgcttcgaggctgcacacgtaggcaggtgttgctcagacgagagtgaaaagtatgcgagggcatatctgctcgccactcttcacgggcggtcngcaggtccggaggtggtagagtggaccgcgcgacagaccagcggccgcgcgcctagcaacgcgattaccatcgtcgcggtacgttacgcagaccggtgtgcgctcatgtccgatatcgagacgttaaggacgaggtcacgcgagagcatccgtcggcactgactgtgtgagaagtccgaggtaaagaagtatgagacggtgagatgtgtcggtaaaatgagatcagcggagagggacgattctgcgcgtgtcgagtggtagagcccgtagtaataaaagtgttacaggagtgaacgagcgcggggaacacgcgatcacgaccgctatacgaggagtgtgcggagcgtggtagcggatgtccgtgaggtgtgagagtaggcgagcgacgcatgcatcggtgaccggtcgacgccatgcgtgcgattggcgtgtagtccgcacgggtgccgacgagtcgtcatgatgtgagttgtcgacgagcantgccaattgctacggacatgtgatgcaatcgagatacaactgataggacgaagaagcgcgatcgactggcgcgcgcgttatcatttagcgcgttcgcgctagtgtcctcgaggtgacgatgtacacggtgtagcgattcgtggtgccgagatcagcatagcatggtggacactgtcggaccgcgattatgccgtgtacactgacgatacgggcgcagcacggcgctcacgctacgcaagagtgcgcacgtgggaccgtgctcgnggccggtaccttgctgtctaccgtggtgcgttatgtccgtagtctgccgccgttcacgtgacactagatcagtcccacggggcagtgagttcaactgccgcagtgcgcctgccctgcatcgcgcgtatggacgtcactcatacacgccctgcgtctctgctagtaggcgtgttatcgtgtgtgtcacctgcacagacgtcgttgcgttgcttactgtgatgtcgtgcatagagagtacctctacgccatgtgtnacgatgtcgatcgcacatgcgatcagctgtagttctccaaagacgatagacgcggaggtcgatctgtgcacgcgactacgcgacactgccagaactg

SEQ ID NO: 18437 - DNA, 283 bp, Homo sapiens
  misc_feature (1)...(283): n = A,T,C or G
ttgagtggtgggtctgcccgggccggataagtatgttttaggaagggttttgagttccttttcggctcttgntgcctctttcctacanacatgagtgcacagnaaaaagccaagcccaggatgttcttctcagtgagtgagtgttttggaagagtctggaactgagaagagcccctggggcactgccccagggaatctgtccccacccttgttggtccacagttacagttgcccttgccctgacatgaagtaaaacaattctatctattcaaaaaaaaaaaaa

SEQ ID NO: 18438 - DNA, 1691 bp, Homo sapiens
  misc_feature (1)...(1691): n = A,T,C or G
gtgcagggtcgggtgcaatcgttanngtgtgaatggaagagngantaacgcntgangttatggtcnaataggacangatcagantcacgaaaggtatgaagatgccgacgcacgagtccacgagtngctgcgacgcggcgcgacggtggcggcgcgtatggctggncggacgacaagacaattatcgcaaccatatacatatatgccacttcgtcgaccacttagtagcacaccnatcacatgacgatgacgagtcggacagtgaatatgacgaaacacaccaatacgcagacatctaccagaatacacgaatataagcacgtcaaggaacagaattcatgcgttgtaacatgcacgtcgcgcatgtgagtatgtacagcaattcttcatacgtcagacgtttacgaagcataagattagttatctcgttaatattcattcgtcctgatagagccaccctgttgctcactacatattataacattatcggagtaatatagattctagtagcggttacacatggtagcgttggggcgtagaagcgcattcactcctattacctacagcttactactgcccgctccatgccctctccctcccacttacgcgaagttgataccgcgttctctgcagtctattggtgtccgatacttcgtgcctcatctacgtagcgtggagtctatagctagccccgcctcatgcttccgcctggtccttgtgatgcaattttagcagcagttagtctggtccgggacagcgcgcaattagtcgagcagcaggatccgacgttcatatacggtacggcgtcaagagtagtccatgcgagccggcgcctgagtgtccatcgtatacgtaatcacaatacgcacagagacgctgagagtatgatgatcgatgatgcatcgtcttatactctacacatgacaaggtcgcaggcggtcgcttctacacgcgacgcatactgcccagctcaatgtggatacattatacagagatagctcacgagatacgcaagtcagacctacgctacccgcgcagcacggatggtacgtgacgccgaggaccantatctcatttactacatccacgctatactcatcgccgcacacgtaccaacagtcatcatgagtgaggatgactgtcgcacgttccgctgccacgagagctgctcgtggtcagcgacgtgccgagtacacgnttagacacgttggaccgacatgcacagccgatgcgatcgccatagtccaccagcgaagttcgagcagcgatcacnagtgtctatcatacatcgtatattatccacccgagtanatgattatagtatatactgagactgcacacatacatatcnccacgcacgctctcacaccctcccgacncgtctactcagcgatacgtatcccgctagttactgtcacgaccctcagcactcacgntagccactacgcatcatgtaagcncagaactacacctngnctacncaatgttctcatatcagagacagacaactagtgtntcacatancaagcgcacgtatcgtatatacctntgattccnctacgcgagncgaccaatcggagaccatgagaaccgccatataagtcaatgctcnctcatgtacatgtcacaaaagacctgagatgcacatatcgagcacagcagtatctagcatcgtccacacaccgccatcg

SEQ ID NO: 18439 - DNA, 279 bp, Homo sapiens
  misc_feature (1)...(279): n = A,T,C or G
ggcctccngagctccaactgcattctctattggtnattggtctggaccctacttccttactaacgtgcaaaacatgcattgaagcaggcagcatcttcaacaaaaccgcatattttggccaggtgtggtgggtcctgtctgtaactccagcactttgggaggctgaggcaagaggatcccttgagtccaggagtttgaggttgcagtgagccgtgatcacaccactgcactccagcctgggcaacagagcaagaccttgtctctacaaaaaaaaaaaaa

SEQ ID NO: 18440 - DNA, 870 bp, Homo sapiens
aagctgattttctcactccttctaacacatccttccacttgaagacgagctcctttctctccagagagaatcagaaagagcagaaggcaaggaagacaagctccatcctaaactccaatctgcactgttggattcatattcttccagagctgaaaaagacttgtgaagtcctatgatctgttgcactgcctcattttacagtatataaattgaggctcagaaagaaataagatggttagaacattggtgtttagaacacagcttgaatcagacagacctgggtttgagaactggctctgaaactgtctttgcaaaaattatatcagtgagaaaaattataacagtaagctaagccaactctccccaccccttgcctttcccttaattatttctgggctgctgggctaactttggaagacatttaggcgacagtgtaaatgataataggccttgcccaaaactcaactgcttttgtaaagctaatgggaggcctccatacttggaggaggagaggggcctgagtcctgctaaggcacagacataaatgaaggccagccattattccggaggttataagatatgtaacttccccaattattcctgaaaataccaccactattatagattggccttttgagatatctttccaggtttttttggatgtctgaaatccatggcttcaaccccctcctgtgcccaggagcaaagcaatttcagaagacaaccttaaactccctatgattttatctttaccccacccatcagcagtcagccacctggtacccttgccacccccaccttttccctcaacttggctttgaaagtcccctaacctatgagctctttggagaaaggatttgagtagcaccc

SEQ ID NO: 18441 - DNA, 463 bp, Homo sapiens
  misc_feature (1)...(463): n = A,T,C or G
agttctattagcacttgnacttncatncttcactgactttgtgctgaggtgtccactcagcccacacatgaacttttccttattctcccacaagtctctacactgctgaagtatggggttaaaatagaagatgttgacagatagcatactggatgtaaaggagcacatcttgggacaagaagaagagctctgaagaataatatttcttgacagataaaaatatctgaaatgcagtttctgtgtccataatgtttattgaaacaagcctgcctctcatgtttatattggctggggttccctttacattaaacattaagcccacagttggaagggaaaattcggccccgaaaagttaaaaatttttctttttttgcaagagaaaaaaaaaattcactgtttctttgccccaaagggcaaccaaaaaaagtttttttttatttggggggggccaaaaaaaaaaaaa

SEQ ID NO: 18442 - DNA, 696 bp, Homo sapiens
gtccgagtcaagactgaacgtccggcctatcaaacccaacctggtcttgcatattaccagtgcactctgaggcgacggcaagaaggactgtaaggacctgtagaacccacactaaaagataatatggcccttgatagcagcacatttccccattgtaagtcgtgactgcctgacgctaactaaaaaaagtgagactgcccccaaccttaaacaggcactcattgatattcgcccctgcccttaacatacatctttgtaagactacccccaccatacttaaactgatctttgtcctattctcccccgcccttggcaccttgttctgagcctaccacctccgtatacgatctactgttgagacggataaataatgatcctggctactgactcttagcgctggactctgggtcggttacctttatgaagtactaaaaggagccttactgacttactcagaatgatgggataacgcactaaagaacatcggatcaaatgacctcaaaaggggcaatacccgtatacacgccgcgatggtaacactcataataagctgcgacccctggccagcaaacggacatcaaccctaaagggcaggggtggaaacccttctacattatatacataccactggcgagcatcagaaagctgcctctcaagctctcatgggccaaccctgacagttatataatacatcca

SEQ ID NO: 18443 - DNA, 860 bp, Homo sapiens
aaatctagtaaaagacttgccaaccctgaatcagaataaaatactatgaacttggacgagctcaaacactggtccatccatggaggtggactggttgtttgtagtgttgttcttgaactttcccatgtctgcaccataacccacagttcctgaagccaagatgaacatttaaatcagcagacttcaggtaaaggagatctccttcctggatgtgagtgggccacatccaatcagtggaagacctggacagaacaaaaagactcgcgtctcctgagcaagagggaattctgccagaaaacggtctttggacttcacctgtaacatcacctctcccctgggccttcagtctgcggccccaccctgaggactttgaacttgtcagcctccacccctgaatgagctgatatctcgaaacaacttcctctctctctcccccttcctattcctatttctatatacaccccccccccccccctcttcctgtgatccccccatgccctttacactcagaaaaccccgcctcgatacactaacttctactttgtcccagggctcccgacgttgaccccttcccctccccgctcgccgtccaacgacctccagcattgccgccccaccaccctttccccccatttccgcattccccccctttgtcccccccccccctttttactcccctccccttctcccccccccccgctttacccctcctacgcaccccctgttttatacgccccatacttttccccctccacgtatttttccttcccgcctcctcaccccgcccacgccatattccacccccgtcattcacaattccccccgcccgcacttcccccgccccaacatgcctatccccc

SEQ ID NO: 18444 - DNA, 820 bp, Homo sapiens
tgccagggtcacttctgttcttgtgttcagctccagtcacccgcaccagtgacctcttctctgaaggtctgagatttctaaaaattaaacctgaatctccctgtgagtggcttaattacaacacaaattgaatttccaaccccactaggcgttttctgccaaaataattgtgaaggaatggtaccctcctattttccatcccgtcatattgacttaccccactgaacgctgtcgatgatccctcctcgagttacccctgctctcttgatgcctacatcacccccttatttcttccccttcccttacatcctctttcttctacatcgcccccccctatcaggcactgcatcaaccactcccgcaaattaacaagtcaatacccctcttcattcacccttcttacttcacttacgttcctttttcctcataactcccactcccccccatcctccctctgtatttccaacctcccctttgtctcctcccattccccccctcctattaaacataccccgccacactactcactcttcgcttcatatccctactccctctcccacccacctctatgcgcccacattttacccccccccccccacccctccccttttataataccccccatttctttcaccccccttttttccctccccttacgccacccctcttttccccccccccccccacttccttcccccctcaccatccacagtaccattgattccgttcaactttcttcttccacctaaatctatttcctcccccgccacctccacattcccccaccccctcattccctccccccccccacccatacccg

SEQ ID NO: 18445 - DNA, 326 bp, Homo sapiens
  misc_feature (1)...(326): n = A,T,C or G
cgttccatcttttttcctgctcatattatcaaaccagnctacaaatctaattaaactgtcttgatgccaaaatctctgctcctggaagaaatgcatcatgcagcacatctagttctggaggcaagaaataatcagattgctgggccaaaatccgggtatccagagccacactacttccagaggtcctagaggagaatccatccattccttgaactcagaattcaagacgggaactcctaggcttgtgaccacatcactccagtcttcaagtacagcatcttcaaacctgttgtgccttcagtgtgtttgtgtgtgtgtgtgtgnng

SEQ ID NO: 18446 - DNA, 808 bp, Homo sapiens
  misc_feature (1)...(808): n = A,T,C or G
gggcttgggtgaaggcacagcaagcacttgcctaatctgccagctggcagaggagagctgagattcaggcagggggagcctgaggtcttagcctgtgctcctcatcttcaagatgatgtctaaaatatcagcattttggcaatacaggagctcctgggagaaaaacctagcagtgctgaagagcgactgtgggactttgaggaaactgctggaagaatattggggagagaacctgaggtcaagggccaaaaaggcctccccaggggatgagctgccatttaagagagattttctaaagtcaccaaagcaggagaacatactctgaaaacacaaaagctgccagaaaatgaaattactgggtgacaaggagtgacgactgcccggagaaattctctaagtaatgacatgggtgccgtcatcaggggcctcaaactgttggaagcaatgcaacaccagagccttcctggacttgctttaatacatttaacatgtcaatccccctacagcactcacatcttggagacaaagtgtttaacaacatatacttcatgtatgcttggttggtgctttttggtctctgcgcctctaaaacgaaatagaacattcagaatacaaatttttttaaaacatgagaattaaagcatactgggaatgtcttccttcattntcctgctctcaaagctcctaggaatcttcctagttagaaccttaattatggaaattctcatttatanntatgggatttatttaaagcccttgtctttccaggagaaataaatgctggnttttgaaagcaaaaaaaaaaaaa

SEQ ID NO: 18447 - DNA, 863 bp, Homo sapiens
ggtccggtgcttcttgcttgaacaggagcacttgtggcttgataaaagtttggaatacccaggagggcctccttttgaaggcttatgcagtgcagcctctctcaagatctcagtttactcagagtagaaaggtgaactgcatttgttccaagtaaaatatacatctgtattattcaccatcacacccctattccattacaaacaaatactgaccttgttcttctgatgtgaagccagagggagtgtgaaatatagcaaggagaacagtctgatgcagaaatatgaaagttccaagcaacagaaacgcggtatttaaaaggagtagagaagggccccaacttggtctttctaattccttctccgcagctgaccctggggaaagtaactcaatagttaccagtcgctttggggaaactgcctacattagttcagattgccagttggattttttcactctaggatctatgcgttggtagtctctctgctttttcttttggccttaagaacttctcttgagaacgctctgtgtgtgtgtgtgtgccgccgtacctttccattccaccacccccacacccccacactcgcactccacccgttccccccccccccccccctccccccccttttcccctctcccccccatcttttctcacaccccccttttttctccctccccattttcccccccccccccttgtcccccccctccccccccccttcctttaccccccgtaacctttcccacttcccccatcgttttcccctctcaccttcctactccccccccacacctttttctcccccccgtccccccccctatcccccccgccccctgtccccccccccatctgcacctattcccg

SEQ ID NO: 18448 - DNA, 768 bp, Homo sapiens
taaggagttctcagggaactgcagagtgaagcaggaacatgacagacaattggcagtgacctggacacctacctggatccatgctgagctctaatattcgggtgtagaactgctccctgggaataaagggttcctgtataataagagcagattacagctggaagaattacaagaaacagactatttaaaaaggagttctcagagaaacccagagaaagcaggggaaagaaaaacaagaacgctagaggaatttgacacctctgccacctacagctagaacaaacattagatatggcccatttcctacccagattaatataaaacctcacattgaaggcttatttgcctcagttcctattacctgacttatcatgtctgacttaaaaaaaaaattataagacatgccaaaaggcaagaagtaacacagtgtgaagagacgaagtaatcatcaaaaccagactcagatatgatggattttcaagtttttagacagaaatttaaaataactatggttagttaatatgttaagggctctaaagaaaaaagcacacaatacgcatgaacagatggttaagtgagcagaaagatgacaactcaaggacataatgaaaaatgaaatgctagaaatgaaaaacactgtaacagaaatgaagaatacctttgatgagctcatcagtagcctggacatggccaaagaaagaatcagtgaattgcagattatgtaaaagaaacttctcaatagaaatgccaagaggaaaaaaaaaaaaa

SEQ ID NO: 18449 - DNA, 661 bp, Homo sapiens
  misc_feature (1)...(661): n = A,T,C or G
caaggccactacagcatgtgcctgtgggaactggnanaaatatgganatgcagcacacttgcttcctactgaagattaaaatcaaattgttttgggacagcagaggatgaagaaactcattttgactgaagttattggatgagacatggctgtggacaacttcagagaagatatatttaagcagaaccttaaacttatgtcagaatttttaatcaccagagatcagcaaagccaaaggcatatagactatttctcagatgcacttgtcaagatgagagaatgtgggcagagacattcgaacagggaattactcctcccaagaatattcttccaaggaaatccctgaaaaaccagatggcagaagttactcagaagaaatgaaaggattttccattattcaaataggaggtggaagaggaangtgtgggagtaattactggattangatccctgnnngccnnnattgtttttnnggtggactgtggagaanaaattcttgttattggttttttccccgtcccattgcccccccctacttcgccctttcttgcccgtatctctggctttttcccccctcctccccaccgtacccattctcctgcccccatcgccatcgnggttcttcccccncttcctcgccgcccaccattcctccccttat

SEQ ID NO: 18450 - DNA, 871 bp, Homo sapiens
  misc_feature (1)...(871): n = A,T,C or G
tatttgaattccangacttgcaacgagggtctgatgtttgcatgaaacatatgattccaggacactagtgctgttgtttcaatgtttgtcccacacatatgattcgaaaacactactgctggggtctgagtttttgtccctcacatagggttccagaacactgctacgagggtctgaatgattgtccctcacgtaggattccagaacactaccgctggggtaaaaatgtttttctgtcacaaaggattccagaacacgagggtctgcatgttcgtttctcacgaggtattccagaacactcctgctgtcgtctgaatgtttgtccctcacacaggattccagaatactactacgagtgtctgaatatttgtccctcaaagagaattccagaacactgctacgaggttcggaatgattgtccatcacataggattccagaacactgctgctgggctcttatgtttgtccctcacttaggataccagaacactcctactattgtctgaaagtttgtccttcacatagagtatcagaacacggctacgatggtctgaatgttcgtaccacacttgggattccagaacactcctgctggagtctaaatgtctgtcccttacataggattccagaacactgctacgtggatctcaatgtttggtcctcacagtagcttccacaacactcttgttggggtctgatatttgtcattccattggattccagaacctgctacaagggtctgtttggtcgtcccttccctaggaatccaaaacctcctgctgggggctggaaatttggccaaaaaattgggatccaaaaccctgctaccaagggtttggttgttccccccttcctaggactccaaaaccct

SEQ ID NO: 18451 - DNA, 863 bp, Homo sapiens
  misc_feature (1)...(863): n = A,T,C or G
aaaccctacanaggtggcnctntaacaacacanctttttgtgtgaacaacaacgatttgcacctatggcaagtaaacccttcagcactacgtacacagctttatttttaagcactacatatctgcatttttacctggctttacacaatgagataccaaaacaatgtataaataccaaatggaataattaggaagatatgagacatctttcctagtgggaagaagacaaatattctatatggcatgcaggctgccaatgagctaatatggtcattaagttaatcttacaaactcagagaatgaatttttgacactacttatctggcaaatgcatatcatgccttatgccgtctctgggtattcttgttttaaaagctccttgaaatcaggaacggggccttacatatttttttcatattgcccgaagcacctagtgcagaccttgtttagaagatagatgtttgactgattcgttgaaatgggcacatgatttgaacaatgcagctgtcaatctgatttcctcaaaagaatattgggtaggccttctctctaataacacatggatgttcgaattcaggccaaagtttttaatggtcacaaattagcctcgacatagaggctctcaggctaaaatttgcaagagcaaactcatacgaccgtacctgcttgaacacttcttcatcctggtgagtggctctcaccagctccctgatgaatgcctatgggacattcctatccatatataccgcactaggaaagacggttgttgcagggaccttgcggacccatgacattagggacggggacagaaactaatttattacataagcccgttgaaaggctatgccaaacaccaactgcccg

SEQ ID NO: 18452 - DNA, 855 bp, Homo sapiens
  misc_feature (1)...(855): n = A,T,C or G
aagtcggttacatgctcttcaggtagatactgtgtgngcttaaataaaataatcaagtaaaagcttcacagagagcctggctttcagcaggcactcaatacatggtaacgatttctacatctgcagttcctaaagcagctttcacgccaccccccagggcagctgtggccacagaattgaggcataatttggacactgttggtagaaacagcattgggtaactttattaaccaatttggttcatccttattaaggaggagagctccattcatgccaaaggcttctccaagcccttcgcaaataaccaggattcaacagcctgaactcccccaagaatgactccgtgccagaacacagcacaacccagcagtgtggcccttcctgattctcccatcctccttgccacatgggctgatggaggcttaggttctgtggctttaccgagctccaactctcttcctgcacttgagcaagagcacttggtgacctgntgagatggtagaaatggacacaagccctgactcctggaaggagacttcagacttgcagcatgtgcttaaaccacaggaaacggtgtggctcacaagtggtctgagcccaggaatgatgaaccccctgatgctgggaagttatctcatccagttacctctgtgacatttgggccatggagccgtggacccagttctccaggaacctctgcctgagcgactgaaagccctcttgacattttcctttttactatacccctgggatccttcctgaccacccagatggcctgcgaagaaaaaagcttcgcacattttgttaagacctttcgataaaataatatagataatagtgtaaagggagcctgcc

SEQ ID NO: 18453 - DNA, 351 bp, Homo sapiens
  misc_feature (1)...(351): n = A,T,C or G
acccttctcaattgccgacgccccctaggccctnggntnnttnctcgcctctncccacgcctngcctngncagcctnncaccaggnagngnntgnagcgcatgcatnanacccagntcgcaccgcaaacaccactacatcctctncacacacccaccagcncaccagccnanagctaagtactgccccgcagtcctttatcaccgctcgcgcaccacctcgcctntctnngtcngcaccctactcgcacctcantctcgccatgaccgggngcctcccctctcgcctctcncnnctcnccnncccccagcccccccacttcaccntgatcataccgcccccagcnactatt

SEQ ID NO: 18454 - DNA, 840 bp, Homo sapiens
ggcttctagtagcacttggacttcatcttcactgcactttgtgctgatggtgtccaactcaagcccacacatgatacttttccttattctcccagaatctctacactgctgaagtatggggttaaaatagaagattgttgacagatagcatactggatgtaaaggagcacatcttgggacaaaaagaagagctctgaagaataatatttcttgacagataaaaattatctgaaatgcaagtttctgtgtccataaatgttttattgaaacacagtcatgcctcttaatgtctatattgactgtggctccctctactctacaacctcatgccccagcactcccgatggatatcaccgccctgccaagacattatctttactattccgtcccgcaagatttcctcccctgactcctcctccttcccccgttccctcttcccgtcctattcattttcctcctttcaccatccaccgcatccctcgttttgtatccccaccacccccttgcttcctctatttccccctcatttcccaagaatcccctcctttcctccgtcccacttcctttccctatctcgccccccactccagctactacctccccgttttcttccccgcccccggtttccccatttacccctccccccatttgtttccgcccccttttttcccctcccctccctcccccccccattcccccccttcccccccccttcattcccccctccccccccctccccctctattccccaatccgctcatattcctccgcaccaaattcccccccccgcacaaccatatcccccccccccattccccccccccccctccacataccccg

SEQ ID NO: 18455 - DNA, 886 bp, Homo sapiens
  misc_feature (1)...(886): n = A,T,C or G
tatttcagaacattcacatnaaccatacctgcctttcaggtaaaactcaatggggctcactgatgaaacaaagcgagtttgcaaaaaaagattcgacatagtcaattctttgtactcttcagtgatggtagctgccttagtggaaaatgtggaaaattaccgattggggtctggaggctgaaaaatccaaaaacaaggctctggaagattctgtgtctgataagggcccactttctcattcatagatggagccttctcactgtgtcttcacatggtgaaagggatgaaggtgctctcttaggccgcatttataaggacactactctcatgacctaatcccatttatgagggctctatcatcatgacctaattcgctcccaaagacaccacctcctgattcgattatcttcatggttaagatttcaacacatgaacttggaggaacacaaacattcagatcatagcatggactatttgttattagtattattattatttcttaattacaagtttaattaaaggaaccaatagatagggaatacagccaagtttgtttacaagtatgaagaaccatcagtgctacaatcacaanaaaataatctatgaaaccactgttgaaaatatttttatgttatattgtaaaaatcactgaatttataccagtgtttatggcaatatttgcccaatttacaatcgaattatgttggtactttttatatgacaaagagatatacaagtcgttttgttctataaatataattggagattaaatttagctactgaatacaaatagccttttaatgtataaaaactggtaccaaacatttcaacaaacgggggttgagtttttttcttcccagtttaaaccttaataaaaaatttaaat

SEQ ID NO: 18456 - DNA, 875 bp, Homo sapiens
  misc_feature (1)...(875): n = A,T,C or G
ccgtgggcggaaaatccctctctgcccagctggacgcctggtgcgatctcggctcactgcaagctctgcctcctgggttcatgccattctcctgcctcagcctcctgagtagctgggactacaggccccagatgaatctttgtacaacaaagttgagaatcatagccctggcgctcagaagacaggaaatggttnctctggatcagtnctttgttttttgaaacgagatgatccgnctcacactgaaagntnnctatcgtgaggtnnagtgnnatnnagagtnaaccggatgaagnataagcgtnnancgaggnatnnnnacantacagaaagaagaggcaggataaagaagggnnncccnatctagccactnnnnnnnnnnnnnnaagaannnnnnnnncnaggnnttnncnnnncntctttnttcagtttccctttcttccttttccttccttttcttttttcctcttttcttttnnntccttnnttcttttttttttttctcccttccccttcccttccctcctcttccccctttttttttccttctcccccttttcctccttttttctttcntttcccttctccctcccccttcctctttttttctttcccctttttctccctctcccccntttttnctccttttccntttttccttcctttcttctcccccctcttttnctcccttccccttctcccccccttcctttttctctctcttcccttcccttttctttcccccctctccttttcccttcccccttcttttccctttccttttctctttttctctttttctctttttttccccccctcctctttttccttccccctcttctctctttcctcccccctctccccacttatacaaa

SEQ ID NO: 18457 - DNA, 1085 bp, Homo sapiens
  misc_feature (1)...(1085): n = A,T,C or G
ttgagagccaaataaggggaacacttacncgactggctgcatnctgtgctgggcgaaggaaaacggcgagaagcagnttgctctcatctggagaggatctataggcataggatgatgctagtggnggggcagagacgcatcacagacgagtgggactcaggtgcagctggtgtagaggcgaaggaagaactaaacaacactagagaagaagggagcggacattgacgcatgggcgtgtggggagggatagtatgaggacataggtgggggtggtactgcggtgacggggcggggtgcggcgggcgcgaggggaaggaccgtgcgggggggggggtagtaagcgttatggagtacagagggaggagcgcatgtaagaaacaagaaaaagaactagcagagaagagcacaacagaaatgagtagtaatggaaaaagaaaaaacgaagcaacgagtgggagctagggacgcggctggcaccgaacgggagagtgtggggcaaacacgtgacacttgcgggagggggggagagagaggaggaaccgtgaagtaaactgcacccagctaccactcccaccccgccgccgcccaaccccaaccgcacagagacccaccccaccagccaccgccacgggatctccgatcgcccccaacgcactgcccgactgagctcgcgctcgctccgccatcagacgtcaccaccagcgacaccgacccccgacccccgcatcacgcacaacagcccgacggccacttgcttgcccgctccactcccacccgccgccgggcgcgaaggcacggccccgcccacagtctattcccccgacgcccacgcacaacgcgacgatacccacccacgccagccgccccaccacgccgctcgcccgccacccccgcacaagaacaccgaacccaacccggcacgccgccgccgccccgactgcgcgccgtcacgcacaccccccgcaccagcccccccctcaccctctcgccgcagntccgcgccatctccccccacccccgctccccccccgcccgcggcccctcgcccactctcccacccccacgcctacgagtccgccaccccg

SEQ ID NO: 18458 - DNA, 939 bp, Homo sapiens
ccatcaatttaagcaaaaaggaacactaccactgctcatcttctggaagaaaggaaagattcttattcaggatttagctgatgtctgtggccaaacgatacaacagtgaccagtcactgttagacgaggtacctcacacctgcaaaagcagccacttacgatagcgttgccaggataatatgggacatattttgatgtactgggtgcgggcgggtggggaacataaagaagacctggagaggaggtataaatttgggtgcggggggttgattagtggagggggctgtggggagagacggatctgatatatgatatttatcacaacaaacggtatcataccccgctttacaaggacccgcctgtttaacgtatttttcttcacccccctttccgcctttcctatccccgccgccaaaacgcgcgccctcgcatccgcccgcccataagtatgagccgcgcatttatccccgttctcacccgccagatccatcagcgcatcaaactattccgcacgccccctcaacccgctattgcccccccccacccatttccaccattctcgcccctgagccgtttaattatcgtaaaccacgagtgtaacgcgtcatacccctccgatcccccgtggtgcccgaccctcacttcccgttttccacctgccctattttaaaattgacggagcgcggggccgcacgattacatccgcccctcgaattaccgcgttcacccctataccactataacaccgggcagtcccccatatcagcatgagtatcaattaatcccactgtccccctcgttcattccatatcgccccctccccatcgcgcgtccaaaattccccccctctacgctatctccgatacctctcatgattcacccgcctatcgcgcaactgggtcaccccgatggtaggcgtgtgagtaagtactgacgagt

SEQ ID NO: 18459 - DNA, 1854 bp, Homo sapiens
  misc_feature (1)...(1854): n = A,T,C or G
ggaatagtgtttggggtttagtaattttgattatcggatagggcgcagggtgtggggcaactaggattgacaaatccagaaagttagcaattaagaaaccaaattagttaggggtgctgttggcngcgagggcgggcgagggccgcgcgccgcgcgcgccgccgcggcggcgctcgaccaccacggcaggtgtaacgcacctgcgcttgtcgccgcgtagtggaattgtgtagggtagggtgtgccatgcgtctatgttaaagggtgcgtctgtcggtggagcgggcggcgcacccatgagacagggaaagagaaaagagggtgcgagaagcgggtgagggtccaccacgctaccctagcgccacgcgctcgccctacaatcattgttctgctgantgtaatgcatgccaataccggacgattcaattagaaggaattaatcatacaagcgtgggcagcgagactcactcataaagatacaggaggagcaaatgcaagttcagtgtccgctcgtaagaagtgaagcacacagtgactnagcgcgccacagagcacaatctactcgatgatcgcggcaagtctgtgagcgcgcgcgatacaccacacgccgcccgacgctacacgcctcgacgatcgatagcagagaagatnagtagtgtatatgtttgttagtgtgtgcccggttcgcgagcgggaggcgnaagagcaaagtgctgttcacgcgacgtgacagcactctcgcatgatatcttttgtcgttttgtgacaagctgagtaaatgaggcagtatacaccacacatacctctatcttatcacactaaaataacaacattctcacattgtagaaattactctctgattccaccatgacacaactgaggtgatcatgtgcggtcgcgatatccacaggtcacacagtatagcgcgacatactagatatgttgcgcacgcatacagacgccgctatgacagctgatgtaatactcgacagttttcgatgggatacngcgcgtcatgcctgactaaacgctattcctcgacgttcatcgcgcntgcgnttctgagcagagagcagcaggagtctatgacgnagagagagtcgtcgactacagtacgacggatgcgcgaccacgcgcacgcgcagatcatgactatgccctcacctactcgtataggcgagcgcgttcntagtcgatatcatcagtgtcgatggtggatcactcgtgnggttgagccagcagtgagaaacgtnttcgagtctatgcatnacgaacggcagatgaatgactatatncggtgtatgatagtcttcactgcgcgctgttattacaangacacacgcgcgcacaatattccaagctgtcgtgtgcggtagacacgtacncgagtagagtgctgacgacgtagcgatgntnctgcatgcggantgacggtcgcatcagcatatcgcgagtgagcgtanatcgactcagcggttaataacacgacatctacactatcantactacttcnttatattatgnacatanacgataccgtagatagtagcgacggatgacagtcgcgaatgagaangcagagacaagtgacacggagacagancggacnaganagagatggatagccgatcgcatatacgacctgacanagaaccagacaatatgaattnatcgagcgccgcattgaacgacagctgtgaatatcacatnatctgtgttactcacnagtacatgtgnantatatggtactatgcagtcgcnatgtatcactgggtctctgcgtngtncatgttcactcnctncntntccacgttaatcttcagcgtcaatcagntcatatacgaactgactact

SEQ ID NO: 18460 - DNA, 328 bp, Homo sapiens
  misc_feature (1)...(328): n = A,T,C or G
gtgccgactagtaatgaattaacatttcagaatgacacatcctgggtttgggtgggtcctaaatccaatggcaagtccttagaagagacagggcaagaaacagacacaggnggagaaagccatgcaaagaccaaggcaggattgaagtgatgctgccacagactaaggaacgcctggagccaccagaagctgggagaggcaaggaaggattctcccctctaccctccagagggagtgtatccccactgacactttgatgtgaggcttttggcctccagaattggaagagaataaatttctattgttttaagccataaaaaaaaaaaaa

SEQ ID NO: 18461 - DNA, 169 bp, Homo sapiens
aggcagcaagctgttcctttcatcacgagagcagcattcaaggtaccatacttgggtagcagaaaaccaggcgccttaccagacaccaagcctgccagcacattgatcttggattttgcaggccccagaactataagaaataaatttcttttcttgaaaaaaaaaaaaa

SEQ ID NO: 18462 - DNA, 156 bp, Homo sapiens
  misc_feature (1)...(156): n = A,T,C or G
cagtctgctgcatacacagtgagcaggtggccatctacaagccaanaagagagccttcaccagaaatggaattggctggcatcttaagtttggacttcccagccttcaaagctgtgagaaaataaatgttgtttaagccaaagaaaaaaaaaaaaa

SEQ ID NO: 18463 - DNA, 199 bp, Homo sapiens
  misc_feature (1)...(199): n = A,T,C or G
gctccagtgctgctttctttactgnaatcttcattctcacaagcatctgtactaatccggtagtacagatgactaccacaagctcctgacttgcatcctgctttgaatgttgatggatatcagaagtatggttgcttttgctaccaaaacaatttaggttccaaaattaaaatagtaaattagaataaaaaaaaaaaaa

SEQ ID NO: 18464 - DNA, 401 bp, Homo sapiens
gccaacaaacggcccccctatcctacccccccccgaattccagttttgggaaccggactggtttccttgctcctcattgcaaagggctatcgtgggcattcaccttgtgatcatatggagtgttacccagactggagtgccatggtgtgatcttggctccctgcaacctctgcctcctgagttcaagtgattctagcgcctcaaactaccaagtagctaggattacaggcaccacggcaccagacccaagtaatttttgtagttattacaacagacaatggggcttcaccacattggccaagatggtctcaaactactgacctaaaatgatcggaccacttaggactaccggagtgctacaaccacgggtatcaccctctgcccgccccccgtcactaccg

SEQ ID NO: 18465 - DNA, 1761 bp, Homo sapiens
  misc_feature (1)...(1761): n = A,T,C or G
ctnggggntggatacnncaaataaccacttnnncttnntnanctantnncganncntgncgagccntnngatnnctntggnnnntacntacncctcncagnnntnctcannccccaagnctnnctncggcgnctccggaggactcaccncccannnaccactcggnagcagnctnggctcaatcnaccnccccnttnggatcngccnattaancataccttngganaccnagcantcgggcgaacatccagcatcacgagancacccttnttngggacatncgactcnattcntgagctcaccttnacattacgacccgattggcnggcnacngancncgtagcggtctaacccatcggncagncagccagccatgcatacgantcctcgncacagncataaaacgnatcacgccngctcntcgtcgctagctcgtcaatacgcactagatcgtccattgctcntcgtnctcgcncggcaccnagcccgcgccgctcagcgcaaagcatagtcgaaagcgncgccagctctggcgcgtcagcagcgtcgacgatgtgnccggagcnctggccacacaactgancacaccgcgtagtctccagcgtcgcgaacgancgcacgacgacgagtggggcatngctcgactcgacgtgcactgcgntgacgtggccctgtgtagcgatgtcgtgtagtaacgatgtgacgcgccgggacgcgccgctcgaccgcacancacgcgcgctaacatctcacgcgcgcagcgccgaatcccatggcatcaccactcgtctccccggctacgacgcctcacaacgccactncactctatcctcgcatagcatagtctcgccgacctactcggtcaccgtcctctccgctacgtcctacgctctacgtcgccgtgcccgacgccaggccgatcccatactgtctcgcacgctgacgtcgcgccgcgccagcctccgcnccgcacggcaccccgnccgagtcacagcgcacatccgccngatgacacatctntaccaccacctaccgcgcactgagtagcgcgcgctccgtcgcacgagtgacgccagcacgagtgaagnaatgccgagacgtgtgactagcgtcacccntcgcagtcacacctccgtacgatcgaccgttcagcgtacgctccacgtctcatgccgccgtataccccctccgcgcatgacgcaacggcagccactcgcgcccactatgtcctcacgagaccccgnctcatccacgccgatcacgccccctcgaaccgcggtagctcgccgcgcccggctacgaacaacaggcgcccgcccccggcgtccccggcgcacgcgcaacgcacccccccgcgcccacgccctacgcgcacccgcctcgcacacacccaaacgcgcccacgccacacacgcaaccgccaagtcgcgcggcatgacaactacacggacgtcacacgcactatcgccgcctcacctcgtttccgcgctagacgctccccgcgaagacggcgccacatagaccccgcgccacnccccatccgaacccaaccctcccgaccgccctacggcgcgtccgccgtccccgcccgtnacctcccccggacccacccccaccggcgctctccgcgccgccacacccacgccgccgactcccactcccatccctcctctcgcggtccccagccgtccccccgcgccccgcgcacgcagccctcttaccgcgcgctccgtgcgcgccgactnacccgccangcgccct

SEQ ID NO: 18466 - DNA, 1041 bp, Homo sapiens
  misc_feature (1)...(1041): n = A,T,C or G
cagtcaagaataccacatccaaaaggcgatttggtatccccaggcatcggcattggtagaaaccggacttctcaacattccagaaggcttaacttgcattccacattatgccgaacttcactttgggctgaaaactgtcacagcgcaatatgctcaaggatgtcttgccactgcaagactattacaccacttacttgaatgcattcaaacatttataagagcaactgaaccttactgacaaataactttaccaaagacttcgaacttgtagacgacatcaccattacgggcgtctgctcacaccattcaactgtaatatagccgccgccttgcattgctgcatccgactccaccctctcccaccctccatcgtctgcactacttactcctacacaccgcctccactaccctcgctcaagacgttcacttatcacatcgtcccccgcccaccacgcttccccccccatctccgtgcaccctttnaggatnagacnacataataccactaccaccaccacgtatctcctcatcccataatacacaaacgtacaaatacctcctatacacatccccacctcgcgcgtatccccaatcgactccaacacgtgccacatactataactacacccatctacgtctctacactcctttagcgcccattccgactcgctcaccaccattcagcgcctctctccacacaacccaccccctccgcgactaacgagcaacctgtaaccaagcacccaaccaacgacaccaacaaacgcccaaccacgtcatctcacctcgatttcacatgatttatcgccgctctcggaccacgctgtcctcgctactaaaaaccgcacccacctctccacatcctcccacgacaacatcgttcactcctcactccacgaccctactacgcctaccgctcaactcacttagaccatactgccaccctacgacgcaccgtgagtcaccccaaccccaagcaacccccacacgcacgacgaacacctccatacacagtctcacatcacnctacagccaccacac

SEQ ID NO: 18467 - DNA, 587 bp, Homo sapiens
  misc_feature (1)...(587): n = A,T,C or G
cacagagagttccgaggaggctggagcacagaacaanaatggttctgttctgncacgcggtgatatgagcacggcctggggactatctactgggtagagactgactgactgggaacacggactgctcgctagtgagcgtagagatctgccctggagacacagatccatatatcttacttaggcactcatttggtgcatagtctctgggaaataaacttcactggttatgtcaggagagagcggtgtaccagttattgatcatcacttcccttagaggagagactgatcctgattgactgtccctgccacgaaggtgtatcagtggactactacgcacacacacattctgcaccacattgtccagactactttttattaaacataaaagacggagtgtgatgatccacaaataatgagtgatttacaaatggtactactattactttgactgaaacaaaaaaaacttaaatgggctaaatgaactaaaaccagaaactctacaaacgataaactatcacgcggatacgcaaatcgcactgaactactaacaccctaacctcacaaccaccacctacaaaccgtcccaa

SEQ ID NO: 18468 - DNA, 954 bp, Homo sapiens
  misc_feature (1)...(954): n = A,T,C or G
cccccagaggtttctccgaggtagtgntagaagcggttaaaattatcaccatgatactaacagcagagaaactagtaaggatgagtttcgctacactttggtnacctgacagaaggaactaggactccaggnatgggtatctaaatcaagctcaagtccgatatgagaatacacctctggaagtggacatataacactgttattcgaaacgatctgtagcttctaccttatttatacttctcctcttgcattaacaatggctatgattcctaatttatgctggatgaagcaggcttcttactgctctctgctggggttttgcttgtactcaatagccatattgaagggatttattttataactatgcgggaattagaggtaaattaaggtctatttgtacaggatgacttacgttgtgagaaacacatatggcctatcacgtctgaagaggtgaactctaactgactctttcctttgatgagggttaactccggcctcctggtccttgactgggtacctctgcgcgctcttctgtttagagagggataatttctgtccctagctctctgactggtatccctaggtcgggcggttgcggagagcggtatctgctacctcacgggccgcaatacggctgtaacacggaatcagtgccactgacgctaggcaattaattatcgtgaagtctacccgcggcccctctagacgggcccatggacaacctaatagaagggtcaaagtctgcttggctggtctctattcccttaggcctggcacgtctcccatgtacccagcattactccccattggaaactttgctccgggcgtggttacacccggcccctctatgtttgaggcatgccttgtccaccttgttgctgctggaaggccttacctttctcaccctgccgtttaccgaaacttagccgccttttacctccggataacccccgg

SEQ ID NO: 18469 - DNA, 901 bp, Homo sapiens
ccgagagattccgagagagacagcagtaaacatagtatctggcataccagcatagcgcacacaagctctttgtgagctgattaagcagggagagggattcggccaaacagcccccatctctacaggaggccaccaggatgctgctctcacctcgtcaccaggaaccagagactacagaaaaagcaatgcagtgtctcattgagtttgcctaccatgagctacccctacctttttttgtttctgattcctttgttgctttaatccatcatgagaaagccataactgatgaaatgacagcctgtaaagggacctttacagtcacggaaactggactggaagacatggtactcacaacacctgcgcatgcccctcaccacgaccatgcctcccttcagacacccccccacccccccgtgccctcccccccctcaccgtccccccgctccggccaccccgttctcccgccgccccgcgcctctgcgcccaccgcgcctacaacaccctccccccgacatacccacccaccatacgttcgcccccccctccactcccctccttccccaccagtaccctcactttcccaccttcgtctcatttctcctccaccccgcccccccccactcctccgcggcctccacctccctctacccccccaatcccattccacgaccacatacatacctccacgtccacccggtaactccatcccgtacgccagattcccacattgtctaccccctcctaccacccccacatttacgcccactaccgtccctactcatccctgacccctactccccacccctaacccacactccgccccccccacgcattaccacaccaccccagaccacaaccccctcctcttaccaaccgatcggacatgcacggttgcaatcat

SEQ ID NO: 18470 - DNA, 905 bp, Homo sapiens
ttcaaagatcttatatgttgcagagactgcggtgcaatggcgcgatcttggctaacagtaacctacacctaccgggttaaagtgattctcctgactcagactaccgagtagttgggattacagacacacaccactgggcccggaaacactgtgaagtaagcatagttggaatgcccaagcgaaagaccatttgagtattgacaagtggattggagacaggactactacagggctggccctaggataacgcattctacgccggcgattcacgtgacttgtggctgcggcttgacaataccttctacaactattgcgtggaccaagctggataaagatgaatgaaccacaccacccgctgcttcgactggcagacccacctccgacctcaatatactgctcctaatctatcccacctcccacccgcccgagctgtagacctgtttcctcgttccgctccctgcccctctccaatgcccttgataaccaattcatatcctacataaattccgctcgcccaaccaccgcagtggtaagaccaccaacaaccattaattcacacatcaccaaacagagagctgcatcggccactggcggcagagatgagcgtatattatcaatactcgctcttgctacatgtttcggttctagcaaccaccagcacacagagtacagcaataacgtgcctcatgccaccacacatagactacatttcaacaagcgttgcagccagtcacgcacccagaacatgaagcatttgcctgagggccgaggcgccgccgcggctaccggagtagcaccatccgtacccctccctcttccctcacatccactatcttacttcaccgtacacgatccacacattaattcgcggtcctgctagacaatctgccagttttcgctaaact

SEQ ID NO: 18471 - DNA, 1348 bp, Homo sapiens
  misc_feature (1)...(1348): n = A,T,C or G
tttgttcggtggggggggtggtttttttgnggnnntccgtctcggcgctctgcgtcgcacttttctaacatcacaggggggcggcgcggaaatcccccatctatctagaggaggtgatttccgccgctgtttccttgcgcccacccgtcttggtctttgtgagcgactcctccggcagaaaacacgaggtgagcccgagacngcgaagcggacacaacaagggccagaagagccgccccaaggaatcagggcttgcaggacaatacacttcgaccacacgccatccgcagcgagagagcgaggtgggaaaggaggcgcagagacaaagtaaggggaacagacgataacatatataaaacagtgggaagaggagatcgccgtgggtcgcgtgcgttatcatggtccgcacatgtgaaccagccgagcaaagaaagaaaaaacgaaaagataaagaaatagacaagagagcacaagtaaaccatagtgtgagacaccaaaacgcacagcaaagagagaacaagcagcagagaaagacaaaggcgccaaaggcagcaccgaggataagaactgaacgcaacactataacaggaatcaaagcacatcaaacaacagaagagaaaatcaaaccgtacaatatacaaatagacaatgagagaggagatgaagagaagcaggaatagaggcgtaaaacaataacacgcgctcgaaaataataaagggagaacaagaaaataaagccagtggaaaaacgccataaagggaggagcaaaaaacataaactgcagggtaagcagaccgaggtcaggtaaaaaactaacagatgacgtcaaggggagaaaatacaagataaaaagtagtagcaagtgtggacaagcaacgggtaggggggcgggtagatgggacaagaaagtgcggaaggtatacaccggcgaacgtgcgtatagaagtgaagcgagctgagaaagaaaatatataaatgttaagggccgaaatactgatgaacagacgatacaccaatagcacatagtgtacacgacgtcacgcacaacagcaggtcttgtaccgatgtaaatcacaatactgacccagaagcatcacgacatcaaaccgtgcaatagaatcgcagacaatagaacgttagacatcataaccgagacaggtgcaatggtgtaactaagctcacaggcacaacgcatcaacaagtagacgatgatatgattaacagagcgctggacgaaggaaagagtaaactcgagagcactagaantgatacgcagtggagacacgacatagcgagatagacatntgntcgcagacagcgatatatacatcataacgaacgagcgac

SEQ ID NO: 18472 - DNA, 196 bp, Homo sapiens
  misc_feature (1)...(196): n = A,T,C or G
cggaggcacagcaacggccngcnnngtnngtttttngnnnngnnttcgantaaaagncacaggaacaccanagnagtttttcttcaactctgcacagctattgactctatattttctgaaggcaaaaatgcatnngtttgttagaaatgnngaaacagaaaaacattaaaaagttcattccttaaaaaaaaaaaaa

SEQ ID NO: 18473 - DNA, 175 bp, Homo sapiens
cgctaaatggcagcagggaacaccagggaggacgtttttgcttgcaactgctggcacagactagttggactactgattattgttgctgaaaggaacaaaaatggcatggttgtggttagcaatggcaaacaggaaaaacagtaaaaagttgcattccttgagaaaaaaaaaaaaa

SEQ ID NO: 18474 - DNA, 1584 bp, Homo sapiens
  misc_feature (1)...(1584): n = A,T,C or G
gtcccccggggggncgggggngnnnnnnncnnnccctttccgccntttggcgctttatttcttttttcgccatattgagtccactcgttgtgcgcgcagttcctctatcccgtctccgcccctcccgcgcacttttgttacagattttattggctaacatgtatctgttccgcgtattgtaaagtagacataatagacgagtgtgggtgttgngtctagttgtaactatagtaacaaacgatatattcctcaacacattatgtccactcgtgtcggtgcgaacggttgagtatggtatgaacaaggagatgtgtatttggtgggtagggcggcaaaagttaagttgtagttgattatctatttattggttgtttcccttctctgccaccgctgtcaggtgctgtgcttatccaatagttataatacaccccattttgttaagcggagagatttgtagagacagtaatacagccccgcgcggaggacgaaacgaaacttgtataagaagtaatatgaattgtagaaaaaaacacttacgtaacgagtatgtgtgttctgatataccgtcaagcactctagatccgcggctggccattgacgatcgacgtgcgctgtcaggagcgcataaccgatacgcgctacacgtgcagataagagacatataagtatcaattctttacaagtcagcccaacgtagggtgccaaatatgatcatagcattgtggtcgagcaaccgtggagagaagtactaatgagcgcactagtgctcaggaaaaagcaggatagacgaacacttgtcaagtctcttagtacaatagactcgtatcagtggcgtgaggtagcaagtggtttcccgttagtcgagttaagcagtagatgtaatacaatgcaagaaaaaacaaatataacaacgaatagtgaataagcacgtgtgggtaagtacggtggtagggtggtgacttcatgtgatgtcagtcccgagactgtagttggacacttgacggcatttcgccgccactcgcggcacgagcatgatcgggaacccccccaccacagttactctgtggtgtagactgactgtagccaccgaaaagaagagatcagagacagactgcgcgatgcaagaantacaaatgccgacgacgagacgacattacggcgtgcgagcngatcccgcgcgccatgcgcgcctcgaagctgagtcaggtgctagactattcgaaatagtgtgcaccacatccatcaaccaacatatatgtacacgaacttntngnactgttagtgtgagcagtctggcgcaagtgtcgccctataagnngagatagttgaatactcagacagatgcaggcacgncacacgnnggtcantatagatagactcagaagagaggtagagagacatcactatgcagcgagtgtatctactcacatacgacgcgtgcgactatcgntgataggtatgtcatatgagctagtgtatatattaatagtgcacacgcacgntggcgagcactgatcgtacgcagcgacgactactatacaacagctgcggngtattaatagtagatagcacgcaancgatcgt

SEQ ID NO: 18475 - DNA, 1457 bp, Homo sapiens
  misc_feature (1)...(1457): n = A,T,C or G
tacgtaattaacacggagagaantaaacacaaaaccacgtcaagacaagacaatactacggacacagtaattatgatagtatcacagagctaacacacagcgagccacgcgtttctccttacaactactgaaacaacatattgaacatctgattatatcnctgcaaaggacaaaaatgccatgactatgtttagcaatgcgtaaacagcagaaaacgtctacagaaaggtacattcccgttcaacgaaacaaaaaccaccgctacgtagacgaacaacgaacaacaagaacaaaaccgacacaatagacgaacacataataaatcatggatctatcatccggcctcctatctagggtaggaactatagactattcctctaaccgcttctgatggagggaattacctccgattacagttcccgagaatgcccaagaacatcgcgaagcaaccttaaccacaccagccacagcgcagatcccacattgccaagccaccctccacctaccaatccgacatgatacaatagcgaccatacagacagtggaaaaaacagctgacgaccgtgcacatgacgaacacttataaatatgtcatcgacgcaggcagacgcaaccatgaagatcgttatacacagtactagcacatcacaagaccgatactagtgtagcacgcaaccacaccatctagaagcccaaactctcatacccnctcatctgactcgtgatagcctcagtcacaataatctccatatacacaacaacaagcactccagacgtcacagcaggcgcgagcacagccagcactgcgttcatacacatcgcccttcactcaaccaatatatctttagtacagatatcactatactctgcactcaagacgtaacaccatagaccatgaacgacacacgtacgagaccagaccacgccccggttcaccagtccccgcacgatcaacgtcacctagctctcagcccatcacactacccantacgactatctcctgacgctcatctagcgctaaccaccgtcagccgtccacatccccacccacactagcacgcagacgtcacagatgccaggcgcgctatagaagcatagccacgcagtcagcagcaagcacgctctccatacctaatatattgcacatattcaacataattatccaagataagtcagaagcctcatnactacgncaagcacacnacactgtacatagaccactatccagacatgacaaccactatcacactacaacctcaccagatactaccacacagtccaacacaccaanactatncagcgcnagagacactaccgcactgntaagcatacgtcatgccactacggacacaccatgtntctacactgacgctcacacgccanaccncntganatctatgatagcacactagagtcacnatgcacgcgtgacgttcgctaacagtatcacggcagac

SEQ ID NO: 18476 - DNA, 147 bp, Homo sapiens
tcacctaagaagacaccgagggaacaccatgagtacgtttttactttcaactctgcacagctattggactctattattttctggaagcaaaaatgcatgttatgttaggaatgggaaacagtaaaaacagtaaaaagttcactcctt

SEQ ID NO: 18477 - DNA, 158 bp, Homo sapiens
  misc_feature (1)...(158): n = A,T,C or G
cccatataatgcgactaaatancacgagggaaaccanagnagtttttcttcaactctgcacaactattgaatctattatttctgaagcaaaaagcatgtttgttagaaggaaacagaaaaacattaaaaagttcattaccttaanaaaaaaaaaaaaa

SEQ ID NO: 18478 - DNA, 169 bp, Homo sapiens
caacacatacaacaatgcaaatacggagctgtaacagtgaagcagtatggaataataagcccctcaccttcaggaaagctgccctgcagaattttccagaccaacagtggtactttatgtaaatgaaaataaaattaaataagctgctgaaaaaacaaaaaaaaaaaaa

SEQ ID NO: 18479 - DNA, 152 bp, Homo sapiens
  misc_feature (1)...(152): n = A,T,C or G
cgcgtataatacgactaaaancangagaaaaccanganagtttttcttcaactctgcacagctattagatctattatttctgaagcaaaaagcatgtttgttagaaggaaacagaaaaacattaaaaagttcattccttaaaaaaaaaaaaa

SEQ ID NO: 18480 - DNA, 311 bp, Homo sapiens
cacactaggttgttggcctgatatttgggagaattcacacatatgctagatttgacgcttggtagggttctggtttttactacaaattacaacatgtcaaattgcttttactattatcaattaattaataaatcaatactgttgcatagagaagaaataactgaataagaagatattcaaaagccactataagttacgtcaacatttttcatgttttcagttaatttaattttgaccttcaaattgcaaggaaaattccactgaagttttgaaatttgaaattaaactagtaaaacccaaaaaaaaaaaaa

SEQ ID NO: 18481 - DNA, 270 bp, Homo sapiens
ttctctccaatttcccttttattgagccatttgaaagcaaattgcaacatgatgtcactctgcctcttaatatttcagtatttattgcctaagaataaagacattttcctacattaccacaataccattttaacttctaagaatttaaaagtgtcacaatattctataatatctaatataaagtgcatattgagttttcaattgtcccccaaatatttttcaaattataataaattgtccctcaaatgaaagcttttaaaaaaaaaaaaa

SEQ ID NO: 18482 - DNA, 144 bp, Homo sapiens
  misc_feature (1)...(144): n = A,T,C or G
tttctgactaaatgcacgagggaaaccanagnagtttttcttcaatctgcacagctattgactctatattttctgaagcaaaaagcatgtttgttagaaggaaacagaaaaaattaaaaagttcattccttaaaaaaaaaaaaa

SEQ ID NO: 18483 - DNA, 233 bp, Homo sapiens
acagggttccgggtgggccctaatcctttgtcttatagaagtggaatttggacacaaaaagagacccagggcgtatgtacacagagaaaagacacgtgaggacacagagaggtctgcaaaccaagaagagaagcctcagaagaaacaaaaccagccaaccccttgatcttggacttgtagcttccagaattgtgaggaaataaatttctgttttaaagccaaaaaaaaaaaaa

SEQ ID NO: 18484 - DNA, 172 bp, Homo sapiens
ttccgatacttggctacgtggaaaagcctgctcgtgccttgccttctacgtgagtaaaatgtcccgaggcctccccacaagcctagcagatgccagcatcacacttcctgtacagcctgtggaatcaggaaccaattaaaccttttttctttaaaaattaaaaaaaaaaaaa

SEQ ID NO: 18485 - DNA, 238 bp, Homo sapiens
  misc_feature (1)...(238): n = A,T,C or G
cacaaggctcaatgtgctttctggggattcctgctccctgnagnaacccatccactgnatccaggnatattccccttgagtggcttgttccacacactggaccctacacctctcaggaatatctgccatacacaacaaacagtctcttcgacaccctcctagaagacaccaaatacagaaaaaacggaaagatttaatgcaaagaataaatgtattcatccagtcaaaaaaaaaaaaa

SEQ ID NO: 18486 - DNA, 193 bp, Homo sapiens
cacggggataccaggtatggtgcctttcacatgcacccctgtgaggacacggcaggaagagccatctgtgatgcaggagggagatcatcatcagttgccagatctgggagcaccttgatcttggactccccagcctccaaagctggagagaaatatatttatgttgttcgtaagccacccaaaaaaaaaaaaa

SEQ ID NO: 18487 - DNA, 341 bp, Homo sapiens
aggattcccgatcaaattttgcatggctgcagttgagttgaatcatagcagtggcaacccacagaacagaggaccgtcatttaaataaagctgctagagaaaaccatcaaaattaatcattttaacgcattattgaagagggaaaaataacttgagcacaatgaccattctttctgtgccactggcaaacaatacaactgaatcactggttaaaatggctatcacaaatagcaacagtgatattacctatgcatataatgaaagaccaaaaagtttagtctcctgtaaattccagaaatctgttatccattaaaaaattaaccagatgaaaaaaaaaaaaa

SEQ ID NO: 18488 - DNA, 961 bp, Homo sapiens
  misc_feature (1)...(961): n = A,T,C or G
caggtgattccctggnatgtgaanagggganagatgccagcagaaatatttatctgtgttagttacagggggagtgggttcctgtaaagactttctgaggaatacaacaatgaacacactagacttggaacacagaatgttataatgtaaaataagtgaactgaccattgaaggtgatgaaatgtcaatgagtaacagatgggctacaatggtaaattaaacatattgccccttgcttagggtaggaattgatgataaatgagagggggaccatatattgcatggaaaaagaaaaataaaattatggatctcaaatgatctaaacgaatggaaccttagaaatacaataaaacttatagagtaggggtcattacatggaagctcgagtaactgaactacaataaaactctaatcgaaaatagtaaacaaaaagcgagatgcagatattttatttcgctttttatacgtgacaacctaatgaaaaagtcaaagaacaaacaacaacgcagcattcaggaagtgtagaaaatgttagatgcatctctaagaattgagtatatacgggagcaagaacaaataaacaggaagatagaagagtgaagataaagaaaaaaacaagattatatatcagtacatagactcgccacgtaagagtagcagagcaaaacatggtggataactcaacagagtgatagatctcgcatatagcaagacgaaatagacgagattatacagtaacgcagtgtagtactaggaggagacgaaaccataccgaacatcaacaacctatacagacgaactaacggtaaaggtactcatgaacgcaaactctatattcactagataagatacgtcagaagagagacaaaaaagaaaggcgtagagaatgaaataacacaataaagcacgcacagacacaacggacggtagttggtagtgataggcaatagcgatgagaacg

SEQ ID NO: 18489 - DNA, 213 bp, Homo sapiens
  misc_feature (1)...(213): n = A,T,C or G
cccggggaaccagttaaattctgcttgnatcactaacttcctgatccaccatttacgccggcaaatccatatctgatgctctatcacatgtaggaaacaaagtcactcacatgggtattcaacaagtacactgcttagtgaaatatggatctttaaaaacatactgtgaatttagaaaaaataaaccacacactgatggtaaaaaaaaaaaaa

SEQ ID NO: 18490 - DNA, 251 bp, Homo sapiens
  misc_feature (1)...(251): n = A,T,C or G
ttcccagtatcttaatattattggcagatgacaagtaccctgttaaaatcctgtattctgtagcactaattgaagaaacaactgaagctacagttaccatcttaaaattgaccttaagggaaaggacacagacttatagtgacatcaacccagaaatctttgggttgctactttagattaagactgcctgctttcattcttgttgttactntgaaaaaaataaacctcaatcttgttcaaaaaaaaaaaaa

SEQ ID NO: 18491 - DNA, 133 bp, Homo sapiens
  misc_feature (1)...(133): n = A,T,C or G
cctagaagtcaattaggcacacttgnaccanacttgtagnaggtatttcttcataaactttatactccaaatgggtcctgtcatcacaatctccagtcagaacaaatacgacctatgattaaaaaaaaaaaaa

SEQ ID NO: 18492 - DNA, 159 bp, Homo sapiens
acaagtcttccgagctctgtggctgtattgtaatgaaattgtttgcctctgaatgaaaatccatcacctctcaaaaaaaatgcaaatataaagaaggacttatgtctacaaaacgcaaatgaaaaaataccacctcattccgggtcaaaaaaaaaaaaa

SEQ ID NO: 18493 - DNA, 402 bp, Homo sapiens
  misc_feature (1)...(402): n = A,T,C or G
cgaggaatctccacgagtatccannactgncanccggttcctcgctgggctgttcctgtcctgtgcctggtcaagtgctggggaacctgctcatcatcctggccatcagccccgactcccaactcccaccccctgtacttcttcctctccaacctgtccttgcctgacatcggtttcacctccaccatggtaccccaagatgattgtgcgaatccaatctcacagcagagtcatctcctatgcaggctgcctgactcagatgtctctctttgccatttttggagccatggaaagagagacatgctcctgagtgtgatggcctatgaccggtttgtagccatctgtcaccctctatatcattcagccatcatgaacccgtgtttctgtggaaaaaaaaaaaaa

SEQ ID NO: 18494 - DNA, 228 bp, Homo sapiens
  misc_feature (1)...(228): n = A,T,C or G
cccgcgggttatcgagggagaacacaggtagacctgctcacctctacaggaaccatgccgacaattttattttgaaaagggttcttttaaaaagtcgtaaagccatcatgnatcatagggagatggagacactgcccgatcatgtcatcaaagagttgttttacaaagtgtccagtgccgcactctatatatccatgaaaaacttttttcagaacaaaaaaaaaaaaa

SEQ ID NO: 18495 - DNA, 832 bp, Homo sapiens
  misc_feature (1)...(832): n = A,T,C or G
agatttcaaaactgcttctaccctggtaacatgctgagactcactggnatgcccatgacatgggttctggcaacaaagggacagaaggaatcaagataacacagaaagagacatgacatcaccaccccatgcatgtggcctccagacagtaactctaatatgaggaacatcatacaataattcagaagtaatttcaagcacctgctttgaggtattaaaaacccagataaagttaaaaaagaaatgggggggcctaggtgaacttaagggtgaaactctgtagacgattccctttactgaggagtaattgatggatacctgggtggactgactgcatgagatcgggcatagcgttgggttttagcggttgaattgtattgtaagcgtctgtgcctcactatctcttatttttcgtatgattatcggttcgatcttttgctgttaattcgttccataagtcttcaacggttcttgtggttattgtcatagcgttttcgtatggttttggtgggtcgtcgattatgtgttagtgctttagatattagtatagatgtaaatagagtttgtattatcgggtacatcatgattagtataattgtatacgtcgttgtgctttcggtaattactaaaaacggttggtgcgtaaacctccgtttgttcttccgtgtatcttcatcagtgcttcttgcactaaactattaatatctaacctcacctcacgaaccggtgacacaggtcagaatcgacgatcgattatacagatagaaatgtaatgatagcgccggcccatcggttggtttctatgggctgtagttgtgttcatcgaacaata

SEQ ID NO: 18496 - DNA, 338 bp, Homo sapiens
  misc_feature (1)...(338): n = A,T,C or G
cagctggnatgcatggtgtngatctggctcactgcagccttgacggnaaccccanactcagggtctcacctgagtgtctacagacaaaggtcccaaatccttgtgtctccttatagatagaagacagaagatcgaaagcagctcatggtaaacccaggggattgaaaaaaacatctagcagagatattataaaccttcaggaaggtttataatggaaacccaggaaaaaatgtctaaattaatatctgaaggcatttctattttattttgccaacagtattgaaactctttatgtgctgaagattattaaagtcatgtgtgcttgaaaaaaaaaaaaa

SEQ ID NO: 18497 - DNA, 122 bp, Homo sapiens
caaaagagtttgtatgtctttacacccatgtggatatgtggcatggttgagtggtaactaatcatgacattgatattaaacgtttaataaatgcagtatgtgacaaatgaaaaaaaaaaaaa

SEQ ID NO: 18498 - DNA, 225 bp, Homo sapiens
cgcgagaagtccacgagcagcacctagtattttgatgggaacaaaccacatgatcttgatttgttcccagccaccagcaaaaagcatgatgcaaagaaatgattgaagtggtggctgctacacaatagctccctaagtgactattacaaaaagaatgctgctgaccatgatggacatgcaaggagagcaagaaataaacctttgttgtttttaaaaaaaaaaaaa

SEQ ID NO: 18499 - DNA, 127 bp, Homo sapiens
atgaggcctactctgctgttctccattggattgtttcagggagaagaacagatatctcttcaatggggcagggacagaatttttattctgatgaaataataatttgcccatatcaaaaaaaaaaaaa

SEQ ID NO: 18500 - DNA, 408 bp, Homo sapiens
  misc_feature (1)...(408): n = A,T,C or G
ctactaaatgcagcagggacaccaagagaacatgtttncttccatggtgaaaggctatatgagctatattaattttattgaaaagcaaaatatgcatgtaagctcttatgcaaatcaaagctgctgagaaagttctttacttaaaaaagaagagctccttggtactaaagaaattgaagagtacctagtggctgttgttagtgttaataatgaggaggaaaatgtaaattgcgtttttaagtacaaacattcctcaatgagactattaactgggacatgaattatggagtagaaaaatctgcttgatttattacttttatgatgtatgtccatcagtatctagtttgatataaaaatgaacatgttaacaaatcgccaaaaaaaaggccattggcctcgttgggctca

SEQ ID NO: 18501 - DNA, 242 bp, Homo sapiens
  misc_feature (1)...(242): n = A,T,C or G
cagaaccttgcattgcaatgaagctatcttgggaacagnatgtgatttaaggactgcaggggatatacaagcctctggacccactgctgacctgaagacaaccaacacattctagtgcacatcaaatttaactttgatcaagtattcataaaagctccaggcttgttacattttacagtttgtgtatgtggtaaggggtaaagtaagaaatgaaaactttcatgccctgaaaaaaaaaaaaa

SEQ ID NO: 18502 - DNA, 246 bp, Homo sapiens
  misc_feature (1)...(246): n = A,T,C or G
cacacaggttgggcgatatggggtgacaccttgtgagnacatnccacatncctcccagctccatcctttgcacatccctggcccagacagattctgctccaaacccatcctggacttagccagatcttcagccatcaaactaagactctgtcttgaatcatcacactgtattttctaaaaactagtattttttaaaatgtgcaatgtggaaataaaatgttttctgcacagccaaaaaaaaaaaaa

SEQ ID NO: 18503 - DNA, 431 bp, Homo sapiens
  misc_feature (1)...(431): n = A,T,C or G
aaggagttataataatggggttcggacaaaacacccgttccgctcgccggggcctacccgaggngaataaagtgatgncctactcctnctcagttcgtggctgtgaaacacattcaactgttgattgggcgaaccagctaccatatcggaacagctgtatgaagcctgtgtggtaaggaaagaggctcctgataagaggcacagaactgaggcccttgccaaaagtcattggattgagccatcttggaagcagatcttctatccctaatcaacacttcagatgactgcagccctggaggccagattaactgcaacctcaagaaagtccctaagccaggaccagccagccgagctactcctatattcattgaccctcagaaattgtgtgagataataaacactttttattttaagctgcaaaaaaaaaaaaa

SEQ ID NO: 18504 - DNA, 163 bp, Homo sapiens
cggcgataggatctcactgtgctgctcacatggtctcaaactcctggcttcaatgatccttccaccttggcctcccaaaccataattttattaggactttaaaatgtaccttgattcacagggtttgggttattaataaaataatttgttaaaaaaaaaaaaa

SEQ ID NO: 18505 - DNA, 224 bp, Homo sapiens
  misc_feature (1)...(224): n = A,T,C or G
cccgagatatccgggtatggaagaatngagnanaaaagagagaaagggaggaaggctgaagaagaatatgcgtttcagctttcaagctacactctgcagaacttccacataacgaagcgcactaagataaattacctgcttgaaatagggagaagaaaaaatacaagaagaacaaaggcaaataaatatctcaataaagtattcttctaccaaaaaaaaaaaaa

SEQ ID NO: 18506 - DNA, 247 bp, Homo sapiens
  misc_feature (1)...(247): n = A,T,C or G
cgagtactggcctgcnacattttccataattaaagaaaaagagtcaacccaagagtccagaanctnnacaaaatgcactctgtcatttncatctagaaatgaaattcttggacatggattcaaatatatacatgctatgatggcaattttttggaaactgccatcacattttcaacaaaattactaaaattaatgacatttattaaagaaaagtaaaagaaataaaaactttctaaaaaaaaaaaaa

SEQ ID NO: 18507 - DNA, 375 bp, Homo sapiens
  misc_feature (1)...(375): n = A,T,C or G
cccagttttcaggtgtttgtatgnagtcctacagcttgngctgtacgaggcctctaaccactgtgaggggaaagtgcttctaataatgatctcaaaacagaggaagtggagtccagaagtactgccagagaaacggatctagtggcatatggagaaacgatcacactgagagcttcagttgtcactagccaactaggaagtggtggaacacgattcgaagccagcctcaggctcaggagtacccactctcaactactctaccttccggcctctgttcttagtcactccctcatgttaggtcttgtcattgtttcctgtcttctgctatgatcaataaagctggaatgaacattctgatacataaaaaaaaaaaaa

SEQ ID NO: 18508 - DNA, 378 bp, Homo sapiens
  misc_feature (1)...(378): n = A,T,C or G
cagctgtcagtgnactagncaattgaacaaactactncaaacaaagtctgtataatcctgatagcagtgtgggtatttcaacacgtctcctttagacagatgaaaggctgacctggctctgccaagacttgaacacattccagttcctgctgatctgagaagtctcttccacttgcgtttttcttcttttacctgacaatttgaataaaatgaaaatacaaccatacgtatagggaaaagagtttttagtgtacctattctttaaaatcagcttgagctttatgttaaagtcaaaatgtgcacatacctattgcttctaaaatgtaacagatatctgaatataccaataaaatgttttgactctcaaaaaaaaaaaaa

SEQ ID NO: 18509 - DNA, 253 bp, Homo sapiens
  misc_feature (1)...(253): n = A,T,C or G
acagttacaggantttgtgtgtaggcccaactttcttcatctacttcaaccaaaacatgtatcatctcagactgggtgcagaagcagctatggaaccacagctgttttctattaagccagacattaaagcaacttataaaaatgtgaaacgatgccactcttctcactaatattttcattgaaagtatcttatttatattattatataaagggcttattttaataaagaaataaattcttaaaaaaaaaaaaa

SEQ ID NO: 18510 - DNA, 268 bp, Homo sapiens
  misc_feature (1)...(268): n = A,T,C or G
ctaagaacctgcgaaggtaggaatgggattattccctctgctccgggtgttccgactattaagacatgctgcaagcancagtaccactgttataacttttggcgtgattggttatggtatgcatggcaggataaaatacacaagcaaagcaggatttcaagcatacttttcatgcaaaattcattactgaatggaaaatatcaactaagatatttaaatttatttatgaagcataaaatactgatatattatgtgaaaaaaaaaaaaa

SEQ ID NO: 18511 - DNA, 404 bp, Homo sapiens
ccagaggtttccgaggagtttcagcaaaagcctaccccaaatactttggactgaagtgattgggagggcctaagaacaagaagtcactctgagttcctcctgcctttcaatgtgagacctggccaaaagggaattctctgtcctacctcaactgaaagtagcttgtaagaacttcatctcaaaggggtactgcattatactctgaggccaagaaaagtcaacgcagaggccttcctgggtccctctcccccaatttgttaccatacccttttgtcccatcatacttctacatgattttactgaatctaagcacaaaaatactcagttgtcccctgggtgtttggtcctcatttctaatggttttcgttccccataaaactttggttaattcaaaaaaaaaaaaa

SEQ ID NO: 18512 - DNA, 298 bp, Homo sapiens
  misc_feature (1)...(298): n = A,T,C or G
caggtttctgtncaaaaaaanaaaggaagagcaggagaaaggcagagaacagaaaagagaggaggaggagtagaaggagagaaatgaccattctacctaaataaacaactctatctaaatcatgcatcagcaggaggatatttatggcctcagcacatttcttttactgcatgctagagacacttggcttttccctcgcaaattcaaatgtcagtggaatggctaactcatgtgaacaggcttttttcccagggaggagccagccacacaataaaatttaaatggaaaaaaaaaaaaa

SEQ ID NO: 18513 - DNA, 198 bp, Homo sapiens
  misc_feature (1)...(198): n = A,T,C or G
cactaacagctctccttgttgctcanattggtttcgactcctgactcatgatccccccactcactgctgagtagctgggaattacagngcatcgaaccaccaagcccaacaagaatattttaatatgtttaacagaattcagaactctttaactgtgataaaaaactatgcttttctttgactctaaaaaaaaaaaaa

SEQ ID NO: 18514 - DNA, 241 bp, Homo sapiens
gttggcgtttgaagggagagttctcctctcatggcggtcgagataagaatctgcagcatcgtaccactgctataacttattggcgtggatgggaatggatgcatggtaggataaaatacacaagtaaaagagtttcaagatactttacatgaaaattcattactaatggaaatataactaagatatttaaatttatttatgaagcataaaatactgatatattatgtgaaaaaaaaaaaaa

SEQ ID NO: 18515 - DNA, 254 bp, Homo sapiens
ctagtactatgtactgaaattgggggcaaaaaagacccatctgcactaactggagaggttcaaaagatgatgcacacacactcaagcatatcgagagagaaggggcagaggacacagaaggccctgagtttaatgtgcatgttttggggaatttggaagaagagcccctgataatagatccttcattattcttgcgacttttctctgaatctgaaattatattaaaatatggaggtagaagaaaaaaaaaaaaa

SEQ ID NO: 18516 - DNA, 997 bp, Homo sapiens
  misc_feature (1)...(997): n = A,T,C or G
gaaaaattgcccatttttgtgaaaaagttctacgatatgtgaagttaccacatttattcattgaattctcttcctgagtgaatgacatacgaaccgccgatagaataaattagatatagttaataattagaaagattatgctaatgagacaacctttgtctgtgtttaatagaaatttgaatttatgatatatataagaaagattgtttattgctagttgaaaaatatatatagaaatcaaagaataatgtgtgtgtggagaacaaaaaaagaaaaatggcactagaatgacactcaagcggtagggaacatttgcgagacgagttaaccttatagtgcagggatgtaaagacaatgatctctgagctcacctgaactacattgagactaagagccgatcctgatgtcgacgatagcgagtgtatcaactctacttcacaggcatatcgctagtctataatcacagtatagaactcgtacatgaacggtaagagatgtatcaatgtgaacgtagcaagaactagcggatgggacccttaagtctccgagaagacgataccgctgtaaatcgtacacatatgaatctatattaagagaatacataagagaacaagctcatctctatacatcagtcgaatagatacgccgttcgacgagtgcagttatgcagtttagaagagaacgcgcaagaagaggtactatgtacgatagctatagtggatatgaaacgacgaatgtgcagcgagcgcgtgagagtgatagatggagagagcctgaagtaggactggattacgttagtatatcagagaaagaagaaccgaaagtcaaagacaataatatgagttattagagtcaagacttcacagaacgactcatgtatgtctactagacggacagtcagagagattatgtaacaccatatggatgtaatgctatatactcgaatataagcntacatatttgtncagatacggactctaagcgagatagacttcgc

SEQ ID NO: 18517 - DNA, 343 bp, Homo sapiens
  misc_feature (1)...(343): n = A,T,C or G
aagtgtgccatcgctgtttcccgagnctgccggccgcacactcctgacaggatttgggaaacaaagtcagagtgagggcgctgggcgctaaacaaggccttttggtgtcatatctaaaaggtgaatggtgctcacggaggaggagcctgtgtctggggtcgtgtgcatcctcctctgctcacagcggaggcatctttggaagaaatgacttattttctggtacagagaccatttcctcccccacaccctctcttaagactttgtattgaaacaaagtaaatcttacagaaattccaccaaagtgctgagaataaaatgcctgattgctccaaaaaaaaaaaaa

SEQ ID NO: 18518 - DNA, 173 bp, Homo sapiens
tcagggatagatctaatcaaaagttccctgtgcaactggacaaccgggcccttaacgggaacaataaaaataagcaattcttccaataggaaatatgatggtatattttggagatgatcaaggaatgagaaacaataaatggcgatgttgtttagcacccaaaaaaaaaaaaa

SEQ ID NO: 18519 - DNA, 246 bp, Homo sapiens
  misc_feature (1)...(246): n = A,T,C or G
caggctactgaatggagtatggnatcatgggncatgtatggctggnagctccacaagccaccttggactatgcagtgaatgtgaggatgaaagctacacaatcagaggagtagagagaagacagaaggagcctgggttatgttgacactatgtgtccacaatactagtgctgaactggatgtctctggacttcctatacatgacagataaataaatttgtatattggtaagccaaaaaaaaaaaaa

SEQ ID NO: 18520 - DNA, 288 bp, Homo sapiens
tatgtggtatgttaaggtgagaaagttcataggagtatgtggcgagtgcgcgggctcgttccgacgtagtacaagaaccacgctgccatgtcatcagctacccaactgctctgaactttattggcgtggatggcaatgggatgcatggtaggtataaaatacacaaggaaaagtatatttcaagtatactgttcatgtaaaattcattactaatggaaatataactaaggaatttaaatttatttatgaagcataaaatactgatatattatgtgaaaaaaaaaaaaa

SEQ ID NO: 18521 - DNA, 331 bp, Homo sapiens
  misc_feature (1)...(331): n = A,T,C or G
cagcctgtgatgcaatggctaccactgacccagnaaagtaatgcttgcttgtaaaacctgccaaanaagaagagaaatactgaagtgagaaccatgttaatggataaaacattaaggtgggactccagaaactatttctatttaatgtatctttcatttatttcctcacacaaccaacactccttcagctgtaaaatggaaataattatgttttcaatctctgtgaaataacatgcaaataaaacaatcaaaatgtatagcaatttttgccacttggaaggaaaagtttattccaatacaaataaaaggaaaaaactcaaaaaaaaaaaaa

SEQ ID NO: 18522 - DNA, 244 bp, Homo sapiens
  misc_feature (1)...(244): n = A,T,C or G
cacgagctgggcaggnagagcatgtaaagtcttcttcaaacgtgaagtggacagaactgcctccaggatccaaaacaacagtcatttacaaagctagagacagaatgcacatgaaaatacagcaattttacaggtagctccagcaggggataatttatctaatcaaacagctgatctcctacatattctactgagattcagtcttttgatgttaataaaatttgaatatgcaaaaaaaaaaaaa

SEQ ID NO: 18523 - DNA, 216 bp, Homo sapiens
ggatgccatcagtatttcacttgctacccagctggaaaacatggcacgaccttggcatactgcaaacccgagcttctaattcttgctaatatgtttgtcaacaagcacagatttattaatgatccattatggatctagaatgctccagaatagaagctgaatagatgtaggttttttgtttaagattaaatctaaaaacacacaaaaaaaaaaaaa

SEQ ID NO: 18524 - DNA, 126 bp, Homo sapiens
ataaaatgccaagatttgacttctcatttttacgattatatcttgataataaagaccaatttgtcttaaaataatgattattaggttagtgcttatctgaatgtttgctttccaaaaaaaaaaaaa

SEQ ID NO: 18525 - DNA, 191 bp, Homo sapiens
  misc_feature (1)...(191): n = A,T,C or G
cccaataatccacgatggtctcttttnatcgncactccttctaccaagtgagncacattgagacggcgccatctatgaaccagnaagcagaccttcaacagacactgaatctgccagaactttcatcttgggatttcccagcctctacaactatgagaaatacatttctgttgtttataaaaaaaaaaaaa

SEQ ID NO: 18526 - DNA, 1214 bp, Homo sapiens
  misc_feature (1)...(1214): n = A,T,C or G
gccgccgcctcttctgggggcccgcacgcgccctggcgcccatgccccggggtttctgactcgggaggagtaaccagggtttgcgtgctgggtcagcatggctaccagggcaggagatagagccctatcctattttctgagcaccatggaaagccccctgggttctagggtgcaccttgagggagaaagaagactcctgtgggatgcctgacattgaaattcctgcacgtcctaggagcatgtggaactcaaaatgggaaattgaattcgatgtgaataggaaatagagcaaccaacgaaggtctcgagtgtggcgctcgtttgtacctggagcggtgagagctagtggagttcgagttgcctttcagtggaggggaggatggcattgatgctaggttgtcctgtccgcagttgttgcttcgctcgtcgcgctgtagctgtctgaccggtgctgtagggtcgcctgctccgatgcgtgtagtatcccgtagacgtgctgcgcactggttcgggagtagcgcgcgatccgcgtgcacagatgcgtgtgcgcccgtcctggcctcgtgagccgtctcgagagtgcactgcgttgcacagtgctctatgcttgctacgagagatctcttcgcacgtaccgactccgagcgatctctggagaaacagagagatgcgcggtgcagcgagccgctctggtgcagtcctcgttcgcttgctgtgctctcgttattgtctggtcgtgtcccttctccctcgcgggtctcagggtcctgcatcgcctgcgccggagtcgcggtttaggaggtaggagaggcgacagggcgagttgggaggggaactgaacccagagcaccagccagcttcctcagcctagcgaagccttccgcgctgtctgcntccgtgcgattgtgtcgcgatcgcggcaatcgcacggagccgtggctcgtaggccgtgtacgctcttatgtatgtcgtccccgctgcgatgcgtatatgtatgccgagaacagtacgaggtaggggaatctgaagtgcccgcgactaccacgtcgacatatcaatgcataggtcgctcgagactgatgtaatcgagttgagcgtntatgtcgtctgagtcgcacgctattatgctgcgctggtgctagctgnctgtccgtctgcgctgcatcgagctctcacgcggtgtacactnctacatcgtagcaggacatgtaggt

SEQ ID NO: 18527 - DNA, 777 bp, Homo sapiens
ggtgcttttggtggattggagtataggaagggttcgttgccaaccccattttgagtactaactgactgcccgagaccaggtgtgctccttggtggacactcataccaggagaggatgagtataggggacccctgtaggatcagactaatagatgagccctgggtaccgggtggtggaccggcggtatgcctggttctttgggatattggccttgttagctttagtaagtaatgattttgttttttgctagtttcgggtcactgagagaagtgaggtgtgtggcgcgtatttgtatctttggttgttcttgtagtgtagttttgtcttttgtttaaggagattgttgattttggaggtttggagtttgtttttcatttagatttaatggggttggtatttaggtgctggatggagtttttgtgtgttcgttgtttagaatttcggttagttgttttaggtttatatatgtaggtgttattgtaattcgtaaggcgacctgtgaatcgggcgattgggtttgatagcagagaggaataggggttggaaacgttacgttcagattccagagtggctgtatttgtagtggccatgtctcgatgttaagtgtggaggcaggtgggccgagagggagttgaggaggtagcgcgagtctatagaattttataagtagttagattcttgattaactagcatattaatgatcttatgttatgttggtcgttttggaggtatatgtggggtcgtgggtgatgaatggatggttaattttatgttttt

SEQ ID NO: 18528 - DNA, 882 bp, Homo sapiens
  misc_feature (1)...(882): n = A,T,C or G
aggtgcaaatnctgctgctnctgcggtagnagcaattgccctagggaaattttatctcaggattaggatttttggaatctcgagaatacaaacagctcttctctgtacacttgctacccttttttaaaaggtggggaatagcttggaaacccaagatggagtacaaacactgatggctgaattgaaaccagtagacacattactggaaagaggaaagccgatcttacaaaacttattaggaaaggaaatcttagtgaggagagatatattaagaaaaatgagcaagactttaatacttacaaccaccccacgctgacactaccacacggctctttcgtcatattaccacccgccacccagaaatgccaatcccaccactcatccagccagcgcaaacaccaccctcaacccatacaacacagccaataccactactcctagaacaacacacgacaaccaaccaacacctacgccgtcccccaccaccacaatattacataatacaaacacgcaaccaccaccaacctcgcacaacccacccaccacctaactatccttaatgaccatcgaaccccccccgacccacccaacaacccacacccaccacccacacaccttcccccagcctacaatcgcgcgaatccatactcacaatcacaacacccagcagccaacattcgccctcacatacctcccccactcacctcgctctgcccctcccccataccaccaccccaccctccccgcacactcaacgccatcgcccccactcccccacccatacagacctcacccccttttgctccaatttactacttaacctcccgcaagaccacgatcgtgactctcagcacgccactaccccgctaccaactctatcgg

SEQ ID NO: 18529 - DNA, 578 bp, Homo sapiens
cgtcacaggttctagcccagcaggtgacggtgcagggccctgagctctgatcttgcgtaacagaaatagagtctgctcttgacctggtcacccagaaccacagcattgagaaagaaaacttagacatccagctatgtccaactgccacattgagtcaaaaggaaactgaggccttgagaaaggagatttgcctgaggaaagggctcaaccacagtctcccaacccatttgcctttgttcattgcttgggtgccactgcaagtctggccctgtttacagcacattgcggctttctacaggaattcatcccattaacttcacttctcagccctgaagccttcctcggtctccttgctcctgtgcttctgtggtgaggtcaccttttctggaaatccccgtgatttctttccacaagccctcagctatgcatgtggcaatgaggtcagctgaaactaatgatgacgtgttacgtagaaataagtaaaatcttagattgagctcagacaaaaccacattaaaatctcaaatgtcattttcttacacttcaaaaataaaatgtcaggaccaaaaaaaaaaaaa

SEQ ID NO: 18530 - DNA, 296 bp, Homo sapiens
  misc_feature (1)...(296): n = A,T,C or G
cgatcaaacaaaacntgtgnagnaanatcagnaggatattctcggctttctctaaatcaagtgccctctactgtcaaaaagtgtactgcntctggaanagnaaaatgacaaatctgaaatcacaaactctagnaacagtgcagaagaacagnacggnaagnaaaactacaataggaggaattattactagagccaagatttttctcacaaaccattatctttccttgatctggcattgtatatttttttcaatggattccaaataataaatataatgtcttctaaaaaaaaaaaaa

SEQ ID NO: 18531 - DNA, 946 bp, Homo sapiens
cgctggcgtctcatgtgttagcccagactggactccactcctggactaaggaatactcctgacttgggctaccaagtgctgggaatacaggataatgctcttggtaagaacgtaaaggattagctttgggaaaaagaagattactattttgcactgactgatgcataaaggaagactgtactgcaaggggtgtgatacttggtgatgtatgaaacggattacaggagaggatatggagtggacaacgggtgcgggcgcatcgaggcgtggtggtgggttaaaaaaacgaactgaaaaaaaaatgaggctagctgtagggaccgcaatacataacgggcccgccccaccccatccgccccaccccgccaagagtgcccctatctgccgctcgcccgtctatcatactcccccaactacaactaacaccaccgacccgcccccaccccccccctccactatctgacgcgcctcccgccgcaccccacacatcccacacacgaggcaacacccccgtctcttcactggagcgcaccggcacgccccgccgctcacccccccccgccacgtctcccgccgtacccccgcgtccgttcaaccaccacactagccggcacagcacgtatagcgtgactaccacatcctaggtcgtaacatcagtactacggccatccggttacgcccttcatgaggccgccaacaccactgtatgagaattccacacacaaactctctgagcaacatccacattccctcccgaacgccccccgcacccccgcgagacgccccccccctcccgcacctaccacctcggcctcccctgctgcgctcgacgcgtcccggcggcacgccaccattcacgccggcgcccggcgcttctcccgcgccgactcaccccacaccccgcccccctcccgccgacatctcgccgtatgtccccgcgatagcg

SEQ ID NO: 18532 - DNA, 843 bp, Homo sapiens
  misc_feature (1)...(843): n = A,T,C or G
ccattccttgctgtnatggnaatactgcanaaaatataatggccagtgtccaaactcaggctttaagagaattagcatctttcctcctccttaactctcttggaagccagtcaccatgtaagaaagcttaggctaaactcctgaatagagagaggccttgtggagaagaatcaagtaacttcaaccaagaggcaacaccaagacttcagcaatttgagtgaagccatcttggaccttccaccccagttaagtgaagatagctgacacatcataaagcggactaggcatctgcggtaagcccttgctgaattactggcaacagaactgggagcaataaaacatctgctgtttttaggcactaaatcttgaagtgggtgattgtgaagcggaggataattataggcggaagaatatcattcgatcctttgataaagcatacagatgttgaaaatttaacacgtaccaacagtctacaccggacgctaacacgtccccccgctcccgaccccccccgcactcagagacctcacaccgccccccatagctaccagcacttcgccccgtccactctaccccccccaaaccggcgaccccgcccacctcctccatccacacccaccaggcagacactagcacgaacccgggttcggacccgcaacccgcaacgaaagttcgcgccgacccagcccccctgaggacacctaacccgagaccccaccgacaaccaagccaccgaacccactcgctcacaccagaatcctatgcactatcaagccccacctagcgacaatcccggtgcctcggcacccataacaatctccccacaccaaagtgaaggtacag

SEQ ID NO: 18533 - DNA, 342 bp, Homo sapiens
  misc_feature (1)...(342): n = A,T,C or G
acaggtctccggtacaggncaacgtgcagtgnaccccancctgcttcagaactgaaaagatccttgtctagatgagcagcagaagccctcactgtcagtcctctctggaaaatccctcagctgagagaagctgttccattcacggtcaactgcctccaatggtcaacatcagtgaataagcgcccaacctgcttcagaggttaactaaggctcttgttaagattgcactgcagttcaacttctccctctgcccagacctgaatccgtcctttcccctccacagatgttaatctgaagagtatttgagaataaacaaacctctgcgcactaaaaaaaaaaaaa

SEQ ID NO: 18534 - DNA, 381 bp, Homo sapiens
  misc_feature (1)...(381): n = A,T,C or G
gcggaaaactggtgaataactgctacacaaccttgtactacttnacacatcaaaaagnacacgtactctttctctacaaagtgaatttatcagttacgcatacaaggtgatcctgcctctatcctggaagaaagaaatgttatgcaagaggccaagaagaagctaaacaaacaagccatgatggattcccatctcagcttattaccattgggacatgtcctttttgtccaatcacatttctacatggcagtacagtcttcatcaagcctaagcattaaaaaaaaagttttctctgggtctttgggtcttttgtttcggaaggctcctgtattacataaaactttgttaaataaatttgttatacttttaaaaaaaaaaaaa

SEQ ID NO: 18535 - DNA, 390 bp, Homo sapiens
aatactgacacattccccgtatggctgggcgtggtggcttatgcctgtaatcccatgctttggcaggccgaggtgggaagatcaactgagcccaggagttcgaggctgcagtgagctgtggccacgccactgcactccagcctggagagcagaatgagaccctgtctctagaaaaacaaaaaaggaaggaaaaaaagaaaaattctctacccaaatattttttcatgacgttgactatttgaagaggctgagccagttttcctatataatatgtcccatatcctgactgtttcccatggtgttgttcaacctgtttgtctatcccctttattttgtgtatttagggctagacttgattaaattcaggtttaccctacaaaaaaaaaaaaa

SEQ ID NO: 18536 - DNA, 326 bp, Homo sapiens
  misc_feature (1)...(326): n = A,T,C or G
ttcgatcctgctccacagtgnaccaaacccaaaaatggatggnaactgcatccctgttgcacaggttcctgcttcacaaggttgttacacaagcccgacatcaggaaatnagggagcaaaaacacaagcactcccttaattctggaaggccatcctacaagactgcctgccttggttagagacatgcaccagccagacctcttcattgttctcacttttatgggtaaaggccgctaaaaggccctgatgtcctcagaccttcataatatccatctctgttttcaagtttattaaacatattttttctgccagcaaaaaaaaaaaaa

SEQ ID NO: 18537 - DNA, 404 bp, Homo sapiens
  misc_feature (1)...(404): n = A,T,C or G
gcgagatattccgagcattcctgccatnctgtaatgganctncagtcagaaacccanaagttttagtacatgngaagtcgagtcagcatattgatgagaaaacaacttcaagccttgaaaaggcctttcagagcttcaagcaagcaaatcgcaatgacctcagcagtacatagagaggatcctgagtgctgttacaaagtaaactggctctcatcagcgggtcagaccaagctcagatatgaaaatatgacactcttgcacacagcaccttccagcgtcggcaaaaatggatagaactgagattttgaaataacttctccagtgtgaacttcccaggtttctttaagaaataaaaaataaaaatgctttcaacaaaagcatattgagctccaaaaaaaaaaaaa

SEQ ID NO: 18538 - DNA, 487 bp, Homo sapiens
gcgggtctaccgagcatcaaattggcttatggaccataaagtcccttggaaaaactggcctcatacctttgtctacacagtccctgtactgagttcctgtcctgtgaaggagtcttgctttgtcaccaggctggaatgcaggggtgtgatctcggcttaatggaaccctccacctcccgggattcaaaagattcccctgccctcaacccttccccaataggttggaacctacaggctgggcccacacacccaagttattttttttggtatatagtagagaacccggtttcttatggtggccaagatgggctcgattttttgaacctatgaaccacccggcctacggcctgaaatcccggttttaaggagggtaaaaagggggaagataggttggagcccagaggtccagaactggccgggcaatataacgagaacccgttctcccgaaagagggaaaaaaaaaaccgaaggcacaaaaaaaaaaaaa

SEQ ID NO: 18539 - DNA, 620 bp, Homo sapiens
  misc_feature (1)...(620): n = A,T,C or G
ccgtacacctcgncttcagcctctgtcatcttctgggacactcctgtcacttcctgcatcgccttcctgttccagttctgccccctctagtccattctccacgttgaagtcaggaggagctttggaaaatgcagatttgcgtctgtgaaccctccccctccaccattacttcttcccgctgaaacctctcagagcctctctattgcccagattccttgtcacacctagggccctgtgcaattcactctcctgcttatctgtggcccacacacatagacacacaactctgcatccaacatctttgtaattgttactgaggtgtgccctactatgcctccacatcaatttccttaggacagattgtgctttcttaacctgtctaagccttagtttccttgcctgcagattgagaatagtcctagttgcctcacagtaatttggcaggttcctgaaagatcctgttgctatttgagttaaatgtttatattaacatggagagaactgacaggcacacagctctgagtcttcccatccagaaatatgggatgggatctgtcntttgttcatattttcttttacggttcctcagtaaacttgtggaattttcaaaaaaaaaaaaa

SEQ ID NO: 18540 - DNA, 339 bp, Homo sapiens
  misc_feature (1)...(339): n = A,T,C or G
gctattaaccctctcacattgcactatganattaattcctgtgcaaatccaagagcaggccaaggtgagaggattgcttcgaaccaggagagaccagcctcggcagcaaaagacgaccctgtctctacaaaaaataaaagtaaacatagtcaagtgcagtggtgcatacctgtagttccagctacttcggaggctgagatgggaggatcatttgagcccaggagatcgaggctgcagtgagctatgattgcaccactgcactgtagcctggacaacagagagaccctgtctaacatgaaatgaaataaaataattttaaaaataataaaaaaaaaaaaa

SEQ ID NO: 18541 - DNA, 398 bp, Homo sapiens
gcgacaaacctactacatcctctcatggctgggcgtggtggcttatgcctgtaatcccatgctttggcaaggccgaggtgggagagtcaactgagcccagaagttcgaggctgcagtgagctgtgatcacgccactgcactccagcctggagagcagaatgagaccctgtctctagaaaacaaaaaaggaagaaaaaaagaaaaattctctacccaagtattttttcatgacgttgactatttgaagaggctgagccagttttcctatataatatgtcccatatcctgactgtttcccatggtgttgatcaacctgtttgtctatcccctttattttgtgtatttaggcctagacttgattaaattcaggcttaacctatttgtcaaaaaaaaaaaaa

SEQ ID NO: 18542 - DNA, 526 bp, Homo sapiens
  misc_feature (1)...(526): n = A,T,C or G
aacggggttattttccgaatctttantatcacntcnactnanacgaannaaaaaganaatatngcaacgaagantggaagggaagntaaaaanacttattnccatggnctacccattcncttccaagacatggaaacccaattttcttaagaagtncttgggnagnaanaagccagggnagagggaagggccacaacccaccaaaaagaaggaatacccttcaaaattagggtggactggtcttttcttttcatcacggaaggggccctttcaaattttcttggcccttgccttgcaagggactccccttttggtggtgggggtgataaagatgccttcaaaaaaactttccagggaatggtcaatgggtggcacaacttacttggggaaaggcaaattggtgaagaatctatttgtcttaactagctgaattcaccaatctgtttcccaaaaacttggtttgtgaaatattttcctgtgatatcttcagagaataaaagatcttattcttataaaaaaaaaaaaa

SEQ ID NO: 18543 - DNA, 214 bp, Homo sapiens
agatctggtctgtgggcagtttgccaacctgttctaaccttttagcagagtaagaggtgaattgtttattgctaaagtaatttaccaaaaaataacttgtattcatgtattatttgtattaaaaataatatcaataaaagaatatcgtaatgcaaaaaaaagtggattaggaacctgaacttcttcccttaggaaagtttcaaaaaaaaaaaaa

SEQ ID NO: 18544 - DNA, 237 bp, Homo sapiens
  misc_feature (1)...(237): n = A,T,C or G
aacgaaatttttaccgaactttctggaagggaacactgggcgaaaantaccagtgcacagctcttaccttcatgtncaagtgtgnaaaacacatgcaaaagagcatgccatcttgcaagccaggaaaaaggaccctcaccagaaactgaatctaccaacaacttggaactcccactccgcagccttccagaacttgggaaaaataaatggttgttctttaagctaaaaaaaaaaaaa

SEQ ID NO: 18545 - DNA, 864 bp, Homo sapiens
  misc_feature (1)...(864): n = A,T,C or G
cgcgggttttccggtatctaattagaataacgagcacacattacttttcctctactggaagctcccattattcttgtgaacgacagaaacctgggagctgttgggcgccatgcgatccatggatgaccaagcagcgatccaagctgacattaagaaagctttacgaacaaggacaagggaaacaagcttatgatagccgttctcaactgtcggctaaaaatgaaatgaaaacgaagtggcctatgaccgcgttatggacgctgaactatctctttctgaggccgagtctccagaggcatgctgtggagtttagcatgtataggtatctaagtaacttattgaggcccagataaggctttaggatgcctcactgcttatgtcataggctgatgagttagctttcttgcctatcccctaggcggtaaccaaaatactaactaacggagcttaatgaagggcatcattttctgagatgggagagctacacgtactgatgagggtaaatgtatttattaatcaaaaaatcgttattgagtcagccattagcatgtcactattatgagtcacaagttgaccttaaaccattaaaaaggactttgctggtagaacagctaggatatgctacatccccatcccgaagcattttaataactagaccttttacttctaggaagagcgatagcttcgatgaattatgaccaacaccccccctgtttccccgtagagacactcactttatttgctctacctgagacccaacacctcacctctaaccaggataccatatcgacctcttcgcctcttgtgaatagcgnctgctacttattaacaaccccctctccttagtgcattacaaactaaggc

SEQ ID NO: 18546 - DNA, 335 bp, Homo sapiens
  misc_feature (1)...(335): n = A,T,C or G
ggggtctaccgagcatcaaattggattaggnaccataaagtcccttggaaaaactggcctcatacctttgtctacacagtccctgtactgagttcctgtcctgtgacctatgacctgnaagccccctcctgctttgagttgtcccggcctttcaacaacaaacccatggttatttggataaggtaaatggaaatttaaggcttccttaaaaggaagaaaaccaaatggggccttaacaacttggggaccttgtaataagaacttctggaggttgggcttgggcaccaggtcctcactttgggaaaataaacttttgaaatttaaaaaaaaaaaaa

SEQ ID NO: 18547 - DNA, 405 bp, Homo sapiens
cgagtctccggctcgtcgataagctgttctcaggacctcctttccctgccctcctgcaccccatcaccccacagattccacagctgcagagaaagcttcatctggccttcaggcaaggtactgtggggaaaacaaagaagaatgaaactcagatgggatacgttgatagaatgatcagtgaaatattatatatgggtctcatctattcaacaaaaattggctgagcaccaaatacaagcaaggagcttttgtcaaatgtcttttctgtatctattgaaatgactgtgtagttttgtcctttattctattaatgtggtattgttacattgattaatttttagatgttaaaccaaccctgcattcctggaatacattccatttggtcatactgcaaaaaaaaaaaaa

SEQ ID NO: 18548 - DNA, 408 bp, Homo sapiens
  misc_feature (1)...(408): n = A,T,C or G
cgcggacagtgcgaacacgtgggacaggatacctttntctggaggcttgggcattgactgatctatgtggctagttacaggccaattagctgttagctagagtgacatctaacacaactaggctgcagtttgaaataaataccagtgcacagcctccagattcccctcctgctaagcgatgacaaacctcactgaatggtgggaaaaaaaaatattcaagcagcttggataacgaagttcctaaacggaagaacattgtcccagagagtcacttgaacccagaatagatttacgtgatcagacaataaacctctatgacaccctgagaaaaataaagaaaacagcaatcataatcaatcaaaagcggaaatacagttaaaccacagtggcctgggtggcctcaggaga

SEQ ID NO: 18549 - DNA, 357 bp, Homo sapiens
  misc_feature (1)...(357): n = A,T,C or G
cgcgggtctccgggttgcttaagagactgnaataatggntacatgttcctgnaggaatctgcgtttcacaatcccagtgccgggaaggcaagaatactttgcaaacaaacaaaggacgtttaggaagagaaatctgccacagaaggattttcagaattttttcagcaacaggaattttaccaccccaatttcaggaagggaaggaaaggaaccggatgtaggtttggggaattagggaaacccgatggcaagactggactacctctttatattcatttccagatataaaggtctatggtggattttatttgatgcaaagcaataaaatattcctccctcctgtgaaaaaaaaaaaaa

SEQ ID NO: 18550 - DNA, 896 bp, Homo sapiens
  misc_feature (1)...(896): n = A,T,C or G
acgatgtttcgatgatgccctggcctncancatcattacgaatttggcatttncatgncaacataaaacaccaccaactttaatggggaagtgaaaaggagttggcctttcaaaataaaattcccttgtgtgaaagggcactgggaatttacatattgaaatgggaagatgaaacaaaggttgaattttatgggcactggctttaaagctttgtcttgcactggttaccgaatggccccaataaagcgaagaaaaacagaattaggacccattctggcatttacctttcacctgataacatctggtggttcctatgtatttaatatatgtattttgatgttgtatttagtttattttgattggctttcgccaagcatattcctcccggcacatactaatgtggagcgtaccctccagattacgaactgcgttacctcttagacattccaaacccgtttgccatacccgcccccccaccgcgcttcccctcacccgcactcccccccgaaccaagactgctattcggacccacataatctcactcgcgcagcctgcacctattgctccccccaccagagccagccatccaggtacccaacgaccgccagcaatatgaccagcgctgcacgccccagacccacactatactcctagagaagcatcagcctaggcgcaatcgctgaggatcccagccgcctcatcaccgcgccgcgggccaacgcaataccccgtcgccccccacccgagatccccagaagagaaacgcacgacaggagagcgcccggcgcgcacttcaccagcggagtacagcagagccactccccagtagataagatagcgacgatggaaggcgaccccatcctgtcccatggctatccagcagcgccgtatgcacc

SEQ ID NO: 18551 - DNA, 390 bp, Homo sapiens
  misc_feature (1)...(390): n = A,T,C or G
ccggagattaccaagacaatagcanctgccgtgttgttagaatactcagncagtctcatggtacaaacctacatagcatgaaactaagaagtaaagcctcctaacaacagccagcaaaaaggaatctggactgcttgcaagcagccatgtgagtgagacgtctcagaaactgcagcctcagcctgcaacttgactgcagccttatagtaggctctgagccagaaccacccagccaagctgttctcaaactcctaacctacaaatactgtgagataatgcttgtagttccatgctactaagttgtgaagtaatttgttatataacagtagatactttaaacatacatcttgcttttaaaaatataaaattactttttcaaaaaaaaaaaaa

SEQ ID NO: 18552 - DNA, 354 bp, Homo sapiens
  misc_feature (1)...(354): n = A,T,C or G
cagtgtgccagttgggaaanaaattgtagctcttcataactcgttaaatattttctgattctaagagcttaaccagacagactaccgaggttgaaactttacttgtgctgaacttttcgaaacattccaggagactttggaggttggacttttaatatgccaactgctcgttcctgtacttataactatagtgtaactacattgtcctggattttattcaagttgataggcaaatataatagtgttctcttttttctccaaagtgagtaaaatgtcaacccttccctcctgactaaataaacacatcctattgtagaaaactacaactggattaaactcgcaaaaaaaaaaaaa

SEQ ID NO: 18553 - DNA, 498 bp, Homo sapiens
  misc_feature (1)...(498): n = A,T,C or G
aggcattgggattcacatgtcctggggtaggaaggctgtggcactagnaactggcaaaaggaaaaaaaggaatgaaatcaggatggatggagctcagtggctgggatccagggagggacggctgaagaaggaagcactgaaggaagcagacagaggcctgggatgccagggaggagacccagaacccagtgcctgtgtgcatagtgcgtgtatctgcctatgcacaaccattgaggattgcttcaagttaaaccatcagaaggaagggctgcgggcgtgtgtacactatggataatgggcctcacaacatccagcgcattagctagatagcccttgaaatgcatcaaggatgtgagtgcctgcactgtattaatttcgccgttgctagagatgcctggataataataggcgtccaattaaatcactgcggaataaatccatgcagattggaaataaaaataaagaaggcctttttggccctagtcggggaatctttgg

SEQ ID NO: 18554 - DNA, 501 bp, Homo sapiens
  misc_feature (1)...(501): n = A,T,C or G
caggtgttgtgtcccggtaccagtaacatgtgttcctatctgtgtatctgcccttctccttgggatactaggcaataaagcacagctgaccatctgtcctacgcttgcaacgcactctgccgctgtagcaaacgcttcatgccactgccacgcgtaaagcatctctgttctcatcctacccagcattaccttaccattgtctcagccggcacggactctgcaaagaacagcatcgccaaatccggcgtcaccttgcgtgaattgcctgacaaatggcaacctgccctcctttagcaatctttcaagcctcaaccagccagccatgcaccctccagatctggcgcgggtacaaaccaaccactcaccatgtccctcctctgtccacgcgccgctcctgcaccgcctcgctgcaccaatctcatccgcactggtctctggccaatncccaactactgccctccgcatcgacctcaccctgcaagcaaccctgcgccgcttccc

SEQ ID NO: 18555 - DNA, 335 bp, Homo sapiens
cgttctcacctattgcactatgtatattaattcctgtgataatccaaagcaggccaaggtgagaggattgcttcgacaccaggaagagacagcctcggcagcaaaagacgaccccgtctctacaaaaaataaaagtaaacatagtcaagtgcagtggtgcatacctgtagttccagctacttcggaggctgagatgggaggataatttgagcccaggagatcgaggctgcagtgagctatgattgcaccactgcactgtagcctggacaacagagagaccctgtctaacatgaaatgaaataaaataattttaaaaataattaaaaaaaaaaaaa

SEQ ID NO: 18556 - DNA, 1167 bp, Homo sapiens
  misc_feature (1)...(1167): n = A,T,C or G
cgattattttcactcacctaacaaaaaaagaaattcaacaagaagcaggtacataaactatcatggccaccatcgctcaagcatgtaacaattgtctcaagcagtctggtagaaaagcaggtagggcaagggcataaccacgaaagtaaggaaacgctgaagaatagcaaaatggccatgcatcagtatggaggattgcgcttatgcggatgacttgtgagactttggcacgctgggatagctctcagtattcagcgttcgaactctgaacgaaaagcattcgatccacctagattcttagattcgctcgctatcaacaccctcctcatttcaccagctcatgccgccatggcccatgaccgactctcaccacgcctccgcatatagcaaccaatcctgttgtccatccactctcttacccctcctcccttctttacacttatatgggctagaatgcactcacctgtaaatgcacgcaacagcgacatacgactagcccgcctgccgcatccgcctcgcccgcgcactcccaccatctggctcgactgcccacatgatcactggaacccacatacccccaaccacacacacctcgcaaacgtcgcgactccccgcgcacaaccaccacctccccacgagtctatactcactacaaattccagtaccgttcagacactacgcatcatcttaaccaccgccagcgacccacgacaagaggaccgcgagaccgggtcgagcaccggttctaagtcgacgagcactgctccaccagcacaatcgctactcagatcctcactcctctacacccgaacacatcccggctaagccgtccccacgcccacacatccagcccaccacccgatacacctatggcagcagcacggacagcacgacacgcgggacacgagtccagctcactacactcaccgcgtatgcgctcgcacgccgcgtcgctacttntatgcnacgcaccgatctccgctcaacaatctcgcgtcctntggccgctctcntctctagtcacctcgaacagatctgacgcntcagtcacgacttacgctactcgcgccagtactcgccccccaccacgcaggaaccacctgtaagacgcgagccgctncgtgtccacagcacccgcgccacgaacaccacgccgcacaccgacag

SEQ ID NO: 18557 - DNA, 878 bp, Homo sapiens
  misc_feature (1)...(878): n = A,T,C or G
gggttttccgttctttccacacactaacaaaaaaaaaaatncaacaagaaggagnananaaactatcatggcaccatcctcaagcatgaacaatttctaaaagtctggcagaaaagcaggagggaaggcaaaccacaaagaagaaacctcaaaatagaaaatgccatgatcatatcagcattccttatggatgactttcgcctttccacctggatagcccagatcaggttcaacctagaaaacattcatcaccagttttagttgctgcacaacagatctatttagagttatgcacatcccataagatttaaatggaggataagaagaaaatgtaccactaccagcaccagcaccaccaccaaaaaagggtgactgacttactttaataacgaagggccattgaaatagtatggccatgagctacaggactaacctatggatgatgaccatgattgggatgcgtgccccaacacttcaacagaatggaaaatgcccggaccacctatctaaacgcctgccccccttgcccaacaatctctgaggagtaaatacgtgcgtgacccggtccgccttccatcaccagcccgcagccgaacatccaccaggaagtcgcgcacgccccccaccgccaccgtcgaggggcggagtagggccgcagcaacgccacccaacacccgatagagttaggtagagaagctgcgctaagctcgaataagtagaagagtttcgcgccatacgtgaaaagacggcagcccacgacacccgaccgggagaggccaggaaggatatcacgaagagaaggggttgcgcccagtctgcaagcacacgacgactccatccatatagacagtcccagagaataccagccgagcgacggc

SEQ ID NO: 18558 - DNA, 334 bp, Homo sapiens
  misc_feature (1)...(334): n = A,T,C or G
ctacttgttcggctgctcggagagtccagtagtncttnagatncaaggtggtcaatggggctgtgtctccctctgtaaggctctggggaaaaaatccttttttcctcttccacttggtttctgttgtttcttggcttgtggttgcacaattccaagatagtctctgtgtctctgtcttacccttttctgtcctttataaattgctatgaatttaaggcccaccacccagatatacaggatgataacatctcaaaatctgttgcttaattacatttgcaaaaacccttttccaaataaagtcacatacatagtttctgggtgaaaaaaaaaaaaa

SEQ ID NO: 18559 - DNA, 464 bp, Homo sapiens
  misc_feature (1)...(464): n = A,T,C or G
ggcctgtggatcccatgtgcctggggcagggaaggctgtggcactagnaactggcaacaggaaaaaaaaggaatgaaatcagggatggatggagctcaggtggctgggatccagggagggacggctgaagaaggaagcactgaaggaagcagacagaggcctgggatgccagggaggtgacccagaacccagtgcctgtgtgcatagtgcgtgtatctggctatgcacaaccattgaggattgctccaagttaaaccatcagaaggaagggctgcgggcgtgtgtacactatggataatgggcctcacaacatccagcgcattagctagatagcctttgagatgcataaaggatgtgagtgcctgcactgtattaatttcaccgttgctagaaatgcctggaaaataataggcgttcaataagtcactgtggaataaataaatgaagattgaaaaaaaaaaaaa

SEQ ID NO: 18560 - DNA, 1012 bp, Homo sapiens
  misc_feature (1)...(1012): n = A,T,C or G
gaggccattcgctagccaatngtcgaaatatggancatacagtccagcgaaccccagtagattattcancaacatggggaagtccgcactcagccatatgtgcagcagcaaaacaacttccaagcgcttggaaaaggcgctttcagtagctctcaaggcaagcaacatcgcgaatgcaccctcagacacgtacactaggaaaggcatccctggagctgctcgttaccaaagctaagactgcgcctctcatccagacgcggctcagcacctaacgctcagtatatgcacaactaatgacacttcttggcacaccagcatcctccccagtcgtgcggtcacaaactggcgtccgcaacctgaacatccatgcaaactaactctctgacagcagcgcaacttgccccaggctttgcacttaaggaaatcgcacacaatcacagcctgtctctccatcccccacaacagcccatcatggccccgcgtctggacctatagacggtcgggagtctcgtaccgaccccgcttccactattagccgcaggcgcaccactgcatggatccacttcatatcctgaactgcacctgccgcgcgtcccgccccccgcatgccgcgtgagccgcgtttttatcactaactccacccggaccgcacgccccgcccgtcacccccctcacccccgccggctcacctgctgtcgttagagttctcagcatagcgcgcctcgacacgtacggctagccgaaagccaatgagagtacctcactacgatcgccttctcatgtcctataattctcacaagtccggctgcagtgccgatctccccatatacccactttatcctcctccctcccacgcgcgccctagccccctcgcgcacccccagatgaccacnacgtctctgactccgtgcatcagcgatacgaccgaaacctgccccatctacctgccccgccgactcagcgtcccgcagcgctcgccacggccgnctctcccccaccccgcggtaagatg

SEQ ID NO: 18561 - DNA, 807 bp, Homo sapiens
  misc_feature (1)...(807): n = A,T,C or G
cggcgatcaacttggcttatggaccataaagtcccttggaaaactggcctcatacctttgtctacacagtccctgtactgagttcctgtcctgtgatggagtcttgctttgtcaccaggctggagtgcagtggtgtgatctcggctcactgaaacctccacctcccggattcaaatgattcccctgcctcagccctcccaagtagctggaactacaggcatgtgccaccaccacccaacttatttttctttgttattagtagagaccccgnttcatcatgttgggccaggatggtctcgatctcttgacctatggacccccccgactgagacctccgcaagtgctgggattacaggtgtgagccccccatgccctggcctcttctgtggctttctaagaaggaggaagcccgaaccgcctgagaataggccacgcagattttggcttttcctaaacttggctcttgctcctttgaaagggacgcaggaaaagccagggcctgcaccgcccgctagacccctctcgctcggcccttccccgtcgcgggcagcggcgccctcttcaaaacgagatagagtagccacgcgattaacattatacttactccctctcctgacgtcacctacagtcggaccatagccgcgaggtcccgaccatcgcccgagccacgagccacccgcgcacgccacatgccctcgcgcatcctacctcccctcctagcgctccacccggcaccacaccgggtcactcgacgattagaggtacggttgccaaatacacccgagagtagcaactcatacnccaccg

SEQ ID NO: 18562 - DNA, 422 bp, Homo sapiens
  misc_feature (1)...(422): n = A,T,C or G
gtccaccagcaaacagcactgtacctgccttacctaagtacctggnagagttaagaagcagacccaggacttaaagacagatcttttgaatccagagctctttctccaggaaaagagaacctataagtatattttaagaaacacttttgagaaataatagctctttgaggaataataaaaaatgggagggagtgtttcagaaataaatcacattgcagtagatcctttggggcttcaaaaaaataaaactggctttcttaaacatcaagttaaattattgaccacagcaaagttggttaaaagtgaaactcttcaaaacagacatgaacaaggatcatgctagcctggcatgagtaatcttttggatatcacgcggcatcacttttttggctcccattcgcccctccctaatgactcaccgt

SEQ ID NO: 18563 - DNA, 888 bp, Homo sapiens
  misc_feature (1)...(888): n = A,T,C or G
cgaggtggttggtgtcaacggctatcaggcnaacatgtgttgcctgaactgtgtatctgcccttctccttggggatactaggaaaaagaagtgatcattgtctacgttgaaagcaactgccgtgtagaaacgttatgcatgtgcggggaagattctgatgaatgtctcagattacttaattgatcaagggacggatgtgaaagaaaggctgctaacttggagtcccttgaacgaattgaaagacagaaggaaactgacttatttacaattatgcaccgagcataagtatccacttaaattgagggagaagagaagcatgcatgataatagaaacggaagagggcggtcccgatgaatattgaagggcaagtatatagagagggccagatgtccaattgaaaaaactgcaaggatgcgctgaagaagggcggatgacaagaggccggcagtcatgtgcgattgagatgatggcgcgcagatgcctgagtgggtaggattgtgtggcgaaaggagaagggacccgggcctgcaggatgaggagcgccggcgggccgcaagagggggaggactaagaccgcagaggcaacatagtgcgagggcgagagagcagtagagcagccatcaagataacgagtcaggggagcaggcagatgggaggagagcgatgcttaccagagaggcccaaagaagtccacaaggaggctacggacctgtgcagagatctgcgcgagggtaggggcagggtgagcgctagagcagagaccacgagggacacagcagcaaacaagggagagagagagaagagcaacgtgccgagggagggcagcagctaagaggagagagccggcgagagtgagacgagagtccagatccagtcccagttaagag

SEQ ID NO: 18564 - DNA, 496 bp, Homo sapiens
  misc_feature (1)...(496): n = A,T,C or G
gcaaccggaattgaacaggggnctaattacacncgtcnattgaagcaggnntaggtncttcgnanctncctgnacctncgtgnatncacgccagtcacttttgggnagnggcaaggcaggcaagtatcacttgcagcccagaaattcaagaccagcctgagcaacatgacaaaaccccatctctacaaaaaaacaaaattaggctgggcgcagtggcccaggccagtaatcccagcactttgggaggacgagatgggtggatcacctgaggtcaggagttcgagaccagcctggccaacatggtgaaaccccatctctactaaaaatacaaaaattagccgggcgtggtggtgtgcgcctgtaatcccagctacttgggaggctgagacaggagaatcgcttgaacccgggaggcagaggttgcagtgagctgagatcgtgccattgcactcccgcctggtgacagagcaaaacttggtctttaaaaaaaaaaaaa

SEQ ID NO: 18565 - DNA, 829 bp, Homo sapiens
  misc_feature (1)...(829): n = A,T,C or G
caggggtgctacactgtgcacccaggnctgnagatacactgagcatnatcacagctcactgcagcctccccctcctgggttccagcgatcctcccacctcaggctccgaagtagctgcgattacaagcatgcaccatcacaccgggctaatttttctattttttgtagagatggggttttgccatgttgcccacgctggtcttaaactccttggctcaagtgatcctccagcctcggcctgccaaagtcctgggattacaggcataagccaccatgactgggcagttcctgaagttttaaaaaacacagattcatatacgcactgcttcaatgcacatacaaaagagctctatcaccctaagaaactccctcgtgctgctccctttacgccgaattctcccactaactggctgcgaccaccagtttgctggctaacattcatagctgcatctttctgagagcgttataaatgaacagccacaacgtgtgcgggcgcggcatgcgacaacgacaccgcgctcgtgcgagactcgtccgtggaaccgcgctgcacgatctcctttctccgaggattcccaggcggctcagctacaatagcgtccggcgcagattcctcttcgttcgcacagcgtccctccaccactacaccggagtctgacaggcgcggagtatcctcgatcacgctcccacccccacacataccctccccactccaccgtcccagacgaacgacctcccgcggcttagcagagacagccgccactctccaccccgccacaccccgccgtgctcccggagactgtactccaccaacgcatccccggccacg

SEQ ID NO: 18566 - DNA, 506 bp, Homo sapiens
  misc_feature (1)...(506): n = A,T,C or G
ccgactaataccagttaaaataatttncaactgtnaccagcaaggaccccagtgcccagaaaaccaatatcagcttctatacagatacaaggtgatgctgattatttcatcaaccatcttggagttcccatcgtgcagtttgcttacgaggacatcaaaacattagaggctgaataggccggacgcggtggctcatgcctgtcatctctgccctttgtgaggctgaggcgggaggatcaccggaggtcaggagatcgagaccaacctgaagaacatggtgaaaccccatctctactaaaaatacaaaaattagctgggcgtggtggcgagtgcctgtaatcccagctactcaggaggctgagatagaagaatcacttgaatcctgcaggcgaaggttgcagtgagccgagatggcgccactgcactccggcctgggggacggcgtgagactctgtctctaaataaataaataaataaagcctgaatacaagacaaaaaaaaaaaaa

SEQ ID NO: 18567 - DNA, 294 bp, Homo sapiens
catcaattatttcagtgatattccagaagaagcattgttattatacaagaaacaaagctccacaaatgtgattacccctgaagatcttcttgtgggacaagatgtgaagagggaaggcagttatattgaatatcttgaacctgtgtaggcctaaactactatgtgtgcttgtgccttgtttctaataataaaagttaaaaagtttaaaaaaataaaaattaaaaatagcaaacaaatcttatagaataagggtataagtaaagatatttttgtgcaactgtaaaaaaaaaaaaa

SEQ ID NO: 18568 - DNA, 1119 bp, Homo sapiens
  misc_feature (1)...(1119): n = A,T,C or G
gccgccacctccaccaagcgtatggctcttctgtcattcgggatcacctccgacagatatgccttaccctgaaccacaccaagtatgcaagggaactcgcctaaccctcttagctacttgagacatttagaatttattatcttacgcttcgaccagtgatcttagctacccactccataagaatatatacattagagctgactatctcacactcatgatgtcgagctctgacgctactctgcacaacactgagagatagagataacagacctagcaagacgacgagacaagtcctcgccactgtngatatccatcactcgatgcagaacnaggacgacacgtactngaacgacagacgaacacgtaggagnaatgcacatggcagcgaangactcgaacagacagcagcttccactctcgccacagcgaaacaacaccaacagacggacgtcggcctacgactaggagcacacccacgagccgagcacacacccacacagcacacatcctacattctcaatcaccgcgtctacaccacactcatacagcgccacataccgtaagacgtcgacacgacagctgagacgcaccacaccacgagagaagatgaccgcaccagttacacgcgcaaatcnagaaggacccaagacacaccgcgcgactacanctaagacccgacccgagcaacacgcgacccacgcatacacctcgtcagtacggaaggagcatacatgcaccacagaccccccgaccgcatcgacagccgcacaccagtcatagacgcgatacgcacgcgcgagagcagcagaagtcccgacgaacgataaacnacgaaactataacacagcaacacgaacacacacagtccgaccaccgcaccgacggagacacgagagaccaccgcaccaccgccacccagagtacaacgacgctcatacagcgatagaccccccgccgtaccgccaagcgcgncagtagtacaccgncagccatcacgacgcacacnacaccagcgatcagtcacccacgcgccnaacagagtcactacagacgacgaaagacgaaattcgacagagagagatacacacgnagtacaaacagagncgatagctcacgcag

SEQ ID NO: 18569 - DNA, 531 bp, Homo sapiens
  misc_feature (1)...(531): n = A,T,C or G
cccgaagaaggccgattagatgtngttttcannctggtctgcatttttncactgtncaaaggaaacgacacctcaacgatgaataacattgnagatgaagcacagagcatttatatcggtggagaggatggcctggacatgccaagcttcagctgaaactcaagcctcatgcagttttctctgcttggaatgttctctgcccagccttcacctgcccagcttcttgtcctacaggtctcaagtcaaatgccttcttctcagtgaagacttccctggccaccttgtcaacataaatgtcatctggttattctctctccagcctgtggcctatttcttctaaagaacttttcagaatctcatccatatcttggtttacttgtttgtaaccagtggctctcctccagaatgtaagcctcaggaaagcagcacttcctccttgatgttattcctgcttcaatccttaacgtctagcccagtgcttaaatcagatttgttgaataaaggatccatttaaggggaaaaaaaaaaaaa

SEQ ID NO: 18570 - DNA, 784 bp, Homo sapiens
  misc_feature (1)...(784): n = A,T,C or G
cccggtccaccgttcgcagtggcgtgtattgnattgtgtgnaggcatgnaaagnaacacagtaacaccgtaacctcccaaagtatcctggttccaanactcaagaaatggttatgtttttccttattgttggaatttgccttttttacttgtgccatcaattttaaagcacttctgaaaagacataacatctaatgagatggcattttaaattcataaaaatacagtattttcctcaacttttatacatttatgatgcattatttcttatttcccgggaattttactacctttgttttgaatgattaaaaaggaaacgcagcacttttttcagcacgtcaccaagatagcctagttaatattcttctctttctgaagtagttgaattgggatagacagcttgccaggcctgctgccacgtgtcagcatcgcattcctacattcagccacacttgcatctaacgaccatctcttttattaaatttcttttgcaccttttctttctgaatgagtgcatgatacttaattttcctgtgcacttggctgactcaaggaaggttttaattctttttgtcgtgcattaatattaaattgaggttatcattgcgaaatggattatcctggccataagaaaagaaccgggcctcgttgaaccttaacgatggaagctctaggggccgctttcctttagtgagggggtgatagatggaacctgatcactaactacattacgctggaacatatgatttaagaagaatgatttatcagttacttataggcctgta

SEQ ID NO: 18571 - DNA, 942 bp, Homo sapiens
  misc_feature (1)...(942): n = A,T,C or G
acaagtagccggtgcaggnanaccgccagtgtccagtaccctcgggttcggctgctgctgctgctgctgctgctgctggtggtgccctggggcgtccgcactgcctcgggagtcgccctgcccccggtcggggtcctcagcctccgccccccaggacgggcctgggcggatcccgccacccccagaccgtggaggagcctggcgctggcggacgacacggacttacgggagcgcgcacggatgctggccgaactaaagcgccgacactggatgaactcgaacatgcacaagctgatggtgatgaatgcacactgaacacgctgaccgtacgcatattaataaagacgatgcactgaggtcacggaacaaagagagaacagggggcttcatttggagctaaatgatagaagaatctgaaatgcagtatacctttagagatgggcatgccagtacaaaacgagcgtgactgaggctataaacataaagatagaacggaagaagaactgacgcccgcagcgccagtcgagcgcggcgcaggtacaggctagtgagcaatgattggtacaaagacagacgctcgcgacttagttatacgaaaaagacaaaccgcagagtccatacgtcaacgagcgaggcaaccgctacgacgtaaacttcgtaccatgagcatacacgagagacgaggccttctcacaaaatatgtagaattagtgacgcatggagagagagagagagagcatgacaattcagcgttgaatcgccgcgatacagagatagatatacacacaaccaagatagccatcgacgnaacggtcgggacacgtagatagcgntgagcgagactcgtcgtcacgttaccccgatacgaggtctataggagatagactaatgcagagatcgatagagtaagacanatcactatgcccgcctgaagctacatat

SEQ ID NO: 18572 - DNA, 850 bp, Homo sapiens
  misc_feature (1)...(850): n = A,T,C or G
acgggtattcccgagctaccgaatgagtgtcagcgtactggcagccctcgcttgctcttggcgcctcctcggccttggaacccacactggccgcgcttgaggagaccttcagcctgccgctgcactgtgggagcccctctctgggatggacaaggccggagccatctacctctgcttggggggaggtgtggaggaacaacccccacacagccacaccccccccccaccgcccaccacccagaaccaacacagagccccgcccccccaaggaccgcagaaggagaaagcaccagccagaaatgacaaacagacaaacgcagccgacccaccagagaccgagacccagcacagagacgcacaacaaaccaagaccaacaccagcacaccgccaccaccacgcatcccccacgcgcgccgccaccggacccgcccgacacactagagccaccccgcagagagcacccaccaccagcaacaagaccacaccacacccaggccccacctcatcaaacaccaacacaaagcaccccaagacccaccctaacgccacacagatcatactacaaagcaaccagagacccaggagacagccccccgcagcgacccaaaagacgacaaagacgaccaaccaccaaccaattcccaccactacacacccagcacaacaccaccccccccccagacaacagagaccccacaccgacaacgcaacagaccccgccaccgcacccacactcaccgccatacccgaaaaagncggaccgacagaccaacaagtaacagagagcaaagagaacaatacgaaccagaatagaacgaaaataagatcacaccaagctatagccacacg

SEQ ID NO: 18573 - DNA, 827 bp, Homo sapiens
  misc_feature (1)...(827): n = A,T,C or G
tggtggcgagctgccatgccatgtaanacctcagtcagccctatgaaaagtccacttggggaggaactgagacctcttgccaacaaccatgtgggtaacccgtcttggaagacgatccaccaaccccagtcaaggcttcagatgactgtcactccagccaacatcttgactacgacctcatgagagactctgtgccagaaccacccagctaagctgctcctgaattcctgacccccagaaactgagataataaatgtttattattttgagccacaatatttttgggtaatttgttggaaggcaatagataactaatacaggctctcataatgtcatttatttgggtccagtcagcatgctttaggatctgggagtttttttccttcatccataatctaacagcaatataaggaatgcaagaaaaagaaactaaagagacttccctgcattctcctggtattggtggatgaaacattggactgtttacttattacctgctgagtctgaagggcttttgcttgaaaaatgttccattccggagagaagactatctgctccggtgcgtccattgcaccacagcctctgacacatgatcaccgtacacttactctatctgaccacgcaacccccgacgccccccatgaaccctcattacgaggacgccgcgcgccacccacgagtgaccgcgacacgctcgaccctaggcacgacgccagccagagccactcgcatccgctgcacctggaggctaccccaaccagcgcacagtccccaacgcaacgcgcaatcgctaggacgctccgcccaaataccacccgtctcagatg

SEQ ID NO: 18574 - DNA, 430 bp, Homo sapiens
  misc_feature (1)...(430): n = A,T,C or G
cagcggggggcccgatgggtgaatctaaaatcaacacttnagtggtgccctcacaagagnaggnattaaacacctctgatccagaagtgcagggaaaatcacattccctgagcaagcagagtcaagtctctctctgggtgtgttgcctttggcaggaatggctgatttggacctaagagtatacatactaaagcattaagaagtttaccttaactctgatttgtggctatctgctatcttaaaataaaatggcagctcagagatttactaatgagcatattttctgtaattaagattttaataacattttgaatgtggatgggatgtagacctggctccaagggaagaataaaacatgtcttttcaaatgaagtgtgcattttcaatattttaatatattaccgacagtggtgaaacaaaaaaaaaaaaa

SEQ ID NO: 18575 - DNA, 722 bp, Homo sapiens
  misc_feature (1)...(722): n = A,T,C or G
ccgggaaaaccgagttaactgaaggtgngccatnaaaaagnaaagaaaaaaagaagaanaaaanaagcagnaagaaaaanaaaaagctgggtttggagcagtggctctggcctttaatcccagggctttgggaggccaagggcgggaggacatttgaggctaggagttcaagacagcctgggcaacatagtgagacttcatcgctacacatacaaaaaaatagtctgggatggtggcacacctatcatcccaggaattcgaggttacagtgagctaggaccatgccactgcactccagcaagaccctgtgtcaaaaaacagaaaaacaaaactaatacattatgggaagaaattgttaaggcataaagtaattatacttttcacattaatcagttttcccttgtgtatctagttgctctctcatgggttgattttaaagaaagataaaatgttgtataccttttatctgctggattcccttaagcatgatctcatttaattctcaaaaaattctaaaagacaaggatcaaactcttgattttatgactgaagttaatttgggctcagagaggtcaagtacaaatacaaatgacgggactaagaagggtaagataatctgatttctctggctccaacttaatgctttttatttacaaggctaacctacctcaatagcctaaataaatttgtaagttataccaactttcataaaaaaaaaaaaa

SEQ ID NO: 18576 - DNA, 964 bp, Homo sapiens
  misc_feature (1)...(964): n = A,T,C or G
ccggtattttccaggtattatgagcattttgctccattttcttaaacttctgttttccaatttgatgatgcattttcatcccatttgcttgcttttctgatttagcattacttttatgaattctgtaccaaattgcatcaaccggcctaacctaaatctgttttaattaaccatttgctcttctgtaacaattgtgtgttccaaggaatctacacaattattgatgtgatgtgacaaaagatgattatgaggaataacgttactggatatcgttacaaaaaatgggtgtctaacctcaaaatattgaacataagcaactaggaagaagggctctgtagcattgattttcattgtgtgtgtgctaatatttacatttataattaaataaactattcgaaattatgctcgaactgaaaaaaaaaataatattggccctccttgcgcctcagcggctggagcctctgcgggccgcctttcctttaatgaggggctaatctcatggatccctcactcacttgactcggttgcgctcgagaggatcagggtagcggacaagcgagaatcaagctccactccacgaggcggctaatcacgcggttatcccacagatactcatcgtggataacccccgggcaactgaacattgtcgagccacacaagcccatgacaaacggaccctcgtaaccccgagacagagcgcccgcncgtcgcgtaggacgacattatacacctaagacgctccggcctcccgcctgnacgnagacatctaccacatgacactcgactgctcttacacctcaccgaccggcggctctgaagcctcgcaccagccaaccctttcccagcatcacccctgtcgatctcccaaccactggagatatctcaccactaactactcactctctcccgctcttacatcactcctcgcgtcgcattatgccgcgcgataacccacgttcccaca

SEQ ID NO: 18577 - DNA, 455 bp, Homo sapiens
  misc_feature (1)...(455): n = A,T,C or G
acgatgtgccgctagtgccaccggctctcacgcagccactgcggnaacagatcttagtttctgaggcaagtgcttcagccgagtctggaggtgatggagacgcatacatcatggtaaggaataaggccatgccggagcactgcctgcacgccaggggggccaaatgaagtgacgggcatggctaagatgagtctctgcacttgatggatcagctggtgccatccagatcgataaactggctcatccaatctcttggcccccacccaggaactgactcagcacaagaagacagcttagactccctacgacttcctctcgcatccaaccaatcagcactcctgagtcactggctgcccacagcccaccaacttatccttaaaactcctatccccaaatgcttggggagactgatttcagtaataataaaactctggtctcctgcaaaaaaaaaaaaa

SEQ ID NO: 18578 - DNA, 386 bp, Homo sapiens
  misc_feature (1)...(386): n = A,T,C or G
ccagtaaacacttgnacttattaaacattaattttaccttttganacattccttaanatcctgcttactgatgaaactactggctcagctggtctgaaagatcctaccgactcaagctgatctgaaggactccatggatgccagctggtctgaaggaccccacaaggagctaactcatgaaagaatgcagtttccacatcctggtgatttcctctcccttgccccgatcaaccaacaaccccaattttccaaccctttaccttccacgatccccttaaaagccccagcccagaactccttggtgagatggatttgagggtctcctcttgtgtcctcacttggtgtgctgtgattatgaaactttctctgctgcaaaaaaaaaaaaa

SEQ ID NO: 18579 - DNA, 343 bp, Homo sapiens
  misc_feature (1)...(343): n = A,T,C or G
cacggggtcccgaggtctcactctgttgcccagctggnatgcagtggcatgatctcggctcaccgcaacctctgcctcccagctcaaagattctcctgactcagcctcccgagtagctgggacctacaggtgcgtgccactaccggcttggctaatttttgtatttttagtaaaaacgggggtttggcatggtgggcaaggtgggattggacttttgaccttaaatgaacggctggctcaaccttccaaaggggtgggaataccagaatgagccactggacctaaaccatttggctttttaactattggaaataaaagccacttaaagggaaaaaaaaaaaaa

SEQ ID NO: 18580 - DNA, 885 bp, Homo sapiens
  misc_feature (1)...(885): n = A,T,C or G
ccggagggactactccgagggnaacatggtgtgagncgnctgnnagacancatncctgnccatgggnnccacttgtncatncttncgntnctggnacagncagncacgnaatcatgggnagtgggtaaattttgaagcagcaaaatgtggcccactgaacagcgcgtcagcagaactggaataggacgaagagaaccctgtggatgcacatcgaacccgcttaccccttgctccagctggggtcccagcctggtccctgcagcccattaattaaaatgaggctgagaagattcaaaagacagcatcttcatccaccaggccaaccacaccatcacccttgttagtttggccaagtctacgcagctgagtacttggaagaaatgggaggatgaggtcagagcacgcactctccaccagaatacactgggattctgccgcaaatgcaagaggttcactgtgcagggagaaaacactatttactgccagagacgctggtaaaattctggcccgacactgcccttcaggcagcgcccgcccccccgttgtcctccccccccaacacctgcccctcccacaccctccccccgccctccctccccccccacccttctatgcggtcccctttccccatatcccccttctcacacccccccctccacgccttcccccccctccaccacactcctctaccttcctctcccaaccccaccccctaaaccatctctcctcttctccctcttactcttcttcgcttccccccctccgcccctcccccaccccaccaaccccactcaccctctcccgctatctcaacacccacctttctccttctttcattccctcacaaccctcccccgacctcttctctccccccagacctccaca

SEQ ID NO: 18581 - DNA, 838 bp, Homo sapiens
  misc_feature (1)...(838): n = A,T,C or G
actgttacgtagcaccttcggttttacttccctgtcccatctataacaagccagttcgaacggacttgaactacattgccgctgtggatctcaggacagcccaaacccctgaacactgggtgctccgtggggttgcccttctgtgtgatgccaagtaacatgtggggagcgcccccacccactactatgcaaaatgcaacatcctaaatcatagaacactctacttctgactgactgccggcacacgtctgtcccgccgctcctcccactaacgaacaccacaagaccccccaactccttcatcgccataccaatatccccccacacccaccactcaccaccccccactctcaccccgccacactagtcccacccctaaaccaacgaccaaccacccgaccaatcacaaagaacccctaccagccctactatactccacccaccctcaactcacaatcctactcacnaccaaaccacctaaaacatagacccctccttcctcccaatactctcacttcctattaccacacgagaaaccacctgaacctcaagaacatgataccaacccacaccaccccagaatcaggagacaaaacaccacagcccagaccaccacctcacaaccatccaaaaacagatacattacaacccccacccncccctctgcctctcctcacaccaacacccacccacaccccacaaccccccatccccactacgcagcaccaacatcgccacccccacaaaccatactacaccaccactctaaaaccacgaccacggatgaacgatacccctataacaatagtatcaaatataaatatcaacataacaccct

SEQ ID NO: 18582 - DNA, 856 bp, Homo sapiens
  misc_feature (1)...(856): n = A,T,C or G
gcgcggcagacagagcggaaatctgcaaccanctccanaataagttcatagcggtgggcctaatattgactggaaatacaccttgacgagttagttttgagtctctgttaacagcacagggtatggctggatggccctcaagactgactgcgacaaattataaagcaacgtcgatgctaacgccagaaacaccaaggacgaaatgcttgagcccctacagaactggcaggaagcagtagcttaggaggctccgaaagatgaaaacactaagacagaagcacacctagaaactggagggaatccacatggtgtgtttgttaaatgaatgaattaaagagagaataagtagactcagattaccacctggactcaggacatttatagcaacttaatgggctgaagttttgcaaaagttgatcctcagtgctaaacatcaggtccagctgaagggttccccagaggggtgtgggcatgggaggatgacagaggcccccctngtcccacatccccaacactccccataccccaacccacatactcacacatccgacaagcggccatagccgtctatccctcccccccaccacacccccccccccccagcccccacccctcccacccactcacaccagaccgaggaacactccccccccgtcacccacgatccccaatcacccatccctcgcactccaaatcaaattcatcacaacctcatcccctgacccaccctgccgtacctgccagcaccacatccacccgtcaactcccccactaaggccacaccacactccgcgtctctccccgaccctacctgcataacacgatccccaaacccccttcacaccacactcccccc

SEQ ID NO: 18583 - DNA, 936 bp, Homo sapiens
  misc_feature (1)...(936): n = A,T,C or G
tacccccctgcccgagaaagataaacttccggaattgtaantcgtcgcttccccggtgtngnnccncncgagaanctgngaannatggnccnataggggattggttggggtaaccttcggggncttccaacttggcccaaaccccttcccccccctttttcccccggggngtttccaaggcccaatttcctccccttggcccctcaaacccctccttgggagttagggctgggggcatattaccaggaaaccgggagatttttcaaccttcccattccaacttccaaaggggcttggggaaaaaggcccaaagggggcccctgtaaaactcctccagagttttaacactgggccaaccgccttttccccccccttccttgggggggtttctcaaaggggggaaattttcctttgggggccccccttaaaacccccttttttggtggggggggacacctcgtggagaaaaataatccccagaggcgctgtgggggggcccccccctcttctaaaccccgcgagattagatatatgtttttttggggggattcttcttaaaaaacaaaagaaaagaaagagcggggggggggtttttttcacccccacaaaaacaatttatttggggcgttctcgggggggtgggggctgcctttccccaaaaaccccccccccccccaaaaaattagtaagcggagggaggatttctccctcacccccccccccccctttttttcttctttctataaaataagagaaaggagggcgggggggggggaaaccccacacccccccgccgcggccgggaacaaccgnccccgctcggcgctcgccctccccccgccgcccccacccccccccaaactatttctctctcntctgcttntatctncatcgggacagaagaaaaaaaaagatagggctccgtcgccccccccc

SEQ ID NO: 18584 - DNA, 232 bp, Homo sapiens
  misc_feature (1)...(232): n = A,T,C or G
gggatatcggccatctgtgctgcggtacatcttacggnaagcaacagtagcaggtggtctggccatacagggattgcttactcgcagcacacaatgttgctgccactcaaagcaccaggggctgaacagcttctgtggagacccacatcatctaacagcacacgtactgcccacagggcaactgccccttccccgcacaggaacacaccccccttccccccacctgacctgg

SEQ ID NO: 18585 - DNA, 192 bp, Homo sapiens
  misc_feature (1)...(192): n = A,T,C or G
gaaactttcggatcncagtactcctgaacaaccttgtaagctactgcttggaaaaaagaacagtaacaaatacattatcagaaactggcccaaaccaagaaggaacaagacacaatttctctctcattgctcttgtcactgctgagggttttaaactatgaaataaatcatctggcctgaaaaaaaaaaaaa

SEQ ID NO: 18586 - DNA, 436 bp, Homo sapiens
tgaccggtgatactgtacagaagaaaagcctgggcaatgccagacctgacacacgcatgccgccactctgacacggaaagcggccgggatgtcccggcatgataattaaaccatcctgtctaacagagtatcgctctgttgcggaggaggaaatctttcttattccttacacacagggtggtactggccaggtactatatatcgatccccttcccacttacttgttatgcccacttactatctattttctctgcactacacatttggatgcggcactggtgtccactaatagaaatagttcccagtggacgctaccctggctggggcactgacaatattgaggactatgtgacggaaaacaccaagagatatgctctctttgtactcagcgctgtagatctgtggtcgcttaacctaagcgggggtaacatcatga

SEQ ID NO: 18587 - DNA, 279 bp, Homo sapiens
  misc_feature (1)...(279): n = A,T,C or G
ccggagagcaactagccaaaccccagnagatatggcacaaccaagggacaaaagctttccggcacggaagatcatactataaatattaggccgatagattcaaacactccacagaggttgggagaatcatccattattataaatcacattccttttatttaaaggcattacctcaaaaagaggtatgtacttttataagcttctttttttttgtttttaaataaacacatttcccctgagagaaaaaaagaagaggagaaaaaaggaaaaaaaaaaaaa

SEQ ID NO: 18588 - DNA, 253 bp, Homo sapiens
  misc_feature (1)...(253): n = A,T,C or G
ccccgctacagaaacaggnagcaaatananataaagagcttgcccaattttagaaagctagtgagtgggacagctaagaattcatctcacacccgaccctggaactgatgctcttatcacttcactcttctgccttcccatgatgaggcaggtacatccggggcagtattgctgtctaggctgttgttacattatggtgaaagactaattccaacatgaagaataaatcaaaaatttattaaaaaaaaaaaaa

SEQ ID NO: 18589 - DNA, 1220 bp, Homo sapiens
  misc_feature (1)...(1220): n = A,T,C or G
cccgccgggtgcgccgcccgggccgccccaaaagaaacaaacgagtttcggtgtgtgctcctgtggnacctgnactgctaacaacacacaaagcacacaaaacaaaaccaaacaacaacaacaacaaataggcacacaggcattgaatattttgagtcaaattcttcctgggcactgcaagtatggcagcataagcgactgttgtatgtgtgtgtcttaactttcttaggcaatagcatgcccgatccccngccccgccccccccccccccnnacccccgccnccccgcccgagatacgccccgcccgcaccaccaacacccccacacgtcccctctcacctcaatcgcccctccccaccccccacatctacccctccaccccaacccagcactaccccccgcttcctccctaccccgccctcgctcaacccctcatcgcctcctcatacccaccatcgcccctgccaaccctatccctccacctacattacaccgacacactcacccccccgtctctgccacctatatatagaacattcaattaccccccccatactttcctcgacacatctgatccaccccgcccgaccccactctcgccccgctcgacctctcgtctcccccctcgcccaccaaaacggcgcgccacgtccacagcaacaccaacaacacccaactatcccccccacgtcttacatgccgacaactactccacgctctgattcacccactccccacgtcgtcatgcccaccacaacatatcccacacacccgcgacatcgcgcactgcaaaccacatcgccgctcactccctcaccacccccccgccatctaccacacccaaccagtcatactctaaacaccgacaccagatcactccgctcactcctcaatgaccactggtccattaatacatgctgcgtcgcagtagtcgacgcgtcactcanactacactcacacacacacgcagccgacactctgctcgtantccatatcgcactacctacaacgcaccctactcacnacatcgcccgtcacataccgctcatctaccccatcgtatacaacactcaccacctgccggcgcgactcgcgacaccataccgtcgagagtatccagctctactggtntctcttcaccactcacactacggatatcattcccaccttaagcgctcctgacatcgtacgcccgctacgtgccnccgctactgtaccc

SEQ ID NO: 18590 - DNA, 382 bp, Homo sapiens
  misc_feature (1)...(382): n = A,T,C or G
acagaaatcgtccaagacctgcactgnaggctacagctggccccacccagaacaatgaactggctcatctgatctcgtgcccctcctccccaacccagtaactgactgcgcattgcattctggtggaacaactgatgccacccagacttgtgacccccacccaggaactgacagaggcacagcagacagttttgataaccctgtggtttcatccctgaccaaaccaatcagtatttgccatttccctagctccctgcctggccaaactaatccttaaaaccctagcctccgctttttctgggaggcagatttgaagaattgtttaatctttcgcttggttgggcttgcaattaaaatgttttttgctgcaaaaaaaaaaaaa

SEQ ID NO: 18591 - DNA, 401 bp, Homo sapiens
  misc_feature (1)...(401): n = A,T,C or G
cgaaacagcactcctacgtcaccacggnatgtttgagtgacacgaagtctccatgtcatggatggccaggcagctgctgaatgaggcatgctcacgttctgattccccggattaatgaacctcactcctgccatctattacatccctctgcaatctcctactcacttgaatatcataagcctacgtttttttgcccacacggcagaaaatcgtccttatacctgtgacccctcaactgaaactatcccaagcgtcgtttcacggaacacaaagagactgcctcccctcatgcccgccactactgaccctactgcagcgtcgcagaccatccgcccaatcacggcacctggactcactctaccactccccaacccaaccccctaaacgcccaatgcacaccc

SEQ ID NO: 18592 - DNA, 194 bp, Homo sapiens
  misc_feature (1)...(194): n = A,T,C or G
ggagttccgagcagtcctgcccggacaagttggnagccctattctcgcattgaccgcacaaacttttctaatgaaaaaaccatctctaagcttgaatactctaattttagcgttagatactaatagcaagagaaaaattggcacacgctgaacaatggatactgcctgcgcttaagcactgtgcgtgctcacaa

SEQ ID NO: 18593 - DNA, 835 bp, Homo sapiens
  misc_feature (1)...(835): n = A,T,C or G
cgggtaaccggggacattgcttttctttntgcactttgtgnagttgnaanagctactgggaaaggaatcagagcacctccagccatcagccagtggaggaaaccaagcccttcaattcaacatcccttcaagaagagaattctgtcaccaaccaagttaggttggaaacagatattccccaaccacgcgcttaagaaagaagacacccgccctgggtggacaccttgactacctcctggggaaagaccctgaaacaaaaaacccatctaggctatgccgattcctgacccatgggaaacccctggcataataaaaatgtatgggggtttataactccagaaaaacaacgaaagacggggctcgtctgggaccccagcgggagaacggagagcaaggtaggtttcgataggggcgcccccggtcagcgaccgcagccctggccggctgcgccctggtggagccgtcggcgccgcctgcccatccccccccgcccgccaccgtgcgccgagcgcgcgcgcgggctcgccgcgcgctccccgacgctgggcggacccgccgcgggatccgccagccggagccgcccacgccggcccctgcaccgcccgccgagccgcaccggccgctcggcgcccaggcaccggccgcgcgtggaccccagccgctcgaccgaggagggccgtgcagagaagagcagctcgggcgcccgaccagttcgccgccacccgcgcggggcgcggcagtgttcgcagagaacgcccgagccgcccccccgacgatgaccgcgtagcgcagcggtgcggggaccagagcgcgtcgcagcgaggccccagcggag

SEQ ID NO: 18594 - DNA, 410 bp, Homo sapiens
gaaaccccttttcttcccggaaggggggggggcaaaccccccggggcccccctttttgggaaaattcggcccgaaaactttttttatagaggggttggttttcccccccccccccatttagggggcccaaagaacccccccctttgtggttaaaaccaaagagccgggtgttgtgcccccccccaaaaaccactaagtcccccaaaaaaggagggccccccacccccccgctgggggggcggggggggaaaaaattttttttgtgggtgagaaaaacacacatcctttttttttttatagggaaggggggggcctttttatatttttcctcggcggggaggagggccccccacccccattttttcgaaaaaaaaaacgctaacaacttctcacattggcggtgctttttt

SEQ ID NO: 18595 - DNA, 821 bp, Homo sapiens
  misc_feature (1)...(821): n = A,T,C or G
ccgaatcagcccgctgataccctgatggaatctncgngatccatgtttgcccctgtgctccctctgcctcctgaccaacctggtacttctccgtgtggccctgcacagcctgccctgcctcctgtttccagggatctgtatgaaaacttcttcctcatgacagtcatcttcatgtttgtgtgtctcatcacacctgatgtttcactgggcaagttcactttcacagagctgcagtcactcctaagcctgagcccacgtgaccacgattctgcttcgagtctgatcacagctgcaattcctggccatgtgactgtggacaaataccttctcctctcaaaggctccattcgctcatgagtcagatggacatacgaacagcttcagcccttgctttatttaagggaatgccacaacaaaaaaaccttgcggactcactgactacccacgagtcaacacataaaactactggccccgatgacctacccgacacacgctctcccaccctaaacttatacgcgggctaataaaaaacccaccctccctacccgtatatcttcaactatctactctcttcacctaccccaccttattcatgatcacgtgcagccccctcagcatatacctaatcacctccccatatacccaatcactcaattaccacttctccacgaatgaaccagataagcccgttctcactacttcttcatcaccagcactactccgcctaccaccgcgcagccgcacgatgaccccgactagacctcgtcacccctccgctccaccccacataggcaaattcacatataaaagcacatacaaaag

SEQ ID NO: 18596 - DNA, 433 bp, Homo sapiens
  misc_feature (1)...(433): n = A,T,C or G
cgggggtcgaatcccagaggggggaatcatttngnctnctntnnncctntntnctnncannctnnttngtngnangntctngnnannaaagancttacnatnggcncaatgggnnaattncagnnanncaacccttnccagncncattcagncgcagtaggagnaaaacccaagtgccctttgcagattgcaaccattgccctttgcaaggaagaaggaaattctgctcacccannaccaagttaggtttgggaaacagattattccccagccaagcgctaagatgagacaccagccctggctgacaccttgactacctcctgtgagagaccctgaaacagaagacccatctaggctatgccgattcctgacccatggaaacccatgccataataaaaatgtatgttgttttaaactactaaaaaaaaaaaaa

SEQ ID NO: 18597 - DNA, 842 bp, Homo sapiens
  misc_feature (1)...(842): n = A,T,C or G
ggggttttccgagggatacttgcctattctttnctcactttgtggatgttgnaacaagctacatggnaaaggaatcaaagcaacctccagccatcagccagtggaaaaaccaagcccttcaattcaacatcccttcaagaagagaattctgtcaccaaccaagttagtttggaaacagattattccccagccaagcgctaagatgagacaccagccctggctgacaccttgactacctcctgtgagagaccctgaaacagaagacccatctacgctatgccgattgctgacccatggaaacccatgccataataaaaatgtatgctgttttaaactactaagacaaaaaaaaaaaacagacacgaacccccgcgccgcgccgccacgcggctcagccgaagaccgctccgcgacgcgctgcccggaccagtcagaccaagtccctctagggccgctgcacccgtgctcacccgacagccacctgaccgcgccccctgccgcccagccccgcgcaccacggcgagcctgggaggccccccacccgcgcctccagcgtagtcaactcccgcacccctagccacggtaccgcagcacccacgcacgctattgggtctttacctccccctgcgccacccccccccgtacctgctcccctcgctctctccccgcgacttagccatctccgcgccccggccccgcacgccgaccccgcgccgccctaggcccgcccccccgccccccccgcccccgaggagccgggcgtaggctctctcccttagacatgccgtgaagctgggccgcggtgcgcacggcgggaggcgatctcccatcccacctatcag

SEQ ID NO: 18598 - DNA, 171 bp, Homo sapiens
cgggccccgagaggaacaggccaacacatttattggctgcagtgagctttttaatgctacacagttcataaaacagttgtcacaacttggcacaaagcaacacagaagaaccttactatgataatctacttggaatgtggatcaatgcaaaaagcaagaacagctcccaga

SEQ ID NO: 18599 - DNA, 1054 bp, Homo sapiens
  misc_feature (1)...(1054): n = A,T,C or G
accaagttcgtctgattggtctagcanattactacatccgtgcttgggagaagcaaaacaaaaaacatagaaagtaaacgcgctgagtacaaagtgccaaattgcttactttatggcatgtaaaatgtgacaggtgtgactacaagaatcacgcacggagtttgagaacatgtcttcaaacagaaggcatcttatgaagaaaagaagatctacacaaccgcctgagaccacctctacaggaaggcaacggcccactacctcacacgaccgggcgcctccattctactaaccaaaccggcgagctgcgcgcatcggaccgacgcgccctgcctgcacgtgtctcgatccccagcgcctgccctccacaccaccggccctccatgcgtgcgggggactctcgctccgtaaagcacagagtcacgacgagatcaccctcgaacatccgtcacacgaacacccatccgacacccctccgccctctcaccctcctcatacacccaccccacgtacgcaccaccatccctccgcaatagccgccgtcagatacgtatacacactacactacaccaatgtcaccacgatcccacacacataaagtacacacaacgcgcccacattcctcctcagcacacgccaaccacacccatacttacgacatacgacacgacaacccttcgccacaccctacatcctctaccctggctaacgcgaccgcacacgcctacgcacacccagacccctagacgtcacacacacgagcacgcgcacacaggagcctcccccaactacagcgcgcgtgcgcgccctttcgatcttccatccaatccccctcgaaccacacaactcaccgacatgcctcctcacccattcacgcactgtaataggatgtacacacactaacgtacattcctacctaatcccacgctgcctaatcgacccgccacgtagcacggcagctcattccaatcccncagaatcaaactcccactcacggcccagtaccaccccacgaccacgcccacctccctccgagactcacgtccccttccacgcg

SEQ ID NO: 18600 - DNA, 456 bp, Homo sapiens
acgtggtattccggctgtatacttcgcttactaacaagacacaatctctttaaaacggtggtccacaaacctgtagcatggacacaacctgggagctgttagatgcacaatctcaggcccatcttggatggcctgactctgcaggtgtctgcattttaacaggatccccaggtgattaataaacatgatatggtttcagatgcacatcttcagttcatctgacttcccttctttgtggtccaaatatatcaactccaaataaaatgactttatacttacagtattaaacatagggtacagtatggagtctcattttttttgagatggagtctcaatctgttgcccaggctgtggcaggagaatcgcttgaacccaggcggcagaagttgcagtgagctgagattgcgccactgcactttagcctgggcaataagagcaaaactccgtcaccaaaat

SEQ ID NO: 18601 - DNA, 579 bp, Homo sapiens
caaggctgtcataactttcttcccacgctgcctgccagcgcccccgaccccacccccgtttcctgtaacttctcctagatatagcccagctgggtcttctcatcataatgcaaatgacccaaggtcttaagcccgtcagcgtggaagggaacctccagcagaaaccggccactccaaaacagagaaagacgacagccagagccatgacccagcacagctcatgcaaacactaggatccataagaaagtgctgtaccttcaaggagaggagaaacaggtactccctcaggctccagtccattcatttcttcactacttcattcattcaacaaaaactgattaaattaccgggttcaaggctgcgtccctatattcaatggtacaaatataacaacccacagaattaggatgtagatacacacagacacatgtatgtgtatacacagattttattattcatgtgtgtgggttgggagagctattccaagaataatctgaaaatcattggtatcaggctttgaaatgcatcgatgccttttaatacatttacctccttggtgatgtttgaaaaaaaaaaaaa

SEQ ID NO: 18602 - DNA, 259 bp, Homo sapiens
tcggcaggtgtgccagtaaatgtttaacaaccagctctctggaaagtagagctctgacttacatcctttgccaattgccgtggtttaaatactcctatcatggttgagttcaagctaccaacatgacatcaccgaatacagaggagaagaggtgcgtaatcaacagcacaagcatcatgtagtatttacacacagggacaataaagtatagataatagtaaaatgaaataaaatcattagaaaatgaaaaaaaaaaaaa

SEQ ID NO: 18603 - DNA, 567 bp, Homo sapiens
  misc_feature (1)...(567): n = A,T,C or G
agacgatgacaggcattcaccgcattaatcagnatggtctcgtctcctgacctcgtgatccgccagcctcgacctcccaagtgctgggattgcagtagagatggggtttcaccacattggctaggctggtctcgaactcctgggccgaagcaattcacctgcctcggcctcccaaagtgctgggattacaggagaatccctgttttctgctgtgcctttattgttccataggaattcaagtctgaaaatcaaatttatggccatttttaaggacagaaaagcactgagagagaactcttcctgccttatcaccccatcaaaatggctgttccaaagctgtcgatcaccaaagctgtcatctacaatacccagacatcgttagtctcagaagcaaaaacattctacattccagacatcattagtctcagaagcaaaaacattctacattcaatttcctattcaaagcatactggggtggaagacttaatcattttataaaccctccagacatgtttgatccatttcaggttctactaataaatgttccttactctaaaaaaaaaaaaa

SEQ ID NO: 18604 - DNA, 297 bp, Homo sapiens
  misc_feature (1)...(297): n = A,T,C or G
cggccaggtgatgagatgcttgacaccaggnananaccgcctcggcagcaaaagagaccctgtctctacaaaaaataaaagtaaacatagtcaagtgcagtggtgcatacctgtagctccagccacttcggaggctgagatgggaggatcatttgagcccaggagatcgaggctgcagtgagctatgattgcaccactgcactgtagcctggacaacagagagaccctgtctaacatgaaatgaaataaaataattttaaaaataataaaaataaaataaaattaaaaaaaaaaaaa

SEQ ID NO: 18605 - DNA, 827 bp, Homo sapiens
  misc_feature (1)...(827): n = A,T,C or G
ttcgggcttctacaaaggtaattgattttaaagcatgcctttttcttctcctacatatatcctatccatctgactaaaaatccttgaagtagaagatggcaaatccgtgagtaatttctttacccacataaaaaaaaatgagagaagcattaactctagctcatcactaaggttgaacaaccgcaactacagagcagtttgtgaattaaagacatttcttaaactcctacagctatnaatctccacccttggtagagctaacacttggaggctaagaaaaaagaagaataaaaaggaaactttagnttncttttgaacagnaaagaaaagagnagnagncttgaagaaacaaactgttctttnattcttggaaaanaaaaaacaacaaaaaggaccctnatactgggatggacanaaaagcnnncacnnattaccannnanacacacaacancccccaaccaggccacaattgcccagacgccacaccaccccccttccccccccccaggaaggccnttccatcacccattctattttttctacatccctcaactntctccctgtttcacgcccccccccttccgttccccccttttctatccgcctcacccggcctccgcgtccccccctttttttcccttttaccagcgtccacccccgcccccccctcccctcccccccttccctcccttttaaccntttccatacccccgccccctttctccttttttacacccctcttcttttttttccacccttccccccttcccccctcccgcttctctcccccgcccaacccctccccccctatcatgtccccccactg

SEQ ID NO: 18606 - DNA, 343 bp, Homo sapiens
  misc_feature (1)...(343): n = A,T,C or G
ttccagttggccgctgnacctgaactgaaaagtgaaatgcagnatgataggaaactgtatacaatactgtatatatagaactaagaacactcgctgtcaaatgtaggcctccagtaaatggacttgcacttattcatactatttgtatttattctaataactttgtattttaattagtctcaagttttatgtaaacataagtaactttgtgcataaatggatatccacacctccaaatgtatggaaaatcataccaataagcaaaatgcttctggaaggtataggtgaagtcatataataaacacagaaaaaaaattttgtttgcttttcaaaaaaaaaaaaa

SEQ ID NO: 18607 - DNA, 377 bp, Homo sapiens
  misc_feature (1)...(377): n = A,T,C or G
gattacagacgacaatacaccgngagtactggntaagttggnctgnatagtaactgacatcanaaataccattcaaaacgaagagccagtgtcaagatcctgtatacccttcctgtcattactcccaagtagccttttcatggacccagcttgttggataaaaaggaatgaacaggagttcaccagccatcagagaattgcagctaaccctaggttaagaaagaataaccaagaacagaactgacaaattaagtcagtcagtgccacctgcagttggaacaatgacataaatcctgccacattttttatgggaaaatctaatggaaactgttccgaagaaaatcaataaagccatcaaacattgaaaaaaaaaaaaa

SEQ ID NO: 18608 - DNA, 905 bp, Homo sapiens
  misc_feature (1)...(905): n = A,T,C or G
gtaccacagtgacagtcagnataaaagcaacacatgcctgtccgagagtgctgactgagcaccaggaactgtgctagaagttagaagctaagtgatttgccctgagtcacacagttggtgttgcgcaacggaccaggaacatgtatccctatctgtgcatctggccttctccttgggatactaggaataaagaaagtgatcattgtctacgtcgaaagcctttgccgtgtaaaaacgttattcatgaccggcaagattatgattaatcactcatattacttcattgatgagtgggcgactctgaaatcaaaatcccaccaatttatgcgcctccattcacaccgatatacatcgccaccgccttctttttcccttttttatttactcacatttcgagctcaaatccgcccgtaaaacaaccctcaccccacttacgcctcgatcatctcatcacattcgaaattaagtccgccatgcatcccacactgcccttccctcattaccccaccacccccgttacttccccactgaaccaaacacccgacaaacagttatcccaacaacgcaacgcctcacaaccacacaactcccaaccatagcacaccaccttgcacccctcaccccggtacccgtcccccctttttcttattcctcattactacaatccacaccggcccccccccatatttcccactcttctaaatattccccccctccacaaccgctttccccacccccccgtttcaccccccgttattcacctcttcacatgccaccccctcccccctttcaccccattatttaaactccccctacccttttatacaacgcctatccccccccttacccccattcgcatctattgcccgccccaccccccccccgcctgtcttgccctattaatt

SEQ ID NO: 18609 - DNA, 391 bp, Homo sapiens
  misc_feature (1)...(391): n = A,T,C or G
gcctactactccgctatataactaacagtnactctggccgggcgcagtggctcactcctgtaatcccagcctttgggaggccgaggcaggaggatcacttgaggttgggagttcgagaccagcatgaccaacatggnaaaaaccccgtctctactacaaaatacaaaattagccaggcgtggtggtgcatgtctgtaatcccagctactcgggaggctgaggcaggagaatcacttgaacccgggaggcaggggttgcggtgagccgagatcacaccattgnactccagcctgggctacaagagcgaaactctgtctnaaataaataaataaaacaaaatacaaaataaagaatggcaaacaaaaaaaaacacatggcctcgccggnctca

SEQ ID NO: 18610 - DNA, 856 bp, Homo sapiens
  misc_feature (1)...(856): n = A,T,C or G
tcgtggccgctgggtccggtgnatgcattaacagggnatgccagtagccactgtcatgggagcgaatgacatggtagcctaatggagtggatgacatagagcctaatggagcagagtgggagatggggtctggcttccctggtccctaacccctcagcactagacaacggacccacacagagggaatttcagcctgaatgctgagaggcctgaagagtgagcaacccccatgagaatggtaagtgggcttnctggctacctatttgtgatggntaatactgagcgtnaacttgattggattgaaggataccaagtattgatnctgggngngnctgcggcggcgcggcaccaggagatnncagccagccctctgtctaagacagcttcttcgtcatctttcccttccctcctccccctcctcttctcttcctccccttccctcagttccttttctcttcttagttagtcttaccctccatcttcgcacctcgccccgacatattcccccttccccgcgttctcccccatcaccttcacttcacaacccgcgcttttcatccaatggttgacatccctccgccccctcataaccccctttttccccttccccctttgccttccccctttttcctttccctcttcccccctcccgccggcccacccctttgtttccattttaccttcctcacccctccacaccggtttccccccccccgcttcctccccttcttcaattccattaccccgcccccgcttcccctttttcaccccctctttttttttcccctctccccccctttccccttaccatcttttaccccccccgccccccccctcagttaactccgctcgattc

SEQ ID NO: 18611 - DNA, 1309 bp, Homo sapiens
  misc_feature (1)...(1309): n = A,T,C or G
caccatacgtntggtgtntccccacctttggggnataacgtgatngctcangaccnananntnangaccagngngcgnnaangncnccatatcagngctcacttggtnncatgngnnagtcagcatatggaaccatgcgntagncgctnnaatggtggagctggcgcatngaaccatnacgtagncnctncnaatgngnagnncagaaagatgggngaagnaaatgnggngntnnctngngtcntnntcgcnctcgggtncaccctcacacnnccnctnncagacnacttnaggaacanacngcgnacccccacgacgagnaagtgtgtaactcttccnagccctggnatatgacntngcagcagcgccctnggatagnaaagtgagcccaaccctacccatgaagnaaatnnggcaagatgggggcgttgccctgcgctatannctagtttgtnngatggacttaatgacctggagctgctccaacctnntggatttggagttggaagggataaccaaagttacttcgatgccttggcgtgctgtactagtgaaggggttgctggcaccaaagctagtattttgtagtttaactggtacctgcaggcaaagtacagatactcagccgaatagatcttcggactcggccacccagtactcactgacccgctgccgcagccgcgtgcccttctcatcggtatatgcgattccaccactcagatcttctatctagctagatataaacgtactctttatgctacacacttagctctcaatggtgctgttcacattatccccagactcagcgccgcgcacgctcttagaccacanttcatacacgccctgctgttcgcatagtgctcgcagatgcgacgcatccatcgctagtcgcatatagtacacgtgtaaggcgacttctcccactcatctagtcccagccccctcactccagtaagncgacgccacccaactacacactccccgtcgcactccctcacgccgcagcagcgccagtcgtacataagtcgcatcagcgccgaccaagtcgtcgttnctccgttatagtacttcccagcacntacatcatgtacgcccatccgacgtcgattcgatagacgcactgccacgagaccactgattgcgactacgcgtcacgacacccataggcactcacacacacgcgactgcgacgagtantgtagccactnacgctcgcgaattcnctcaccgacctacggacacggctacctagcatcgttagcgatctacatgtcattacgactctgccagnagtagacaggcgtaccag

SEQ ID NO: 18612 - DNA, 526 bp, Homo sapiens
  misc_feature (1)...(526): n = A,T,C or G
ccaggttttccgttcttttcactcacnaacaaaaaaaagnattncaacaagatgaaggnnantgaaaactatncattggcaccattcctncagncatgnaacaattatctaagagtctggnanaaaagcagggagggaaggcaaaccacaaagaagaaacctcaaaatagggactgcctttctttcatcacgaaggccattcaaattttctgcccatgcctccaggacttcccttggctgctgcagattgataaaggaagcccttcacaaaaaacctcccaaaggaatggttcaatggtgtggccacaaacttaactccagtggaagagcccaaacttgctggaaaaaatatattttggtctttaacccagcttgaaattcaccccatctttttttcccccaaaaaaactttgttttttgaggaaaataatttttccctggcaataaccccttcaaatggaataaacaaaaaaacctatcttctcttattttacgaatcttcccccaacaaacaaaaaaaaaaaaa

SEQ ID NO: 18613 - DNA, 165 bp, Homo sapiens
caagctccaaagactttccctttgcccctggaagtccacccagaaaaaagatccagctcttctgagactgtcttttgaccttctagaatgcagagacaggacggggattgtgccctgaaagatcctcccaataaagatctccctttgagtcgaaaaaaaaaaaaa

SEQ ID NO: 18614 - DNA, 392 bp, Homo sapiens
  misc_feature (1)...(392): n = A,T,C or G
gtccagcatgtgaatagaaaaacacanaanacgataagcgcttgatctacacagccacaaaccggaaatggcatggcactcctgctcaccttccatggcaagagcgacctgcgtggtaccatcgagaggcgtgagggagaacctgggaaaggcatccttcctgcacctccacaggagaagaaaatggtctaattaccacatagcaccgactctgctacaataacatcaccgctctcttgagctcagtcgtcctttttgaggccagcaaagtcctcagttaatttttggaaaagttgacaggaaggagctgtccagaaaattttgtcttcaggtttcctagtagtaacagccatcatttactaaatgtttactgcatatcaaaaaaaaaaaaa

SEQ ID NO: 18615 - DNA, 382 bp, Homo sapiens
atcccaggacaaaatgttgctgtgccacctaggctgggatgcagtggcacaatcacggcggactgcagcctcaaaatcctggctcaagcactcctcttacctcagcctcataagtagctgggactgcaggcttcaagaaatggaattttattaaaagatggaagaggaggataattgagagaaggggaactacctaatactgaaaactaatacagtccaggacacatagaagatgatcaataacacttattcaatctaaattaccctatcagcaagtggagaattctctctcgggagtgctgttttctttcctgccagtcagctctgtcaggttgaatagaaagcgataaataaagaggaaaagaattcaaaaaaaaaaaaa

SEQ ID NO: 18616 - DNA, 1043 bp, Homo sapiens
  misc_feature (1)...(1043): n = A,T,C or G
taaaatagaccgaggccaagtgacactctnnccaatggtgtaacatgattagnatgcaaaataccaattacatatacattncatngccacagccagnccctgtccgactaggataggaaaagtaatagtcacaggtccaacatcatgataagaatggtgatgtagaatatctgngnntgtggcnacatnncttcagcaaaaataccatagctttgctactagcagcaatatctagaactcttgcattagcaagataacaaataaaacaaacaaaaacaactggctctctgtctggcactacaatagagtggaaaactactagaaagacgacttaacctattacaagagagaaataatataatagatcaaataaaataaaatagaataacaataaacctcaacaaccaccccccttgactccccagccgcactccccctccctctctccacccccccccacccaccttccttcctctgcgcttccctccttctggctccctcccccttttctaccacctacagccaccacccctcctccactcccaccacaaatccacctccctacccactcctccctcccacactccccccccccccctacaccccatctcttcccccccccacctcccacccaactctctctcacttccacttacatcccctcgcgctcacaaacaccactcctaccacacctattacacccacaacacacttcccatcccaccaccaccctcaccctacccacctacccataccctgccactcatccacctctccatcaaatttaccatcacacaatctcaccccatccggcacacataacacacgaccaccaccactatacaaacccatccaccatccccccctaacacatccccaccaccctcacctcctcataccataacatcaattccctctcccctctttacccccgaccaccaccttcccaccacccccccctactcatttttccgcttccctacttccccccttcctatcactccccactacccccacacaactccaaacccacaacccccacg

SEQ ID NO: 18617 - DNA, 849 bp, Homo sapiens
cagggcacactgtgttccatgctaatcccacatcattctgctctccctactctgagcgcacagattctctcttcatgccacacagctgctgccagtgtatgaaggaggagtggcgtcagcaattcaagattgcctttcccaccttcttcagtgcctctttccttgatatgatgctaaaactagcgccctgactagaagctcctgtacaacattgcgtacaactgacaagacccaagattcttgttcttcttccttatttcggcgaaaagcatccagtctttcattatcacccattaacttagttgcaacttcccgctagataaaccgacatgttccagtcaccccgctacccctgaaattcttcacccccccaattccccctaatttcccgaccatatacaaaaccactacggtcctcctcgccctcatcgcttgcattctccccgcccctacctcgaaggcggcgaattgacttcacacctgcttgacccttagctccctttacactctcacccttacccccccactacccctcctcagactatcacctccaaccccacatgtccccccccttcttcccttttcacctcctcaacaccaccgctaaccatccccaccccatcattgtgccccctgtgtcgccccccgcccccatccattttgtacgcccacaccccatcactgcccgtcccccttccttttcccccccaccctttttcatacccccccttatcctttacccttttccccctctctcccctcctctgcacctctccgcccccccccctgtctctttgccctgacctacatcccgatcccgcaaaccccccctatgtcctttttgcctat

SEQ ID NO: 18618 - DNA, 219 bp, Homo sapiens
agtcgaagacaggcaacttgctttgttgcccagctggtctagacctcctacttcagtgatcctcctgcctcagcctcccaagttctgggattacaagcatgacccactgtgcctggctctgtctttataatttctgagtggtatgaatcacccctaaatgaatgaccaagtaccctaaataaatgatgaataagtgttaaacattcaaaaaaaaaaaaa

SEQ ID NO: 18619 - DNA, 267 bp, Homo sapiens
  misc_feature (1)...(267): n = A,T,C or G
cggggctctccaggtaccccagcttcactggnagcaggacagcaaaaaaggagagagagaagagcagcttaacatcagtgagaagcagcttgacttcagagggacggcttgatggcggaatctcagagagagttcagctggggacggccagactccaggagaagatcacattcccactccattccctttccagctctccatcccactgacagccactttcatcagcaataaaatctcctgaatttaccatcttcaaaaaaaaaaaaa

SEQ ID NO: 18620 - DNA, 270 bp, Homo sapiens
  misc_feature (1)...(270): n = A,T,C or G
gatccagtggaanatcgggtgtacagctcccggcagccctcggctgcccatcgtgtcactgtagctgcttcatagacaggtgtgcatcgacccagtgcaagatccccaatttcctttaaaacgcatctatccagacccatgcgctacaggtgggcaactgctacaactatggacgggtatcaaattaagctcaaatgtttgtacaaagtctaaatgtttagaaaatattattaaaatgcataatgaaattattagccaaaaaaaaaaaaa

SEQ ID NO: 18621 - DNA, 956 bp, Homo sapiens
  misc_feature (1)...(956): n = A,T,C or G
gcgggggtctccgagtagcatttcacatttagnagnctatgagaatctncggangaaaacaatcgaatgtgaattctgcgcatattcataaattgataagtcaattcatgaacgagcactctttcgtgtgtacttaactatcttactggtatcatggagatgcgcatagggatatcctgggaaagggatacttcctgcacgaacagaggagaaggacctggtctaattaccacatagcaccgactctgttacaataacatcaccgctctcttgagctaagtcgtcctttctgaggccagcttaagacctcagccactccttgcgacaagtcgcacaggcacggcagcctcgttccagcaccaactctttgcctcttaggcccccacctacgccccgcacagtccatctatctccctcatatgcccccctgtttcccctcccttaacccctccacctctgccctcatcctcccctgcgagcccttcccctcttcccccccccttcctcccacagcgcgtgcgaacttttcgcttcctccacccccgtccccccctccatcctcccgtttgacccttccctgcccgctagccactcggcagtggcaccttacatgcgcccccccctctccttccccccccctttcccccgttgttttcccctatcgccattccgcgctcagcgtccccctacccatccccccctcattccttggtctccctttctccccccaccccccattcatttgttctcccaccacccgcccctccctccccgtgcccccggtcccttttcccccaccccccgttattttcctagcccaccttgcgtcatcttacacgttttcccccctcccaccccctctattccctgtttgtttggtgcccccccgcttcaacccgccgaaaccctcgatcccacccccccaatccccaacacctgcgtgcgggcgctcattc

SEQ ID NO: 18622 - DNA, 904 bp, Homo sapiens
  misc_feature (1)...(904): n = A,T,C or G
caagttgccagtgctaaggnaagtaacacttcaccggnattggcctcttgatcttggactttccagcctccanaactgcaagccaaataaacatattgcgtataaatcatccaatctgtggtattctgttataacagcaaaaagtgaactgagacagtttattctttaggagtggcctgtaagtggtttcataagaggagaaagatacctgaattcactgtataagtcctctcaccatgtgatgcactgtaccacctcaggactctgcagaaagttcccacaacccagaagaatcttaccagatgtggtctctcaacttaagagttctcaccctatataactgtttacagaaggagactctgaactttaaacttttgacttgaaactggaacgcgataagactttagggcaatgagattagatgactatgaaaagcacatgactcttgagggactatcggaagaatgctatgctttaaatatcagaaccttgcaaaatgcctgacgaaagaaaatgctaaatatgatacacttgtaaggtcacgaattcatccaacgatctgaaaaacaaaaattacaacgaaaccaaatgatccaaaaccatgaaactctacagaccaataacttataaaccgatgaccaaaccacatcccccacccttcctccccccttcccagccccgctatttccccttccatacccccccctaccccccgcgcttcctttcacttcttttttccctaacccctataagtccattctacttccgtttctttacacatccacaaccccacactcactttattcccacctggtacatatacacttctcccccccctccctatgttaccctgatccagtccccattccccttttctcttctcccccccattttttttcttccc

SEQ ID NO: 18623 - DNA, 151 bp, Homo sapiens
  misc_feature (1)...(151): n = A,T,C or G
gagggtgtccgagggtacctggggctagtgtccgctnacgtttactagggtaaaactcacaggcaacggtttaccgagagaccagctctgagccacttctgttaccttgacccatttagaaaagaaagaaagggaaataaaaaaaagaaaa

SEQ ID NO: 18624 - DNA, 940 bp, Homo sapiens
  misc_feature (1)...(940): n = A,T,C or G
ggcgggcgccgacgggcaagcaaacatgtatacaccagncttccaagtctgcctgttctgagacctcagcaccctatgaacaacctacatgaagaggactgagatctccagctaacatccagagaacagaggtctcctgccaacagcttggaagagaatccctcagccatagtcaaccctttaagtgactgcagccctggctgacatctcattgccacctcatgagaggccctgagccaaaatctccccctcaaactgctttccaagttcctttcccacaggaactgtggtataataattgtttcttgctttaaggcacccgattcaggatgatctattatacagcaatagatggtaactaatgtagggcgggtcaaatggaaaggatttggatgtgcctacaaccacaagtattagtcttgcaagactaatgctttctggaagagatgagctatcttaatagggaaagacttaccttggaggctcggtggcgaagggaaagaacaaagtgcgcttgtcaattaacgggctgaaagaaacatgacgattgcgtgatgtggaaaaataaaacactgggcttcatgatctatacggtggtactgtgtaaacagtttactttagtgaggaaagctaagtgaagctcagtcactaccccactataccacaaataaaacgactcatatatccgcacttttataacccctgcggtttccccactgatatcaatccagaattcgagttggtcgttcggaccatccgttctctttttcgttccccatccgtttcattcattaattaacgtacatattaattaacaatacaaatccccccgaccattgccccccccgtttttacgtacccctcttccccccctacngtgttacccctttccccataccctgcccctttcgtcttgttcccccctatccgtcctcttccg

SEQ ID NO: 18625 - DNA, 373 bp, Homo sapiens
cagtaatatcataattcaccctatgaacagagattggacaacataagatgttctgcagaccaactggagcccatcttggaagctgactgacacagtgctgtagtttgaatgtttgtttctcctaaaactcatgctgaaattgtactgccatgtggtggtgttaagaggtgagaccttttggaggaaattcagccatgagggcttcatccttacaagtaggaataatgccattataagagggcaagttcagtcatttcaccttctgttatgtgaggatgtagcaagaaggtcctcaccagatgccatcaccttgatcttcccagcctctagaactgtgagaaataaatttctgttttttataaaaaaaaaaaaa

SEQ ID NO: 18626 - DNA, 312 bp, Homo sapiens
  misc_feature (1)...(312): n = A,T,C or G
tccgtttcacacttttcccatcctncccttgnaccttgcagttgnagccatttgactgggatatgaccaatggagtatatatagaggtgctgctgactggacacatgaccagatgcaccatctcttttccccttctgtggcaaccacagaggccacacattacagagcataacatgaaggaagcacagaagcctgagtcgctgcttgaaggagaaactcccagggggccaaataaccagaaaattctaccttggattctgcttaaataagaaataaatctttattgtgttaatccactgaaaaaaaaaaaaa

SEQ ID NO: 18627 - DNA, 967 bp, Homo sapiens
  misc_feature (1)...(967): n = A,T,C or G
cccgtaggcaagcacctgaaggaatcagatntattacactttagcgaagctgacncataggcctaggatggatgnctagctgggttggncacaatacgctnaactcttncacnaaccaagccactncaatgagttatctggggtgcgtatactgaaatgcatcatgcattcttatncgctctttgcagagtaacgtttgaatgacttacatggcaatagacacgcattcgacgactctgcattaacttagtaataatttcctttcataggttattattaacacaagccaggttgctattgcagctagattgctacacgtttagtccttaaaaaaactggactgatctgcttctctagcctccaacttctatatatctggcaaatccaagagcagccattgttgactgacttgtccttatatctatagagaagagaaagcgtcatattcactaggctgtctgggatctgtccctcttgagaacaaaggataaggaactcttagaagccatatcatgctaaacaggtatttctaccactactgatgtaatagctatggacactttagaattacaatccctacaaaagcgagtgcgctcattatcataaacatttctattggtctagatatgctcatataagaagctgtgggcacactgacttatatggacgtgtaaaataatcatccgccttcactgactcccaaaactaaaaaaaaaaggctgttgctagcctcaacggttcactctttggctcgcttccctttttggcccgctcatgcactatccctcgtacctacctgcctacatcacggtcccctattgtcccccaaccggaaaaacgcccactcgggggggggcctccccccgcccccccccccctttaccccactactaaatacactcccccccccacgcttgtcccggctcccgaccctttccatgtccttcaccccccccccttttcttcg

SEQ ID NO: 18628 - DNA, 197 bp, Homo sapiens
  misc_feature (1)...(197): n = A,T,C or G
cggccatcttgtgtttnagaaggtaaaaatcttcacttacaanatgtcaaagctatacctgagaagaaagaaatcttgaagagcaatagtataattgtgctgtaagataataaaactttcaaactcaccaatatgatattcaagatcttcctgaatttataataaatactaaattttatatctgaaaaaaaaaaaaa

SEQ ID NO: 18629 - DNA, 448 bp, Homo sapiens
  misc_feature (1)...(448): n = A,T,C or G
taatcccgagtatacatttcaggnanccatttgattctgnaaagctgtataaaaattatcttacactgngaggatggatgcaacaatcttcactgtgatgaatgcaggagtgaagaggctaaagacagaagggcgatctcaagataccgatgggaactcacagcctagaagaaaggttttacaagaaaaactctgatgtccaaagaactgtgagaaccagcaatgagcatgatcaatttaaatctgcagttctcaattctcctatttaatatgtgtttcagcatgcctcttatggcattttacacttgagtaatttcattagatggatactctggtgcctttgccattaaaatatgttttgttgtaagattagggagctattgaaatactaaagttaagtctcaataaaacaataataataatactttaactgccaaaaaaaaaaaaa

SEQ ID NO: 18630 - DNA, 894 bp, Homo sapiens
  misc_feature (1)...(894): n = A,T,C or G
aatattcgaatgattggaaatacaacaaccaacctggnatgagtgatgcagnagggtctatactcatactttatgcaccgtcacactcttcacagagcaaagccacagagcctggatcccttcaattgacagtgcacatctctgtggcaaggataccaatgcgggtgctggccactgaattaatcaacatctgatctcttgaaaatgatctggatgatttgtgaagaaccccacccaccaataaagacaagtctgtctgttttccttaactactgaacagaactgtcagatgcagcagtcttcttgtctacacatccaaagcacaatgctcaaatgctcatgtaaccccctcatatcaaagctttttgtcttagagggagtactatgcccataacactgcttttgcttttcaaaaaagacttactttcaacaaacaggcttaaatttattgattctgcaaggaggggccagaaattgctcaagcagaacatgagcgaatttgacattgcacaaaactctcggggaaaataatcactatcataagaacagatttcacacacaaaccacatggccctagatgtcctataaagacggaactctgaggtccatatattcaaccgcaggactaacccaattttcaccccataacttaaccccantaacacaatcccgtcccacctacaactaacccttacccatccccttattatgcccaacgattcccttctttcaacaacaattcatgtttattctccctcgacatatccctcctcctcttatctcccccacactttttactacccacaccgccccccgcctacctagtgttacccgtatgtccagacatcatttcaccttatatttatcaacccccacctttatatgtatcttacc

SEQ ID NO: 18631 - DNA, 1207 bp, Homo sapiens
  misc_feature (1)...(1207): n = A,T,C or G
tttcccatggncgtatcctagccgnactgtcggacanaaccattnacggaccagnccacagtgagtcacggtggccctcggccatacagggaattccttactcgcagcagtacatgttgctgccactcaaagtcaccagggagctagaagtagcttcctgctggcagtaccccagcatncatncgtgaacagactactactatccactgcatacaactaggcccacaatgcttgcacttcctncgcgccagcaggcaagcaccacataaccctctcttgttctaccctccaactggtcctcgcacaccacctgctgtacactaccatgatcgcctccctgctcaagcaaacgcgatgcgatagcgatcgcccctgcccacatactacccatcctatcgaagccgatacccgccacgtcggccatgcaagggcgatggtgccgcacagtgtgcattaattccttcccgtaactcatattccatccccccccatttctctcccccatattccctcttccccccattcccctcccccccccctttttccccctttttaccattattccgccatcctccgccgtgtatccgcagcacgatacttcccccagtggtcccattaccctcactgtcgtccgttccccccatacccctcctaccccatctccgttacaaattccacccgctcctctttccccgtttccccccctttttcaccggcccaaccccttttagtccccgccttgctgttacttcttctcgtgtttacccctatctcattccccctttatccccactctccacttatcatattccactgccaacccctcataaaccactttgtcgccacactattttccaccaccccccccctcccccccccaccgttctctccacccccattctctatccccccctactgtctcccactctctctcactcacccaccactcccacctcccatcgtatccctcnacccactttcttttatttaccccacacaccgcgcgcatgcccgcgccctacccactgtcccagtttgttgatccgccctcccgagagtcctcacccgtacgctattgtttcacccccactgttttcactcaccccctcccccccacccgcctcacaatttctcctcccttatccacagatacacatttcctcattcttacgttctgctccccaccactgtcttatctttctacacc

SEQ ID NO: 18632 - DNA, 403 bp, Homo sapiens
  misc_feature (1)...(403): n = A,T,C or G
aactctgagagccttgtactgcctttagnagtcgggcgacccattggagaaaccatgtgggaagaacacacggagagggaaaggtcctaagacttcatgaagaaagaagagcccagctgttccagccaagtccaactcaccagtgaacaacaggcaagaccagcagaagagctgccccgctaagcccattccagattgcataaccatgaataaaaaaaattggggggggttagttaccagcaatagacaattgaaacaaatggcaactaataataaatggcaattaataataaaacaataaaacaaatggcgattagtaattattattctagctgttcaggccagaaataaaagaataaaacaaaatttaaaaacacactaaaacaaataataaaaaataaaa

SEQ ID NO: 18633 - DNA, 301 bp, Homo sapiens
  misc_feature (1)...(301): n = A,T,C or G
ttttccgagtggcaggaggttgcagtcagctggcaacatctgttcccanagaaaggagcccctctctcctgtcactctccatgacaggaacccatcatgcagtatcaacctcaacgagcctgtcctcccacactcagcttttcacatcctccatcctcagtgtccccatctgtctccctctctacctgcttaccatgattcctcggctctcagcccctgttctagggaggctggccacctacatcccttcactgtagcctgcgtatgggagctattccagttagcggcgcctgaataatgg

SEQ ID NO: 18634 - DNA, 894 bp, Homo sapiens
  misc_feature (1)...(894): n = A,T,C or G
ctacttcacttggttnaacagtgagtcattnctttncagggnactgaaatcaacagctatatcttattaatttgttactgagtcaatgcgtggggtttatatgtaagagccgaaaacagaagaatgcatgtcctccttacctgaaatctctttaagaaatctcaaaaatgaaggacatgtgggcacaataatatacagcgaagaaaaagaatgatattcagcgaagaaaagggaagatcttaagtgcacataaagaaccaaccctgtgggtttgaaaaaaaatacccccccctccatgaaactgaatgggaggggcctgctttccccctgcttttgcgaaaaaacctcttccaactttcattaataagcgctgcccccattctaaaaccttccccctccctccccaaatttttttccctgtataccaggctgggaatcacccccttctgaacccgcggcggcagggtggcaatataccacaaaagccgccttactctccatccaaacaattctctttccttttcaccgcggccccataaaccccgcgcataaaaacaaaaaaaacccccccccctttccttccgagtttatccccaaatcatcccttccgtcctttcctttccgccctttcccccccataaatacatacagtttttctttctctcccctcccccataccatttccatctttccccttttcctttcttaccaccgctttatcctcccttatcctccattccgatcccgcccctatttccattccctatccccctgttcatttcccactaagtcctcccatcccaatcccctttccgccccgtcacatgtcgaacaatttttacctctttgcgtttcccaccccacctatctaccttccctatttcccccctatcc

SEQ ID NO: 18635 - DNA, 774 bp, Homo sapiens
  misc_feature (1)...(774): n = A,T,C or G
caggggatcattgctattacctttntncanctttgtgatgttcgaacaagctacatggtaaaggcaatatcagcagtcaacccttccagtccatccagggcagtggaaaaaccaagcccttcaattcaacatcccttcaagaagagaattctgtcaccacccaagttagtttggaaacagattattccccagccaagcgctaagaagagacacccacccttgggctggacacccttggactaccctcctggggagagaaccttgaacaaaaaaaaccctttaggctttggccgttcccggacccccagggaaaacccctgccctaaaaaaaaagggttggttggttccaaccaaaaaaaaaaacaaaaatggggctttttgggcctctaagggggggggttttggggcggctttctttttgggggggggtatattaaaagccctcttcttcctattccttcccccttgggcccttccgggggggggagggggggtccctctcccccttagggggggggtttctgcctttctcccccccatccgcgggggttccccccaggaaaaacaatttttgccccaaccgcccgcccccccctagccggcccacccttcttaacaggccccccttttcccgtttcctttttttatatgagcctcccccccccccctcccgggcacttaaaaaaaaacccctccactcacatgggggggggggggcgcccccccgccgcgtttttttacaacacccatcgtccttccctcctcccccagtta

SEQ ID NO: 18636 - DNA, 925 bp, Homo sapiens
  misc_feature (1)...(925): n = A,T,C or G
agtgttgcagatggtggctactgccacaaacccttctctggnactccaagccaatgaattgaagttctttgcctctttccaaacaactcgtgctgcagactggggagtgaccccagaacaaaagccacagtaaacacagatcgcaatcagcacatgttattttttaagttgaaacctatcacccagtgtttgcctacagttgtttgctccaatggttctttatgtagttgtctttcgtcacttcatcctagttcataacctatatctgacattgatttgcctactaacaggccttctgtccttgctgacactataccccctactgcttttcattttcccttctatgacgccgcccgattcctctatgatgcaacccctctctctcttcattcccccccctccctttttttttttccctttttctcccttctgttatcccatttctacatctcctcgcctcctttttctccctatatagtttgttcccccatccatctcctcccttatccttctctccctttacccttccccatctcaacacctccccattattcccttcttataccgcccccaattccccccccttttattgctttttctctcccttttcacctttaccatccccccctgacccgccccatttctccctctcattttttcatttcctttctatcccccccatccttaatcctttatttcccttttttttcttcctcccccccccctttttcccccctctttctttccctcccctttccccccctttttccctttcctcttcccaccttgcccatttccctattttacctcccatatcacaatcacgtctttcccctttatcccttttccccccctctttttacctctcttttcttctcgcacacccaccctttacctccctttctccctcacccccccatttacg

SEQ ID NO: 18637 - DNA, 202 bp, Homo sapiens
  misc_feature (1)...(202): n = A,T,C or G
atccagggataattggctgcggtcttcacanaataaatcaanaatcaatgaagaagaaaatgctttcattcagtccccaagttaaaatatgatagatattgccaagaccctgaggagttcctagtaagcctaacaaggagagttgatgacttttttcatcaaaaaataagaatgatattgaggaacaataaaaaaaaaaaaa

SEQ ID NO: 18638 - DNA, 541 bp, Homo sapiens
  misc_feature (1)...(541): n = A,T,C or G
cagcaacaagggtctcgcttatgttgcccaanctggnatacacaggtgcaatcccactactgattggcatgggagttttgacctgctctgtttctgacctggatcgttcacccctcctcctgagacaacctggtggtccctcgctcccgagaggtcaccatattgatgccgaactcaatgtggacacccaatcgacatagtgcatgacagcccagaactcctgccgcagctttccaaatagctgggacaacaggcacctacactacacccagcgtaagtcttttcttaaagtgaagaagacaagtatggatatctgttcatttcttaagagtactctgcttaaaaattggtttctgttttttctggacaatgaaatattactatcagtaagtaatgcttctacgtctcttcaatttatgccacttaaaataagcttagccatccaacaccactacagatagaaaactgtgttgtgaatcactgtaatggactttaaatttgcttaaataatttgttttgaataaagacaaatttatgcaaa

SEQ ID NO: 18639 - DNA, 895 bp, Homo sapiens
tactgggactgtgtagcgctgaacactcctgcatgggccacttgtcatcttcgatctggacagcagcacaaatcatgggagtgggaaattttgaagcagcaaaaatgttcagaggcacagcaataggtattcccagaacagctcccgctgagtaacagcagccagaattcccaagtgcaagggtcactgggaagtctccctgttcattccctctcccagtggcccactgaacagcgcgtcagcagaactggaataggacgaagagaaccctgtggatgcacatcgaacccgcttaccccttgctccagctggggacccagcctggtccctgcagcccattaattaaaatgaggctgagaagattcaaaagacagcatctccatccaccaggccaaccacaccattacccttgtcagcttggccaagcctacgcagctgagtacttggaagaaatgggaggatgaggtcagagcacgcactttccaccaaaatacactgtgattctaccggacatgtatgactccactgtccagggagacgctactatctactgacagtgcccctgttcaacttttgatacgacaatgccttcaaggcaaccttacgcccctcctttttcccacccaaatagacaacaatgatctaaatcgatccatcaggccgaacatatccccaacctccatattatagcggagccccacctttcccacactttaccttccctgacctatcccacccttacgtccatacacctctccccacataacccattcaccagtatacctctcacggccggatcacctcgtcctcccttccccagtaccgacaccatgtttccgctttaacttttccacacaacccctatccgtacttgtcccatcgtccccacaatttc

SEQ ID NO: 18640 - DNA, 420 bp, Homo sapiens
cgagaattctggtactttgacaactgccgatgacctggaggctaaactgcactccggaggcgccgggtcagccgtgaggaaacatccatgaggcgcacgcaacctatcatgcacgcgtgtcgtctactaccccgaacacgcagcacacgagcgttcaatccgtgtgcggcgatacagcgggacaccgagctgcgggcatctctggcttacgcgcgggaggcttgacatcggttaggtgtggggaggggtcaacggtgacgctgggtcactgagtacctcgcctgagagcgtcggatggggggaggggttcacgtaatcgacgcgcatggacgatataccagaaccgggtgatccgcaggaacgaactgaagagctaactgccaccgaacggccacaagcacgcagagggcctcctggcct

SEQ ID NO: 18641 - DNA, 870 bp, Homo sapiens
caagtgtcgagtctgtgatcattttcgataatgcctgtggtgccaatctgggcaacacagctaacaagggaagtgaagagcctcttcaaggagaacttctcaaggcattgctcaaggaaatcagagaggaaacaaatggaaaaacatttcatgttcgtaaataggaagaatcaatattgtcaaaatggccaaactccccgaagtaatttatagattcattggtattcccattaaactaccattgacataggtattatggaaaaaagctattttaaaattcatatggaaccaaaaaagagcccgtgtagcctcgacaatcctaagcaaaaagaacaaagttggaggtatcacattactcaacttcaaaatatactacacggctacagtaaccaatatatcacggtcctgccccaaataaaaaacactggtctccctcggcctcaaccgtggaattctgtcgccgcttccctttcgcgcgggttaattaataatcctcattcacctcctccatgcattctgtcctatcaccaccactgtacaaccccctccctattccttcaaatttctcccccaattccccctcatttctcccctttacccccacccgcctttccttctcctctttaccagcctataacctacaaaatcaatctcatccctccgccctatcatacctctactccctttattctctttccccccttctcccccttttttccccttccttccctcccttttccttcccttccccccattccatccccaatatccatccttcccttaccttgtcccccaatcaccttacatccccttcttccccttttctttccaccccacacattacattccttccctttaccccccccattc

SEQ ID NO: 18642 - DNA, 351 bp, Homo sapiens
  misc_feature (1)...(351): n = A,T,C or G
gcagggggatccgagggatcattgctttaccttttcactttgtggatgttgnaacaagctacatggnnaagggaattcagtagcaacctccagccatcagccagtagacaaaccaagcccttcaattcaacatcccttcaagaagagaattctgtcaccaaccaagttagtttggaaacagatattccccagccaagcgctaagatgagacaccagccccggctgacaccttgactacctcctgtgagagaccctgaaacagaagacccatctaggctatgccgattcctgacccatggaaacccatgccataataaaaatgtatgttgttttaaactaaaaaaaaaaaaa

SEQ ID NO: 18643 - DNA, 446 bp, Homo sapiens
tcaagactcccccgcaccacgctgaatgcttggtgtgattagctcactccacctccatttcccaggttcaagcaattcttgtgcttcagtctcccatgcaccttacaggtgcacgccaccacaccgagctagtttttgtatttttagtagaggctgggtttcaccatgttggccaggctggtctcagaactcccaacctcaagtgatccacccactttggcctcccaaagagtctgagatcttaaaaacagaaatagttcctcctcagtgaacacctgtgattggcagcagacactgctctggaaacctggtagaaatatctgaaaaagcatgagggactgaagccgcttagcactgtgcaggccacttcatctatttttactgtgcccccactagattggcagggaggatattatactaaagttgtaactgcaaaaaaaaaaaaa

SEQ ID NO: 18644 - DNA, 809 bp, Homo sapiens
cggggcatgcccagttgtaagcaacttccaaacgaaacctccacagattggatccagttcagcctcacatacttgctcaagcgacatcaggtagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctgggggggtgatagttcttctttttaaaataaacattttcttttgaactagctatacagaaaaacacactaacacaagcaacaagaaaccagagtagccaaagaaagaaaaacacacaagaccaaacatcaccatcgccgcgccgcccacaccaaccacaacaaacaaacaggagcggctacccgtcaatcgggcgaggacgagtcgaacacgctacctcaggggaggagatgcatctatcatctatgcatacaaaactcgccagccatacacaccagagcgagacgcaggaacccagatctcccaaaagccgatgcgagtgcgtacccagcaacttggagaaaatacgcacacaaaaagaatcatacagacaacctcgctcacaaacccagacacacaccaccagaccaagccgtcagtcagcgcctccctatccgcgagtacgtgtcacaggaagtaatcaccacttccctgctcttctcgcacctaccgcccacccctccg

SEQ ID NO: 18645 - DNA, 866 bp, Homo sapiens
  misc_feature (1)...(866): n = A,T,C or G
gctctttccgatctcttcatcacatcactanacgnanaaaaagnaaatncaaccaaaagcaggnagcataaactatncatggccacccatnccctcaagcatggaacaatttctaagcagtctggacaaaagcaggagggaaggcaaaccacaaacaacaaacctcaaaataggtggactgccttcctttcatcacgaagggcgcattcaaattttctgcccatgcctccagggaatcccctatggctgctgcagctgcataaagatgcatccaagaaaacttacaaggaatggccaatgtgaggcacagctaactcagtgaaggccaaactgctgaacaatgtattcgccttaaccagctgaattccaccaacgtgccccccaaaaactcgctccgcgccatatccccctgtcctgtctcccggcgcctaccagcccttacccctcaccacccctcccccccctctacaccccccgccccccacacagtccgcagaagacgcccccttaccctcccaagcgccacacacacaccgatacccgtcgcccaccccaaccccaccccacgcacgcaagaaacacccgaaccccagacaccacggaaccagcccccacgcgccaagcccccacaaccccaagcgtcccgcagaccagtacgccccccaaccccgaccaagcctccaccgaccccccacaccccccccagtcaccccccggcccaaagcgccaagtacacggccgccctacagccgagaacatcaccatagtcaatgatcctgactgacaaacaaagataaatgaccccgagaagcagcccagacaggacaactgagaacacacatccccaccacgacccaaccacccag

SEQ ID NO: 18646 - DNA, 776 bp, Homo sapiens
  misc_feature (1)...(776): n = A,T,C or G
cgttctctcactcactaacaaaaaagaattcaacaaaaggagnatataactatcatggcaccatcctcagcatgaacaatttctaagagtctggnaaaaaagcaggagggaaggcaaaccacaaagaagaaacctcaaataggtgactgccttcctttcatcacgaagggccattcaaattttctgcccatgcctccagggactcccctatggctgctgcagctgataaagatgcatccaagaaaacttccaaggaatggtcaatgtggggcacagctaactcagtgaaggccaaactgctgaacaatctatttgccttaacttagctgaattcaccaatctgtttcccaaaaacttggtatgagacaacttctacttgacatgccgtccagcccaatcagagccctcgttccttccgagaacacccaccgccccccgaacgacctccacggatcgcaccgcgggacccctgtcaccccaccgtcacttctacgcgcgcccccccgacgatacagacatctagcagaccggaccaccgcagaacttgcctgccccccctaatcgtccacctcccgaccctgcccccgaagctccccacgccccacctcccccccccatcgaccgtactctcatcgtacgattccctcccccccccgctcccacccaccaccccaacccccctcccaaggcacacgcccccccccccccgcccctcgcgtgccgcagctcgaccaccccgcgcactcaccctgggccaccaccacccgcccgctacg

SEQ ID NO: 18647 - DNA, 293 bp, Homo sapiens
  misc_feature (1)...(293): n = A,T,C or G
ggagaccgggcgccagaccatcaggcctgtncaggcatagcactcaagcagcactactacaggtccacaggatgaggaattaggcaaagagcccacgccctgtgagtgagccaccaggagtgcatccttcagatctaatcaagccctcagttgtccacagccccaggtaccatctctggtgcagccccaccagagtccctgagtcagaagaacccagctaagccactcccaagctcctgatcctcagaagctgtgtgacataataaatgtttattgctttaaaaaaaaaaaaa

SEQ ID NO: 18648 - DNA, 388 bp, Homo sapiens
  misc_feature (1)...(388): n = A,T,C or G
cgggggactcagggaactatggtggccttaaaaaanaaaagaaaagaagagagagagcgaagaaaagaaaagctgggtctggagcagtggctctggcctttaatcccaggctttgggaggccaaggtgggaggatcatttgaggctaggagttcaagacagcctgggcaacatagtgagacttcatcgctacacatacaaaaaaaattagtctggcatggtggcacacctatcatcccaggaattcgaggttacagtgagctaggaccatgccactgcactccagcaagaccctgtgtcaaaaaacaaaaaaacaaaactaatacattatgggcaagaaattgttaaggcataaagtaattatacttttgacattaaaaaaaaaaaaa

SEQ ID NO: 18649 - DNA, 387 bp, Homo sapiens
  misc_feature (1)...(387): n = A,T,C or G
ccgatgtaggcggagtggaggtacaactatatcagnagcagcggnagnaaatagaattgggctcctctacagaagaggaggcattcagctggatggcttttgaaagtgtttcctgtagagtcatctgcaatgacttttgtctgagaagtctttgattttatgcactgacatggtttcttgttctgttataaatatatgctgttctagtccttcaataagcctgtcacatttttatcatatctaaaggcactttttctgcaatgttaacaatgtcatcttcattgtcactaatgtcatgatcattttaattcagaacaatttttggctatatttcaataaatggacaactggagcctcattatcaatgttgaaacaaaaaaaaaaaaa

SEQ ID NO: 18650 - DNA, 822 bp, Homo sapiens
  misc_feature (1)...(822): n = A,T,C or G
gagtgccatgggtccaggcagctctaactgttcagggctggtaaaaggtgaaatggaaactcaganaggcatgctgagcaagaaaagcggataaacagacaactggagagtctgatataaaaatggcacatggacaaacgaaacaagtattcataatagcactatttctaacagtaaaacctagaaataatccaaatgtccattagcaatagaatgggtaaattatgtttatgtttatacaatgatacatagattcaactacattattatggatgattctctcaccaggctctgccacatgaagggaataaaataaaagtggcagcaggaacatgtgttataagccaccatttatataaattcaaaaatgtaaaattaaatacattgcttacagagaaaaacaacacaacacatggtctcgctgacctcaacgatggaactctgacgacgattcccttcagtgaggcctcgtgaatgatccccgccaactgactacatcccatcaccgacacgcgtacctcctcccctccctcacccctaaacattctactctcttcccctcctttacacaacacccggagctactcgatgtcactccccacccctactaccagacacgccaccctctcactcaactcccctccccctcttcaccccctaccccaccccaactcccgctcacccctccccctcgccaccgcgcacatgtaatatcatacatacgcacatctacaccgctataactccacgaccnagagggaacaccagctccgaaacaccgcttgaatatctcacctcaccaatcaacacaacactatacct

SEQ ID NO: 18651 - DNA, 920 bp, Homo sapiens
  misc_feature (1)...(920): n = A,T,C or G
acggtgggtcgatggtgtgaccatnaagttctaacaccactctttggaaagcagnactctgnattacancctttgccattgccgtggtttaaaactcctaaatggttgagttcaagctaccaacataacatggacgcgaatacagagcagaagagtgtgttaatcaacaccccagcgtggtgtagccttcacacacagggacaatacgggctaccatgtcagccggagagctcgcggcgctgcgcagccgggcggcgcactaatctcgacgatcgtctgacgccgccgcggccgtcgcgagaccgaccgcgcgagccgagcggaggcccgcctgagtcatggcgtcgagcaatctcggaaaccacacgctcaggagcgccctgcccgagcccgcgcgatccataagtagacacgcatcccgagcgcattagcgaaggagcggccgagaggaccgttgtcgcgacagacgcgcagccgccagcccagcacgatgcggcctcacgcatcacggtcgaccgtagcgctctcccgtgcgctagttccccgcgatagccccgcagtcggtgcacgcgacagatgcgaagattgaccacagagcggcgcacctcccccggcggcggcaggcccgcgccatgtagaagcgcaacctgcgacgcgtctgtgctatgatgcgcacagcagcgacgagaataagtcggccgctttccccgctcactacggttgtttagacgactgtcacccccagagaacggcggacgagtcaaagtgaatagtcgggcagggtggctggctccgcgagcaggcggactgagcagcgtccnacgcggcctgtcccgtacgnctatcagcagacgcgcagtnacgcctgtgaattgagagtctggtccgacggcgtggtaggaggccggctagtcgtacct

SEQ ID NO: 18652 - DNA, 851 bp, Homo sapiens
ttcagaaaaaaactccaatttgagactggaacaaattcagacccagccttgggaagatcctgacctcctccaagaaagaaatccagaaagccttaagactaagacaacttgactctgctgattcttttttccttttttttttttttaaataaaaatattattaactggcacttcctaatatatacttcctatcacgcggcaaaggaaattccaggcccatggcaaacttggatatgggtaattcgatgacactacgacatcccgtaaagcacctacaccccattattatcccccccccctacaaaatctacccacgcaccaccccctgccgagcacacacacacccaacaacacccaacatacgccccacccacccccaacaccccccaacccccacccccctgactactccaaacactccccctcaacgccgccgcgccgacaccgcaccaccacccacccacaccccccgacacaaccaatacccacaacgcaccctagctctcacccccacacaagtaacaacacctcatacaacaaacaaatcctacatgcctcactatccaaaaacaaaacacacacccccgctccctatcattatgcatgctacacaaaataaacacacatacacacaaagcccccaacaccgatccacaaacccataccacccccctatacacacaatgaaccccacaccaaacacacagaccactaccccagaaacacacaccaagtgcaagacacaccacctacccacatccgctaaccccccacgaacacacccacacgacaccccacccacgtacgcagcaccgaaccaacaccaacataccataccaactaccactcac

SEQ ID NO: 18653 - DNA, 1128 bp, Homo sapiens
  misc_feature (1)...(1128): n = A,T,C or G
aatttcaggggtntccacacaccattaaaaaaganattcaacaaatgaagcacaaaactatcatggcaccatcctcaagctgaacatttctaaaagtctgagacaaaagcaggtagggaaggcaaaccacaagaaagaaaactcaaaaataggtggacttgcccttccctttcttcaacgaaagggccctttccaaattttcttgacccatgccctcccagggacctcccccttttgaattggttgcaagcttgaataaagaaatgcctttcacaaaaaaaccttaccgaaggaaagtggaccaatgtggggggcaccaaggttacctctaagtggaagggtcccaactcgtgttggaaaaaaatatatattgggagtcttactctggctgtggagtgtgcgcccatgctcttgggaggggcagaagactctgtgtggatgagcagaacatcccccccctctcccccctccaccccctcccccactccccaccacccccctcctcccctctacccctactcattcccctcctctcactcgccaccctccactcacaacccctcccactctcacacccccccccccctctcctctctcctccacactaacctcctgtatcacacattccactaacaccacactatacaccactcctcccccaccacttcccctcatcctcccccccaccctcctcaaatcctcccaccctcgctcccccgctcaccctctcctatactcctccctctttctcgcccacccctccccctccccactccccccccctcaccaccccctcttaccgccttcccgctccccgcagccccccccactccccccctctctctccccccctatctccccctccctcctactccatcccatacaccttcgtcccaccctctcttccccatccgtcactcatctccccttcctcaccccactcacatctacacccgcccacttcccntatacaacctaccatcccgccgagaacactacacctgcaatcagcacaccactttctatcaccccattttgtcacccccgctgcatacccacccctcacgtcctgccctcatccgccctcgtctactctaccccatcagcgtcagcccacctcatcaccct

SEQ ID NO: 18654 - DNA, 367 bp, Homo sapiens
aggtaatatctggaccctgttggcagttcctccaaaacccacgtggggtggacccagcgaccacttcccataaaactacaggctcatctactgttctctggaataaggtttcctggagtacaagttccagtctgtcccttggttttgccaaagacagatccgcctactgactattctctgctgtaatgacaactgtgctctaagacaaacaacttattcttagtggaaaacaattaatttcagccatcacatgtgttcctcaacagccatttattcacactggcccatcttccggtatcagactgatacaaaaccccaaagacttgcctgatgacaattgaatgagtgtcacgtaaaaaaaaaaaaa

SEQ ID NO: 18655 - DNA, 354 bp, Homo sapiens
  misc_feature (1)...(354): n = A,T,C or G
agaggtggtccgagtgtgggaaactgnagcttgtaagaactttcagttttcttggcagaatacagtgtctccccagcctgagacaggccaagnagccgtccctgaatgaacagatgagcaaacccctggatggagagcccatgagcgaagcgtgggtgcttccggctgagatctctcaaacccgcagatggaggcttgccaggcggggacactgaggcctcatctggcctcagcccctggaggggattagtgcctgtgccgggcagggatcattacctcagcccctttcctcccttttttttctaatgaaaacaaaaacaaaaataaaaaaaaagacacccaaaaaaaaaaaaa

SEQ ID NO: 18656 - DNA, 832 bp, Homo sapiens
  misc_feature (1)...(832): n = A,T,C or G
catgggtcactgncagcaattacctgcagccaaatgtctctataacaagtccaagacatgcattccagctggaatcctcttcccggcatgtagccatctccaaaaatgccatccagtaaccatgcccttgtgtgctgccctttccatgaatctgagctagccccataatttgcttttggccattggatggtggtggaagtgatgctgtgtgacttttgaagctgagttacaagcagccttggacagtctttctagacctcgtggagggctcactctgggggaagccaaccagcatgtaaggagcataactgccctgagaccgccgtgttgtaggatgcccagctagctatgtggagaagctgcatagactgagggagaagcccagctagaccccagttattcctgccaccctaactgaggcaccagacccatgagcaaagaaaccatcatggatgtactgtaccatccaacttctgtgactgtaactgtatgaggaccccaatgaaaaccacacaggtgaacctagacaacacacagaggtatggaggataattatcaattgacactttcaaccttccgcaaaatatatacctggactaaagtgaacaataagaagagaacatagcaaacagataacgcttaacaagagcacaaataattcataacacgagatactaaccagatcagctcacacgccattctaaataatatccgcagttccactttctcgagaatctccctcatcgagcatcaatcatagcccggaaccccaccctctatccccgcactcacaccccctcctcccgacacacatgcgccacccttttttgcc

SEQ ID NO: 18657 - DNA, 296 bp, Homo sapiens
  misc_feature (1)...(296): n = A,T,C or G
gcgaaggttctcccgagttcttctgncnatgncgntatactagnaaaaagaaatnctcaacaantnactncttnaaatacaaatttcttaataacttcatattaatgggactaatacaaatttttccaaaacttccaatggcaaaaattaataaatctgcaaaactgcttatcaagataaaacccaaaaattagttcctggagaattaataaccttaaaggatggttttatgaattttatttaaaaggttatttggaaataaaggatttgggtggcttaaaccaaaaaaaaaaaaa

SEQ ID NO: 18658 - DNA, 185 bp, Homo sapiens
acaagcgtttcgaaagctaccaacaaactttccgctttgccacctggcatgtccacccagaataaaaaaatccaagctcttctgagactgtcttttgaccttctagaatgcagagacaggacggggattgtgccctgaaagatcctcccaataaagatctccctttgagtcgaaaaaaaaaaaaa

SEQ ID NO: 18659 - DNA, 1174 bp, Homo sapiens
  misc_feature (1)...(1174): n = A,T,C or G
ccacgaagctacttctgagtactactnactagacatgttcacttctgggccgggtcgtcagtgcgcttcacttccttgtaatcaccagacgacttgtatgggnaaggccctnagngnncaggcagcgcattcacattcgcagggtttgtggcagantccgcagaacccatgtcatcgcacncagacaatagtggaacaaacgcctcgctactgctaacttanataaaatacctaacacatgtaagcgccagtggccgtggcgtgggatgctattgttcttagttacatcccctatttaccttcatggagaggcttgggaggcaatggaataatatacatttccgataccccgggtagaggccatggggggtttgcgcggttgaagcccctaacaatccccaacctcatctgccancttccacgagcctgtggacgttacggaggagaccggaggacactcttggttcttacaatgataaattactatcttagatctcnatatctcaacactatatangagnaatgagagatataatatatatatgagactacctctcccgtatcagattagatactccaatatcgagaactacagacaacgtatgatgaacatgaagcacgacgaggagaaaaaaaaaataaatnctggccccgcggttggctcctcagaggtgggagagaatattttcgcggcgcttcttctcttttaagggagagggtatatattaagagagctctcgttctattggcgcttcgctactggcttagagggacgctagtgggtggcggggaagagtgtatttattctctcctctcgagggcgcgcggataatgtgttttatctcctcgaaagttgcggagagtaaaacaggacgagaagaaaaactaggagtgaagagnataggcgccgccagagaaggggcgccacccccctcaacaaaaaggacgcccgtggatggccggctatttctttatacataaactcctccgcctcccctcggagagagnaatatagaaacagatatgactctcctctccagnagaggtgaggcggcgcgacgctcctctacccgcgtctacttatagcacctccctctcccgactctcctgcgcgcggtagagcaactcatataacactcactagtattatgagcagcaccgaagccctatctcc

SEQ ID NO: 18660 - DNA, 631 bp, Homo sapiens
  misc_feature (1)...(631): n = A,T,C or G
ttctatatacctttcattacaatggcttgcacagtgcactgtgaagcaatatccatgctgctcctgnaacttgagagggaaaatgaaagcagccaaaaaagaatttcctgatgctcccaccatcaaatccatcagcatacctgcctctgaaatcacattctttgctttccttcctttgagagtggctggtctgtcagtatctctagcaaagaccacaccacatcctatcctcttaccagagagcattttcctgaaaatgacgatttctgcgttcccccttatgtttccccctatactgaatcattccgattatcatttgtttcaaatgaagaattataattcaactatttcttttagtgcaatgagtgagagataaaggttacatttaacattaagattggttcagaacataaaagttctttttgcaccgtgttggaaactgttgaagtactatcttcacagcgtaactctccgtacatgcacttcattgctcctcaatttttctgcctttctccaacacaatacctgatactgccctactttctattctcttgcatccttatttttttcctaattgagagagaacagtgatggtaattaaacaattgagtgaaaaccaaaaaaaaaaaaa

SEQ ID NO: 18661 - DNA, 235 bp, Homo sapiens
  misc_feature (1)...(235): n = A,T,C or G
tctgaagatatctaataacactgcacananaacagnactgataaccccaaaacttgtaatggaccagcaaacttctgaactcatactcacctaggatccttgatagcaattatttttgcttaatctaacggatttctgctgcccactggaaagacccttcttccccaatagtactttgcactgaagggaacaataaaaacattatgcgaaaaaaaacgtaccaaaaaaaaaaaaa

SEQ ID NO: 18662 - DNA, 301 bp, Homo sapiens
  misc_feature (1)...(301): n = A,T,C or G
tactggctcttgctccgtcgcccagnctgnaatgcagtggaagcgatcacgatcacggttcgctgcagcttcgaactcctgagctcaaacgatcctcctcgctcagcctcccaagtagctgggactactggcacatgccaccacccctggctgaaaatcactcatttttaatgagaaaatgaagcgggaaaggaagctactcacaacagcaacaagatccgtactataaccaagaatgaaaccagaatatagagcttttgtgattagaacgggcgtataaaagaacaatattgcatgctca

SEQ ID NO: 18663 - DNA, 836 bp, Homo sapiens
  misc_feature (1)...(836): n = A,T,C or G
ggggggggaacaagcncataacacattttatatngagctgcagtgcagctttttaatgctacacagttcataaaacagttgtcacaacttggacaaaagtaacacagcaagaaccttactatgatgatctacttggcaatgtggatgaatgtgaaaggacaaatcttttaatgcgttcgtgccgagttcagtgccccgcgctccagacactccctcacagtccaatggacgccctcaaactctaccacccccgcgcctaccctacgccttaccatccacgcccgataaaccgattacataacagcccacccctaccgatagactatccccaccacagcgaagagcggcgcgccacgcccgcccgtcccgtgacctacccgccgcccaccccccgcctccacccccctggacccccgccccgcccaccaccacacaccgcggccccgcacgagcgcctcatcccgacccgcgctcccgccactcccgatcaccaacatacccgccccccccacaccgccctctacccgcagcgccacccacactccccagcgcacaccgatcagcacccgccgccccctcacaccttcaccccagactccggctcaccctagccgcaccgaccaatagccacggcctacccccgnccccccccccgacgcgccgcgaccctatcacacttaccccgcagccaccccgcgcctctctgacaagccggcagaaaaccgcaggaaggcacgacgcacgtcttagaccacccgcggatccgcgccaaagtctgacggagacagcgcccccacctaaccaacctccctaagaccacccactccagagccagc

SEQ ID NO: 18664 - DNA, 1464 bp, Homo sapiens
  misc_feature (1)...(1464): n = A,T,C or G
acattggactgtagacatagatcactgnatatgnttgttgatatatctcagatatcgctcncgacgtgctctctatctgcctaattcactgccgcacgtcggtgctccgagatgaggtagtactaagatcacctaatgcngatcctccatggattnctagggtncatntgaactacttncnanactccagnccacatctacttnaccnaagntngccnacgaggacgatcgcagcggcatatctcagtgactacanagtcaggcntccnactcgtcacncttcgatagtcagctcgcaagacacgaccagatgagcaagnatggtcacttctcgttttncnagtgatacgtaacgatacatgagacgcgcgtgcgagctntctgtacacgacgatgtcagcactctaacgatcaactcgatcnncttcgttgagntncgtcgagactgcccaccactacgagnntagtcgctgccctcgctagntccaacgatacaggaacactgcctatgtcgtcatagtgcgcgacctgcgcgctagagacgtgcacgtcctatacncgtgctagtagagctctcgctgcatgcagaaatacatcaaccatcgaccctcatctctgcctctatcatccagcgagacgctatgaagcccacgcgtgtctcctgtcgtttcggctctctcctacctacggtncgacagctatccctgacgtgtctccgacctcccccactacatcaggagtcacggacagtctactcatctagctatacgcctcgtacttcccgctgttggccgcagtacgacgccactgcccgccccgtttcctcactacgccactgagacgacagatgcgtatctccgagtcctctcccctacccgacccatcctctctcttctacgactctccctcctgttacactgaccctctctcttatatagatacggcgagtacgcatcgtactacggctctccgtcacttcgatcctcagctcccgctcagacaccctcgagagaaagctgctagccatgcacgacgcctgtccgcctacgtttctccgtctccggcagcctacgctatcacgcactcgcggctctcacacgctataatacacacgactctcagccaccgcttcgctcatcgccgcgcctgcctactagcctaccgncatccatcacctacatntcctctcaccagccctcgccgcgctccacgccacccaccaagaacgcacccctnacgctaagttaattaagatctctccccagcgcctccgcatacgccgactactatctagtacttatgcccttcgtatggccgcccccgcctccttccatgtctccgcccggacatatcacgtagaccgcgctatatcaccgtcataattncgttcatccatcgtctcactcctcccgctgtggtttatccnactgcgatcttatccgtctatcttatatatccatagta

SEQ ID NO: 18665 - DNA, 823 bp, Homo sapiens
  misc_feature (1)...(823): n = A,T,C or G
ggattgtccgctggaaaacgacactgtnacctgncttacccaagnaccggnagagttaagaagcaacccagnattaaaagacgnacttttggaatcagactctttctccaggaaagaagaacctcaggtatttttaaggaaacacttttggagaaaaatactttttgagaaataataaaaagggagggaggcaaggatacctgggtcaggttgggcacctatggtcaaaaagaaaaactgggatgggaagaaattaagccaccgtacctgggaaggttggagggcaatccctttataaagcggacagcgggggaggatagctgggtgggagggggttcccaaacagaggccggcggggggccacgccccggccgcccgcctcgccgggggcggacggggcgcgcgcaccggccgcgccccgccgcggcgacgcctcccgaggcggcgccaacgggcccggacggccgacgccccgcgcggtcgcagcggcgcgccccgcgcgggccggagcggcccggcccgaggcccaccccagcaccgtaccgcgcggcgcctgcgcgggccgccgacgcacgccatccagcgactccacccgcgcccgcgacgcggcccccgcgcagaactaccggcccccacgcccggcgtgcccgcacgccgccactcgagggcagtgcccagcaagccgcagcgcgcccctagcgcagccgacaggcccgctgagtccgaggtggcggagcagccgcgacggcgcgaggccgcatcggagcgggcgcgacgatgccgccgcgccgcggcagcgcgggcgcggccagcccccgcccgg

SEQ ID NO: 18666 - DNA, 765 bp, Homo sapiens
  misc_feature (1)...(765): n = A,T,C or G
gcgttcgtggtattaaaacacacttatgggccctcaaaggnaggataacacctctgatcagagtgcaggaaatacttccctgacagcagagtaagtctcttctggtgtgtgactttggaaggatgggtgatttgacctagatgtcatactaaggttgggaggggcgcttactttggtcgaggatatctcccttctttcactcaaggccaaccacccctctcttatgccacgtccccctccccaagacttccccgctataccccccccctccttattttcccccggttcctgcactaacgcccccacacactcgtctccctccactgccctcacctcctcctctcatccacatctacctcttccccgaccaaacctccccctccgatccacaacccaatcctatacgtaatatgaatatcacatctatccctaccaccgccccctcgtaatttatcggctgtcgcacttatcaacaacagaccgccacttccgcacccgatcctaacccccctccccctaacagtaatgttcgcgcagcgttggagtctcgacaggaagctctattaatctccttcctattatcccatgtgcatccacacatcccacatcacccgccccacgtcttaccccccgccccaccgtctctacacatctctcccaacctccccaaacatttctttatctatcttgtactcccagataaccgcatattatctatcaatttcaccacagcgactcgcctaatgcaacttcttatcacgtacg

SEQ ID NO: 18667 - DNA, 1043 bp, Homo sapiens
  misc_feature (1)...(1043): n = A,T,C or G
cgatgtctctatcacatnactggaacaaaaaaaaaatatcaacaagaaggaggaagcaaaaactatncatggngncgccatccttcaagcatgaaacaatttctaagagtctggcacaaaagcaggagggaaggcaaaccacaaagcaagaaaccttcaaaataggaaaatgccatgcatcattatcagcattgccgttatggaatgaacttatcgaccttttccacactgggatagcgccagcaacagccttgcaacgctaggaaaacattccatgcaaccagtcttgtagattgactgacagacacaacctactattgtagcagtgtgatgcacatcgccatgaagcatttgaacatgttaggcattaagcaagcaaaactgcattcacatcgtcatggaaccagaaaatcagccaggtaaaagcgagggacgaactcgcacgttgactatgcatgcagcccaatggtccaattcaaagtgcttagtgacccatgaagctaacaagtgagctctaagctgaagcgaatgaatgccacgcagctcataccataccttcctcttcaaaatctccgcaagcaacgacctacatatcctagcgaacacctcaccacccatcgcatagccatccgctgcgcacatagaaccccgccccagccttcacgatacgatcaacacacgatacacaggagcgcatcacggccacactgccgctcctgacactctaagcccacccgccatagtatacacgcacgcgagtcaatcacactccaccaaccccgctatgcgcctcaccagcctaacacatcacccacccaagccgtctatcccatcgagtccaaaagtcgtcctgagcgagcagttcgagcggtctctagttaacaagaaatgctggggcagtagattagatgcctcagcacatctgtcgcagcatcacgacatgcacgcacgccactacgtgacaccactcgcatacactaagacaggatcggccctatcaactccacgncattccccgcacgtgtgattatcacgtgacctct

SEQ ID NO: 18668 - DNA, 346 bp, Homo sapiens
  misc_feature (1)...(346): n = A,T,C or G
aggccaaagaccaaataaatgttggacaacatgnaggaaactggcacaagnaactatctcananagcatggaatcaatccttcaaaacaagcatcttgatgtggcagaaaattgttaatctctttcctcagtgcacaaaagatgaaattcaaatttatcacgtcaaagctagctcttagcgatcatatggcccggctaatattaccccttcacgatccccggcccacccctcccccccacccccactccctcccctcgccccccccatctccgcccctccgtccccggcccacctcctcttaccccgtcattgacacacccactccaccatccttccctcctgact

SEQ ID NO: 18669 - DNA, 508 bp, Homo sapiens
ccgatagcatgatattaacacccattaaagacctctgcattgctgctcgagctgtgtggcttactttgttgaaacatgaatgattcccaaagtctccaaatggctacctgatggaagtcttccagtagacagctagcttctatgcccaacaaaatattcactactgagctttctactggttctcaaatctgcattggaaattgtctgctcatagagaagtgggtttatcttgaagttattgaagcttaagtttttaggctcaccacctgtctgggctgcttctaagaccccagcaatacgattagagtgttgtgaattcaaagaattctttactttagtccttgccaagaaaacttgaattttcctgaaatcttacagctgatttatgataaaagctcaatattttccaaatttgataacggtcctaaaatgtggaaaaagcattacggattatgttttaaaattaattagtaaaatattatgtcattgctctggaaaaaaaaaaaaa

SEQ ID NO: 18670 - DNA, 301 bp, Homo sapiens
cggaaatccaaattgccacttaaaaggatgccccgttgaagtggctttttgaatgaagaaatgcagagagtgaatttactgcaatgatgaatcagcacaattatttgcatatgaattttatgctgctgccaattcctctttaattatgattgtatgactcatcactccatggctgcatgactgattgaagccctccctacttcgaatggtcaagctcctatgccccctacatacgcccacaccgaccctcatggcaacccccccctccacaccacccagcccccacctgcccccccccacc

SEQ ID NO: 18671 - DNA, 285 bp, Homo sapiens
  misc_feature (1)...(285): n = A,T,C or G
ccctcgcttagaagnaatccaggcttactcctanagccacagcaanagaactgagcatcccagctgncanccagcaccaactgccgggcgtgtgagtgaactttcctagaaacgaccctccactccctcaatcaagactgaatagatatagccctggacagtgcagcttgactgcagcctcatgagacgcccagagtcagaccacccagctaagctgctcctggatttctgaccctcagaaactatgatacagtaaatatttggtgcaagccaaaaaaaaaaaaa

SEQ ID NO: 18672 - DNA, 1031 bp, Homo sapiens
  misc_feature (1)...(1031): n = A,T,C or G
cgagcccatatgagctagctgtanaacttccggtnccgttgtcgaagnccaatggcaaaagcaattgcagctttgcaagcaaaactgacacaggctgcaacacaaaattaaagagctggaggcctcagaggttatgcaaacattgtaatccatttgctcgaaacccaagtttctgccccaatgccatgaacaaaattagagtcagctaatagggtaaaaaaacctgtacatttcagactatgcgatcttaagaatatttctttaaaatgcaaaaaactgaacggaacgcaggatgagataaacagcactgacaatcaaacaaaaactattagggaggaatgagagcggaacaggataacaatgcaggattgggcagcctggactactactccctgactcaccgatggcacgaaccgcggcgtggtggtacctactctatctcccacaccacgtacaccgcctcggccgcccaccctgaccctgaaacacacctcgtctgcctacaacaccctctccctcctggtctcctcgtctctccacaaccccccctgcatcccttacaactcccccacgatcccaccctacaacccctcacctgctcctaccccgccgcaaccctctcccctcacctactcccaccccacactccaatagcatcgcacaaccccctccacatacaccacctccaactcccaccgtcctaaacacgcacatccgcccaataaaccccaccaccaactccactctaccctcatactctccttgacccatctcctcctatgtacgacagttcccctctctcccaccctaccctccaacacccccatacctctaaaccccccccctttccacattccncacacactctacttactctacacaaacactcctcacttcccacctcctctatttactccaccaatctactctacccacctctcatacccacacgacattctactcactcctactactcgaacaccccactgttcccaccccatatcctacttacaccttacaaacaacaatct

SEQ ID NO: 18673 - DNA, 789 bp, Homo sapiens
atacttaacaagaaaaagaaattcaacaaaatgaggcagagaactatcatggcaccatcctgaagcatgaacaatttctaagagtctggcagaaaagcaggaaggaaggcaaaccacaaagaagaaacctcaaaatcagtgactgaccttcctttcatcacgaagggccattcaaattttctgcccatgcctccagggaataaccctatggctgctgcaactgataaagatgcatacaagaaaacttccaaggaatggaaaatgtgaggcacaaataactaagtgaaggcctagctgctaaacaatctattagagttaactaagctaattcaaccatatgaataccaaaaacttgctttgccaaaagttaacactaacgctccaaaacgagaaaaacagcaacttaaccttctagataaaacaacgagtacaaatgcccaaaccgacaccgactacacagcaactttcaccgcttaacatactagaagcccacaacaatacataataacctacgaaacacctctctcccacacaacagaaaccaaaaagaggcagaaacaggaccacagaagagaacaaaagcccaaaacccccaacacacaaccaacacaaggaatcacacaacccacccacattacaaccagcatacccacactaaacacgcaaatagctcacgaaaagaacaacaagtcacaccacactaatcaaaatcacccccccccacgaaatcaataaccacaattagacacaaagcgagacaccagacacgacgtctatacacgactacac

SEQ ID NO: 18674 - DNA, 301 bp, Homo sapiens
  misc_feature (1)...(301): n = A,T,C or G
tttatgtgtatcagacggggcatcaacccccccacaccccccggagcctccgagcatcaaattggatttaggagaccaanaaaagtcccttggcaaaaactggcctcatacctttgctctacacagtcccctgctactgagttcctgtcctgtgaacctatcgacctggcaagccccctcactgcttttgagttgtaccccccttttcgcacaccacgcccaatgcctcatcccccctatgcacaactgatcatctcatgctctcccctataatgtatccaccacccaaaacgtgcctctg

SEQ ID NO: 18675 - DNA, 225 bp, Homo sapiens
  misc_feature (1)...(225): n = A,T,C or G
tcgaggttaaanacattttaccactttggggaaacttgagaaggggacatcgctttaagaccaggaagttacaagaaccaggccctggggcatacattatgtggatgtgctnctttcttaaaaagcacttactcaatggcaataaaaatgtgatttcttcggtttggaaaaatttaccattcctgcccagaaccaatnacaaaccagggaagaaaaaaaaaaaaa

SEQ ID NO: 18676 - DNA, 439 bp, Homo sapiens
  misc_feature (1)...(439): n = A,T,C or G
cgggttgctggcaatatgatagtgtngaacctggnactgtcagagtcctattcagaatctgagaatgaagccttaaaaggaagtggacccaagaaatgaagagactcatggcccaggtgatataagttgagctcccagacactgctgtgcctacacttttcagccacatgaacctacagactgcctttgatgcttaagttatttgaattgagccttctgttgcttgcaacccagagggtcctgactaatacatacaatgtagaagaaccctgatctgacctggtcttcaaacctctctggctttcatttttttcaactctaagatgacaaaattagatatcaccttgattgctaaagttcttgcaggagtgcttagcgcttgcatatttaagatactgtatatctacttaatgaaaacccaaacacaaaaaaaaaaaaa

SEQ ID NO: 18677 - DNA, 268 bp, Homo sapiens
  misc_feature (1)...(268): n = A,T,C or G
ccacagtgggtcgatggtgtagccatnaatagtttaacaaccagctctctggaaagtaaaactcagacttacagcctttgccaattgccgtggtttaaatactcctanatggttgagttcaagctaccaacatgacatcaccgaatacagaggagaagaggtgcgtaatcaacagcacaagcatcatgtagtatttacacacagggacaataaagtatagataatagtaaaatgaaataaaatcattagaaaatgaaaaaaaaaaaaa

SEQ ID NO: 18678 - DNA, 301 bp, Homo sapiens
cgagccatatgagctagctgacaacttcgtccgtgtgagccaaggcaaaagcaaatgcagctttgcaagcataaactgcacagcaggctgcaacacaacaattaaagcagctggcaggccctccaaaggcctatgcacaacgattgggcatgcgattgtgagtctggaacaccccaagcgttcctcggccccaatgcccatgcaacaccgaatcagcaatcccacccatcaggcgacaaaaccacctgcgcattccaccactagtggcgtccgtgaagcaatctcttcctcttaaaatgac

SEQ ID NO: 18679 - DNA, 299 bp, Homo sapiens
  misc_feature (1)...(299): n = A,T,C or G
ggcatgggccacctcgggngtaggttttgcgtactgaggtgaagcagggtgtgatgaccacttctcaggcaaattctagagagctcctccaacaacttgcacctcaaaaaaagaccagagaccagcctcatccaaccattatcacctgggagctattagaaattcagaaatacagaatctcaggcctcgcttcagatctacgaaaaaataacccatattttgccacagtttctagctgattgtatctggtgatatctctttgaataaagtatatttaattactattaaaaaaaaaaaaa

SEQ ID NO: 18680 - DNA, 366 bp, Homo sapiens
ccggggagcatgcatactcaatcaaatacttgtaagcagtacattggttcagtctggaaaggctggacaacttgaagcaaaggcaggaagacttgaagcggggagggagcttccaggtcacagatagagatgaggtcttactatgttgcccaggctgatctcgagcccctgagctcaagcaattctctgacttcagcctcccaaggtgctgggattacagacgtgagccactgcctcgggcccatattttctttatccattcatcattgatggacatttaggttgtttctgtgttacagttattgtgaatactactgcaataaacatttgagtgtcacaaaacccaacaccccaaaaaaaaaaaaa

SEQ ID NO: 18681 - DNA, 301 bp, Homo sapiens
  misc_feature (1)...(301): n = A,T,C or G
ggttactcctctgtcaccaagnctgggatacagtggcacgatcacagctctgcagcctcaatctcccgggcttgagggatcttcctacctcagtctcccagagtttcaccctgtcgcctaggctggagtgtggtggtgtgatctcagctcactgcaacctctgctttncaagctcaaatgattcttctgccttagnctncnaagtagctgggattacaggcgnctgccaccacatctggctaatgntnggtatttttagtggagacggcgcnccgcgngcgggacaggttgtcccctcatc

SEQ ID NO: 18682 - DNA, 967 bp, Homo sapiens
  misc_feature (1)...(967): n = A,T,C or G
tcccagaacaagagtggacaaccaaagtagcaaaatgctttccaggcacggaagagtcatatctataaattattaggccgatagatttcaaacactccacaaggttcgggagaatcatccattatcatgaaattacatgggcattgttgattgtagaagtgcagttactgtgagaaaagatgagtatgtacatttgtagcaacttggtttagtttttactttttgaatggcgacgcgatttgtctctgtccataaacaaacatcctcgaatctaaaattaatcgtcaacctgccgccccaatatcaatctccaattcttcgcaacaccccatcccattccccccgccatacaatcattacggatctcccattgcgcccatcatccctatactattgcgtacatagctacccataacccttctccctccgctaagcgtttaaccatccgtttatccatttatccaataaaaaccgaatccaatcaccttccacgcgatcacttctatctttataccccgccacatatgttcatcacttgctcccccccattatctccttactcaccgacgtccttattcccgccccccatccctcccgctttctttcccccctcactttttccctgccctccccccctttatcaacccccttctatcttattttcccccgccccaaaaccacatactcccccacccaacaatccatcaccctcttctcttttcttttccttctccaccatatactgtaaccactcacccaccattttcacgtaacccataacctcctctccccgcttcttcccccccccaatattccccatgccctcttttttaccacatgtttacttttcccaactcatccctttaacgcccacttcacttcaccccatgttgttctccgtcccacatacccctcctcacttcctcttttgtcgcgattccgcacttcgttctnttgccccagttcc

SEQ ID NO: 18683 - DNA, 232 bp, Homo sapiens
  misc_feature (1)...(232): n = A,T,C or G
ccaagacgcccgctagcagcataaaaataccanaaacctaaccaccgaactttcacatctgtttttcctactgtaaacatcaaagacttcaattttttttttctttttcgtttctgttctctgtataatactgtaaagagcagtgtgtaaatgtcattgactaaggttgataaagtaagcactgataataaacttttctgtattctcagaaaaaaaaagaaaaaaaaaaaaa

SEQ ID NO: 18684 - DNA, 352 bp, Homo sapiens
  misc_feature (1)...(352): n = A,T,C or G
cggtgacaccagtttgcaacctgtaagnccatttgtgcatataagacatcaagtaaaataatcttcctaacagtgcacacttttcaagagcacgatcatattttatattcctgaggatcctgtctgattctgttttttttttttttgaaacctttaaaaaattgttttgttttgctgctgagagcaataaattgtttggaaagtattaatgcaaatatgcagactcaccatatttttgctgtgtgagttctaatccctgctcttacacatggataactgagggggagccagtgacttattttcttggagtctcagtttctttttcaataaaataggagtaaaaaaaaaaaaa

SEQ ID NO: 18685 - DNA, 577 bp, Homo sapiens
  misc_feature (1)...(577): n = A,T,C or G
tcggtacaaaaagaaaaagtaagcacagtaccactgcaagacatatacctgtttcaaanatcagccggtaactcctgaaaacatcgagctcaaaaaagaacaggcatggctttgggaagaagacagaatttgagatctggcgtgaggaaatatggagagggaaactggtctaaagtactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgtttcaatgaaaaaattaaaacctgatacgaaaaaaaaaaaaa

SEQ ID NO: 18686 - DNA, 916 bp, Homo sapiens
ccaggtccagttaagtaccaaaacaaaaatcaaatttctttactatctcagcccccaccaagtaactgactcagcacaagaagacagcttcgactccctcggatttcatctctgacttgaccagtcagcacttctggcttactggcttaccccagtctcactgctgacccaccaccaagtagaccaataaaactctgatacaaccatgctcacgacacattgactaatccacacctacatacacccgtatccatgtcatacaataaaaattacaaaacacccaaacctacacactaaatatcatcactacccccccaaaccccacacacacatacacccaacaaaacccccaaaacacacaccctcccattatattccccaaaaccctatccccccacacctatcccaaccaattattaaaaacccaaaatatcataacacatccattcaccaaacccttattttcactacccaacacaccttatatcctcttttttccctccattctccatcaaaccaccacaacaaaatccgtcccaatacccacccccaatactttccccccaccaattttttcccacccccacaccccccctttatcaaccacatttatttaattttattttccaaccccaccccaatccccataccctccactgcccaccatccccatcaacaaccactaatcctaatttacacccccccaaaaaactataacatttaaccatcaaattatatcacatataattcgtaaccctcatctcaccaccacaaaatccccaacacccccaacattccccaattttataaaccaaatcctccattcaaccccaatccagttaaccccaattttacccctccaaaaccctccatatataccccataatccattccccaatacaatattacccgtatc

SEQ ID NO: 18687 - DNA, 327 bp, Homo sapiens
  misc_feature (1)...(327): n = A,T,C or G
gtatgcatttggaagatgaaaagcattaaaacaaacatnatcaggggnaaaataaaggaacgagaaagaggtgaggagcaacctctgtatccccggtcccagtttcttctagccaccgatgtccttcacctgaagccttggtcttcctcagtttataaagcagttctcaacagagaaggtgtcaaatgatagattcaaacagagatgccctaaaaagactgtcaaaaatatgtccttaaaggtagagagcaaggccttcgaaagctgtacagaacaaatggtgtggttcattaaaattacttggatttaaactcaaaaaaaaaaaaa

SEQ ID NO: 18688 - DNA, 393 bp, Homo sapiens
  misc_feature (1)...(393): n = A,T,C or G
tattacccacgtatgaaaaactgtgaagcccttcatggnctagcagncttataattgnaattgtagtgtctctgcaggctgacacanagcaatggagcaatgcttgagtgacttggagaacagagtcaacacctgaggaataaattttctccttgatctttcaccatggttttgaatcttttgataatgttagagaagacacaataaaaatgatattatttttaatgagcaaagacatgtagctgacactacactgcctgctgcagaaaaggatttttcaatattatttgaaaaatttggggtggggggatattttacatataattaatttcatcttaatttgcttagctctctgttaaagatcatcaggttggaaatgcaaaaaaaaaaaaa

SEQ ID NO: 18689 - DNA, 264 bp, Homo sapiens
  misc_feature (1)...(264): n = A,T,C or G
acaggtttccggtttttggcattctggagaccgaggctctaccatatcactgtttggtcctgtgacccccacccagnaactgactcatcgcaaggggacagcgtcaattccctatgatttcatctttgacccaaccaatcagcattccccactccctggccccctacccgccaaactatccttgaaaaaacctagtcttcgaatttttggatagactaatctgtgtaaaaataaatctatggtctcccgttaaaaaaaaaaaaa

SEQ ID NO: 18690 - DNA, 440 bp, Homo sapiens
  misc_feature (1)...(440): n = A,T,C or G
gatggccccaccataccccacactacttccccattctcccctgnacttgaactggnacaaagtgcaacaagagaagcattccaatggcagtggtttgaagttgataattaattacataaagtcacatttggaatgaatagcaccaatgatcctcgtccaaaggaacagctattattccctcaatttcctatcaggacaacctgcaaaatatttttgataaagtgagaagagatttagtaagaattttatttattttctaaacttaagaatagaaagtatgggtataacatctgagaaggcacctcacaatgttttgatctgattcctaatttttacctttataaaaatagactaactttgtggcttgctaactcaataattgtgtaaatcaaaatttatgatcattaaaatttatggtctataagtcaaaaaaaaaaaaa

SEQ ID NO: 18691 - DNA, 289 bp, Homo sapiens
  misc_feature (1)...(289): n = A,T,C or G
gcgggaaaccagcgaaatactggcaatcataatcttggnaggctttaggatgggattgactgcaaaggagcacaagggaacttcctggggtgatggaaatgttntgtcttgattgtggtaatgattacatgactatgttttgtcaaaattccagtacttttataccctagagggggaatttttactgcatggtaaatattccttaaaacattgatttttaaaaagggcctgaaatttttacctcctcgcttaaaattaaattaaattaaattagccaaaaaaaaaaaaa

SEQ ID NO: 18692 - DNA, 256 bp, Homo sapiens
  misc_feature (1)...(256): n = A,T,C or G
ccagctactatgcactggaanattgggggcaaagaagtacacatctgcaactaactgggaatggttcagaagagatgcacacacactcaagcatatcgagagaggaaggggcacaggacacagaaggccctgagtttaatgtgcatgttttggggaatttggaagaaagcccctgataattcatccttcattattcttgcaacttttctctaaatctgaaattatattaaaatatagagctagaacaaaacatgaa

SEQ ID NO: 18693 - DNA, 936 bp, Homo sapiens
tttctaggtttatgaagcatgcatgtgttcagcaatttcatgcaacatatatgttctggcacaaacacctggcatagctttgccaaaacaaggtaccaatatcgacacttaatgagaactggatgactatgagagactttacaaaaacccatatcttcacgctaaacagtaaggctgaacacatagagtggcttagaaattattttaatgaaaaaaaggatattgtaacagaaagtgccgttctggtcaatgagcacgctgggagttgttattcaaaacggtgcggagatgggtattacagctaaggcgaagggtggtactacattttgcgtctaaaaacctataatagacctaaaaaccacaacaaaaaataccacactcgacacacattaccttaacagcaagacaaaacaacacactacaccgtgactcatacccacaccccctactcctttctcacactctctccgtatccaccatactcctctccccgctctcaccaccacgtctcaatcacatcaccacttcgcaatcacacttaaccttaacatcaatccacagcacgccgcccaacacttattcgcacccgcgtaaatcacactactgttacctttttcggttcaacactcccaaccatctccactccatgagataaccacttaacacacgccgttctaaccccagtcctccgccccaccccccactcacccccccatccacccctcttaccacaccccatctcagcccatctgcatttctcacctttacccatcgtcacgccctctagccgctcacaccctcaactcccgaacacctttccgccctacacaccatcacacacacactcctccccacactcccacttcactgctcactgctcaaaccccttctccctccacttcactcccatcgccacactccccactccctaactct

SEQ ID NO: 18694 - DNA, 409 bp, Homo sapiens
ggggccccagagccaacagtgcaaccgattgcccaacagaatacacatatgtttctttctaacatatagcttttcccagaatgggatctgggttttctggctgctgggcctggtttatagttcagtggggaccacacttaacaatggttgaacttcaggtgctgtgacgaaatgctctcataaggctggagcagctccagtgaagctggacctgcagaagaaagagagaggacatagatatgtctcatggaagggcattatctgctctgggatgtcctgcagaaacatgagaaatgaagtaaggtgtgtgtggccttctgaatcccccagttcactaataatgtgttaatacccagagcaatggacagaggtgaatagatagcctatcaaaatgggaaaaaaaaaaaaa

SEQ ID NO: 18695 - DNA, 204 bp, Homo sapiens
  misc_feature (1)...(204): n = A,T,C or G
ccaagtgttactattgntgnactncgggngattacccactactcaggagctgagcaggagaatcgcttgaacccaggagtggaggttgcagtgagctgagatcgcgcctgggtgacagaacaagactccgtctcaagaaaaaaaaatgcttatgttctgtataaaatcttcaataaaatgacgataccagtaaaaaaaaaaaaa

SEQ ID NO: 18696 - DNA, 2133 bp, Homo sapiens
  misc_feature (1)...(2133): n = A,T,C or G
cccgaaatntnntaatnccgccgagctccntaactctnggtgcntnggcntcctctcatcnncaaccttnnaaganacnganagngnctaanannancatggnnngcntcngngcanatnatcntgncttnngcngccattgctctngncgagctacttatgcgagcttnagttttgncttaaggagnagnataggagaaggatanngatagggtangnctngtaggattngacccagttnggcatanagtngacttgttggggatgcncataggatcaganagnaggcgaatnacgttgtgagagaagagttgtgttcgaaactngttgacgagnagnagccggtcgnaccangatgcgtgcatgcacgacaatcatgncccgnncgtagaangnngatnagctcagcgacancagcacagcanaggcgngagagcgcggcagcacagngatgacacggacacgacgaganagntatcanancgtagcaggcacaagagganagnacgatgatcggaagaccgatnacatgagcagcacacgagatctgcagcacganagttatcatagnantatagtgagacgtacagtaagaatgcagcacgatgctagcagcagcagcgtntcagcagngagagnagngatatgtagtatcacgagcacggacgcagncacgacgatcacagtatnacagcgcaacgcctgcagcatcganancagcatcagnancggnnagcagcagcgcngncagntncgacgnagtagagcatgtccgcgatcacgaacgcgtatcagctgacgtnatgananatcangcaaacggactacgatacacacagacacacgacgancagctcacagaccgncgacgacgacgctantccgacgctcaacgtcacactcgacgcgatgccngnacgagcagggacgacgaccatgcagctagcgcacatcatacagcgctnactccgtcacctcgatacngtacgcgacgccgtgccagatctgacactaccgtacagtcactactaacatcgtgtacacgacgatgtcgtcgactacacgagcancangacgctcacagtcagtcgacaggacacacgntcggacgtcacggatacncnaccacgacgancgcatagcatgcgcgacgcagcgcagngagcagcacacgacgcgacgnatnaagacgtcgacgngagctcagtacgtactgcacgacagacacgatgcaacgatacgcgaggacagcagcgngtacgtgatatgacacgcgacgccgtgtcagcgacacggcaagtcgagcncacgagcacangtacgncagcgctggactatccgcaagtcatgagcacgacgacaggcgatgagcatacgcaagacgnctaccgnatatcacgctgtagcgagcgtagccgcgaacgcngcgacgacgacgccgcgcngntcgacgacgtagangacgcttcgngcacaccgagcgnacgcnacgacaccacgcagnccagacgaccgacgcgtcgacgncgacgcgcgaccgaactagagtgtcagcaccgatgatgcacgcgcgacacctacgatgcacgacacgccgatgcggacagacgggtggcgacgcgacgacgccgacggggcggatgcagacggnagcacggacgcagnaacgcgctgtgcncggcgcgacgcacgcagatgcatgacagcacacanagactgcacagcgcacacgtcctcacactacgctctgacacgcagcgnattagaggaacaccacaccgacgcnccanatcgccactacagcaacgagtgatcgtacacgagatatacgtgcgcggnagccgcgcctgcgctgccgagtcacccactagagcgagcgcggcacgatgcgctncaggcacgcgccagacggcacgcgacgtcgcgcagcgcgcgctntacgcacgcagcgcgtgtagtcgctggacgcacgcatacactacgacggcggcgaggtcgccngcacggtgcacgcggcgcgtgccgncgagcgcggcgcgtcgcacgcagcgacactgagcgcacaagccnccgcggcacgccgatcagcgtnctcgcagtgccaccgcgntacgacgatgntngtgctgcagt

SEQ ID NO: 18697 - DNA, 204 bp, Homo sapiens
  misc_feature (1)...(204): n = A,T,C or G
caaggcctcacacttgaaaagnanacaaaaggaaaatggacatttattttttcccccaatgaaaaatggaaacaccagcatccaagaagccactggaaatatatgctttgcaagtaaagacgtatcctagattctttttaaattagttttggaaatttgaaaattttaaataaaaaagtacaaacacttcgaaaaaaaaaaaaa

SEQ ID NO: 18698 - DNA, 252 bp, Homo sapiens
ctaggtgcacggctgctcaaccgtgtgctcttactggcaacattagcagtggattttcgacacttaagggccatgatgaacaaaataacaagagatgtaaatcaagcaccaatagaaaatgatgcaattaagagactcagtaaacgtaagatgtaagaagttgctgcctgcatagtatacttttttaataagtaaaagaagtacactctaaaattacagtaaaagtatattaaatacataaaaaaaaaaaaa

SEQ ID NO: 18699 - DNA, 340 bp, Homo sapiens
acggacgtcaagggtcttgctctgtccccaagctgggatgcagtggcaccatctcggctcactgcaagctccgtctccttgctcaaggtgatcctcttacctcaacctccctaatagctggggctacaggcacgtgccaccacacccaacttatttttgtatttttggggagaagaaggtttggcctggtggccaagctgggcttgaactcctggggttaagggaaccacctggctgggctttccaaaggggtgggaatacaaggatgaacctgggcttggtttttcaaataaaatccttcacaaataaataaaaaacttctggcagaaaaaaaaaaaaa

SEQ ID NO: 18700 - DNA, 263 bp, Homo sapiens
  misc_feature (1)...(263): n = A,T,C or G
cgcgatattccaccaaatanatgcanattnggatccggctcattgtttttcctcatactcctgttggatttttctcctaaaaaacagaaagacatgagattgaagaagttaattgttcaacccaggttatacatngaatggtacttcccaagaaaattaagagaaaatatcaacaaactcctatagcatgccaggaaatcaaccaatccaaattgaggcagaaggctggcaattcaaggaaagagatctcaaaaaaaaaaaaa

SEQ ID NO: 18701 - DNA, 222 bp, Homo sapiens
  misc_feature (1)...(222): n = A,T,C or G
ggtttctccgtcttctgctgcctacagcaagnaagacattcctggccccaaaggaacatgactgacttctgaaaaaaacacttttaaaatttgccaaacattggtaatacaattcatcatgcaaattcaaccaaaaaaacaaacaaaaaacaaaaacgaaacaaagcaacaaaagggaaaaacgcacagaaacaaaaaaaaaacacacaaaaaacacacaca

SEQ ID NO: 18702 - DNA, 184 bp, Homo sapiens
ccattatgagcaactctggccgtgaatgtctatgctacatttgggacaagaaatacaagagtaaggttcacctgtaaatcatgaaggaggctaagaaattgttacataatacgtaatataattttccaccatgtaaaaataactctataaaaacagaattgaagcaaaaacaaaaaaaaaaaaa

SEQ ID NO: 18703 - DNA, 134 bp, Homo sapiens
  misc_feature (1)...(134): n = A,T,C or G
acgattaattccgactaatgtgccactgtgcgttttggtgctcctgnatggaaaacaactctttgtaacctgagctcctctccgaaatgacctttactcccttgtttgtttaaaaattaaaaaaaaaaacaaca

SEQ ID NO: 18704 - DNA, 206 bp, Homo sapiens
  misc_feature (1)...(206): n = A,T,C or G
ccatgaggaacaacatttcaccatgttggccaanaggtctcgatctcctgacctcgtgatccgcccacctcagcctcccaaatgctgggattacaggcacgaaccactgcgcccggcccaaaatataactcttgattgtccttctgtaccctatgctttgtcttttcaagttcaataaatgatattgtcatctaaaaaaaaaaaaa

SEQ ID NO: 18705 - DNA, 193 bp, Homo sapiens
  misc_feature (1)...(193): n = A,T,C or G
ggtttctaggtccctgctgnatctccaaaatgtgntctaatctgtttactgagttccatagcacttggagccatcatgcaaaaactgtagaagagcattccaggaagagggaagagcaaatgcaaagacgggcgtgagagcttggtgcatacagccatgggccaaataaagtttccttggaaaaaaaaaaaaa

SEQ ID NO: 18706 - DNA, 216 bp, Homo sapiens
  misc_feature (1)...(216): n = A,T,C or G
caggttttcctctggncacacatgcctagttgttggctccaaagcagcgtttcctgcagaaaataagtacatttctcccagatgcagagtgtggcttcatgtcccatccctggttttattaaacgtggcatgagccctggatgaaaatcaagcctggcctagcaggggactgagtcattaaatatcgccactgttaacatccgaaaaaaaaaaaaa

SEQ ID NO: 18707 - DNA, 310 bp, Homo sapiens
  misc_feature (1)...(310): n = A,T,C or G
cgggcggagcaccacctccgagtngcacctatctgtgatattttnatgacctttnaggnaattctgtactttggaccaaccaagaaaaagnactgatttttgattaaagaaatgttncatnccgnagccatttccaaacatgccatanaagcaactgcctattgagggagacacccttgcttttgacattttatcaacaatgatctatgtaatacttaagactctttaaatttggaaaaaataggaaaatgtaactcaaactagtttaaacaataaagtgaatttattggctcatctaaaaaaaaaaaaa

SEQ ID NO: 18708 - DNA, 333 bp, Homo sapiens
  misc_feature (1)...(333): n = A,T,C or G
acaagttttcgagttttngtagcagcaggtntcanaattctgnaactatatttctggcacaaacacctggtatactttccaaaacaaggaccaattcgccacttcatgggagctggtgacttgtggcctttccaaaaacccattatctttagtgtttaaacaggaaggtctgaacacatagagtggttttaaaaattattttaatgaaaaaaagatattctaaaagaaagtaacatacagttcaattaaggaccatgggaaatttttatttcaaacaattagaggtgggtattacaactaaataaaataattttactatgaaaaaaaaaaaaa

SEQ ID NO: 18709 - DNA, 176 bp, Homo sapiens
attccattataccaagtctgccgtgcatgtctatctacatttgggcaagaaaacaaatgaaggttcacctgtaagttatgaaggaggctaagaaattgttacataatacgtaatataattttctaccatgtaaaatataactctataagaacagaattgaagcaaaaaaaaaaaaa

SEQ ID NO: 18710 - DNA, 373 bp, Homo sapiens
  misc_feature (1)...(373): n = A,T,C or G
gctagtttttccattgcatgaataaggaggaanaatgcgggtcacatatcccaacactgcagcaaatgtcggccaagtgaaaaacacacagtatgtcctgaagatccagcgacgtcctgaatgtgacgcgttccagttcacaaaagaggagtcacaaaatgtttacaaacctttaccatcccattgaaatggaccttcacattttcctcaaaaatagctttctaaaactgttactggtttacattaattttacctttcttctttttttcccctttttctttcttattttagaaataaagtaataggattagctttttgattaaagcatattaataaaattttgacattttatttgatttcaaaaaaaaaaaaa

SEQ ID NO: 18711 - DNA, 390 bp, Homo sapiens
  misc_feature (1)...(390): n = A,T,C or G
agttccaccaaaatacaaagaccaacaaatgtattcaaanaagagctttttgaatgcctcaccttaaacgcctcgctactcccatagtggataatctccaatttcactccaccgccatggtagcaaaaattgagtctttttaccttcttcaaaggaattctaacagccctctttttaactttgattctttatggttgtacttggttttatagtcaaggaagagcagcaatcctcttatagtctggctaaatcctataataaagattataatataatttaataagcttaatattatattttgataaaatagataacactttttttctagtggaaatacctatgttttacacatattagaataaaaatatgatatactcaaaaaaaaaaaaa

SEQ ID NO: 18712 - DNA, 362 bp, Homo sapiens
  misc_feature (1)...(362): n = A,T,C or G
ccaagaggccaatgggaaaaacaagactcaagcgacagnaacctgnatttanaacacatcttgtaagtggcagatccaggtttcaggattctgagtggcacccagacagatcaacccataatctcggtctccaggacaagcatcaagtgccttgaccactgcacctctcaaccatcctgcaccccaggaaaagtgcacaaggtacaagaaatccttcaggtcaaggacaaaggcccagtgaagtgactctcatttttctggaaccttcttctgttgccagtcacctgctgctggggcccttttagcaagtggtagataaagaaaaatccctaaaaataaagtataatttaaaaaaaaaaaaa

SEQ ID NO: 18713 - DNA, 283 bp, Homo sapiens
  misc_feature (1)...(283): n = A,T,C or G
acgaggtgagccaggtgtctaggtancagaagtgtaggcctttgggnagctcattaggtcatgaggacagagcccccatgaatggaattcatcccttataaatgaggccccagagagcttcctcgccccttccaccacgtgacgacacagcaagaagacgccatccatgagccaggaaaacaagctgtctccaaactctgaacctgccagcgccttgaccttgaacttcccagcctccgtaactgtgagaaataaatttctgttgtttataaaaaaaaaaaaa

SEQ ID NO: 18714 - DNA, 212 bp, Homo sapiens
ggggcttccagggcaaagtaaatttcagtacccggcaacttgtctagaatcaactcttcataattagtgatttcgttgtctatgggacagagggaaaaaagaaaaacaatttctactttctatatatctgaacttgaggactaccagtaaatacagaatattcataattcatacaataaaacctaactccattttgcataaaaaaaaaaaaa

SEQ ID NO: 18715 - DNA, 345 bp, Homo sapiens
  misc_feature (1)...(345): n = A,T,C or G
gggtttttccgaggcaaactggccgagtactgttgntancttagtncagcatatcagcagngactgggataggtagcttttntaagctcaagcaaatgttgtggtaatgtcanacatgnaatacattctcccacctttcaaatattgaacatcccaaatttgtaagtcatacgaaaaaccccaggcctggaagaaataaagataaaattaatctggtaatttgtcacgggattagttgtacaactagttagaagtttcagaataaacatgcatttcataactgtcaaatgttcttttaattctgagtccaaataaattatttggtgatgttgaaaaaaaaaaaaa

SEQ ID NO: 18716 - DNA, 876 bp, Homo sapiens
  misc_feature (1)...(876): n = A,T,C or G
gcaggggtttccgaggtcttttgtccttcatgctccggnaagtgnaacccgcaacaactcaaatatgttttggaaaagagagatcaacggaattaaactccaagttgactacccttcaaagatatgatatttggatatcttaaacaggcaatagagggaaatgatcaagaacatagagccagactttcttggttaaattctgactgctatttctaaacgatgtcacaatggataaatttgctttttcatttctacagcggactttttcttacttctttttaatctttcttattggaggtcacaatggacacgactgcctcaggatcttaatgtgtgaaacgacgatgactgcacctatctgagttataaagatcacacatcatcgaattgtgtcctgctcaaaaaacaaaataccccttgggctgtcttgacctcaacgcgcgcaactctaccgacgaaccgctttagagagggcccccccgtgcaaccccgctcgctacccaccttaccccccgccctcacaccccaccccaaaccccacgatctcctaaccgctcccctccctacgcatcgtccccactccacccttaccccttctccctcgccccaaacacccagtccacgccccgaccaaccactcaatccgctccccatcccgacacgtacctcacattctcaacgaccctagtccccaactccccccctttcgtcccctcgccttcgcccgcccacgaacgtcctcacccaccgcgaccccgaccccaccaatctcctacgctcgccgccgtctcctcccactcgtctcttttcctcccccccctcccgcccacgacccctcccccgctctcaccgattactccatcgaccgccaggtcc

SEQ ID NO: 18717 - DNA, 494 bp, Homo sapiens
  misc_feature (1)...(494): n = A,T,C or G
cggggctatctgagcactatagcctgctcaccacagacccanagcgtgngcccacaaanaaaaagacatgtggggacacagtgaaaagcagccatcataagccacagagagaggactcagaagaaaccaactctgctgacaccttcatcttgaacttctagcctctagaactgtgaaaaaacaaatttctgttgttaagacacccgggctgtggtattttgttaagacagccctagcaaactaacacaattttgtacactaaataaagtccaattcaattttagttttatagaaactgcaacaaataatttaaagatttacttagtaaattacttcagattgggatcaaatgtgtacatgaattatgaaaatgtaagaaatggatatttaaataagtctaccagaacataaaaattccagtgcctggttttttttttttttgaaagccacttatcccaacaataaaactgatgctcaaaataaaaaaaaaaaaa

SEQ ID NO: 18718 - DNA, 835 bp, Homo sapiens
  misc_feature (1)...(835): n = A,T,C or G
gcggattttccgctaaatctgctatatttanacgggtcaggcacctacctctggaacanaaggaaaagttagcttcctgtgatttacaaagtctatgtacgacacaaagagccagattaacaaaattgggattattttacagagaataagaagtaactaaatatcagtatccaaccacgttgatcacttaagaaaaagaagccttgtgctattaaagaagaataaggaggaggaagaggaggagacggaagagaggagaagagaggagcnngggaanngnntncngncagannacacaccaaagactgagagccgcaaccgaaggcatccctttcttaggtgctctttttctaaacgtgcggactgctgtgtactgcttgcgctcctccgccccctgctgctcccgtcccagtgagctatcatcttaccccgtccccctccctccctctcgccacttctttcccttctcccgtactagcaccttgatccggcagtcactctcccctcttacgtcccccctctctccccctcccatctctgccccccaccccgcctccccacccgataccccccttctcgtcctcccacccctttacctccttcgaggttatctccagcatagcgccacccccgccgcacactccgtcgccgtacacacagccacccctacaccccncnngnccnncccccatcccccacccggccccttgtcttcctccccccccccttcttcctctctacccctctttcgttctgggcgcccccccggctcttgttccccatccctcattcagatactacgctcgtcgctgtttctcatctctaactgtctgtt

SEQ ID NO: 18719 - DNA, 264 bp, Homo sapiens
  misc_feature (1)...(264): n = A,T,C or G
gcgaagcgtttccaggctgctatttagccagtattnccctaataccaatagtatgtgccctgggaaaaanaanaaatctggacacagacgtacatgagcagagggaaggccatgtcaaaaacacagnaaaaaaagatggtcatcagcaagccaaggagagaggcctcagaataaaccaaccctgctgacacctggattttggacttccactctctagagctgagagaaaataaatttctgttgtttaagccaaaaaaaaaaaaa

SEQ ID NO: 18720 - DNA, 185 bp, Homo sapiens
  misc_feature (1)...(185): n = A,T,C or G
gcggaggttagaacggaggttgcactaacgacgctaatctagggcnctacatnctgatggaggaaaaggnaatgtanctctatcancaggacactggaacctgccagcaccttgatcttggacttcctaacctccagaactgggagaaataaattccttttctttataaattaaaaaaaaaaaaa

SEQ ID NO: 18721 - DNA, 295 bp, Homo sapiens
acagtgttccagctggcttgccttggccctgtactcttttccttcaaaggaagagaacacttctgagacttatttgactggacattgagtcaggattctagacagcctggccaactatgaaacccttcttctgaaaaacagaattagccgggcgtgcctgtaatctcaactacttgggaagctgaggcaagagaattgcttgaaccccggaggtggaggttgcagtgagccgagattatgtcactacactccagtctgaccgacaaagcgagactccgtctcaaaaaaaaaaaaa

SEQ ID NO: 18722 - DNA, 224 bp, Homo sapiens
gacattgccgatttgctttagttacgcgcacattaactatcatggttccactaaacgactgactattggggactgactttaaatatgataagcgccgtgtcttgcttgctgtaccaccctacatgactgctttccagagcctactcttaatttataattgcccggtgccatgcttcctgtacagcctacggacctgttgtgccaataaagactgatttctttat

SEQ ID NO: 18723 - DNA, 215 bp, Homo sapiens
gccggtggcgggtgtgtacacacctccaaatgaactgggaggcagccatgaagagaccccatctcaccctgcttactatgagaaagatggcaggtttcctagagctctacttacagaacagccctgaggcctgtgactatgggctctgaaggggcaggagtcagcaataaagctgtgtctgatattttccttcactaatatgaaaaaaaaaaaaa

SEQ ID NO: 18724 - DNA, 216 bp, Homo sapiens
gatgaagttcacccagaggtgaagtgtgttggctccgtagccctgactgccttggtgactgtatcctcagaagaatttgaagacaactgggtcagaaagatcacagaccatttctgtccattcgaaactcacgcgcatacacagatacacatcttgccttaccggcccatcacccccaccaccacccctctcccgcactgccctcactagcacttg

SEQ ID NO: 18725 - DNA, 161 bp, Homo sapiens
  misc_feature (1)...(161): n = A,T,C or G
acaacaacctatcaagcttttgctacaccttgnaaacatagggatcttctgctcaccttgaaacattaggattctggtctctgctgtgggtaacacaagtgccaataagtatcatggagtcatgtttttaaataaaagcttcacttctaaaaaaaaaaaaa

SEQ ID NO: 18726 - DNA, 146 bp, Homo sapiens
  misc_feature (1)...(146): n = A,T,C or G
gcggggacaactagtacaacacaatncaagncaataacatattncagcaatgcagggctataaaggaagagaacccgggagttttgtgatcattgacatttaagacaccaaaaaataaaagactcctacgaagaaaaaaaaaaaaa

SEQ ID NO: 18727 - DNA, 161 bp, Homo sapiens
gctgttagctttgatagtgccagctttccctttgccttacaccatgatgtaagctttctgaggcctcatcagaagtcaagaagagcccggtgccatgcttcctgtacagcctacagaactgtaatccaattaaaactgttttctttataaaaaaaaaaaaa

SEQ ID NO: 18728 - DNA, 220 bp, Homo sapiens
  misc_feature (1)...(220): n = A,T,C or G
acagtggcccgatgttccgttcatggnaaganatgtaagcactcccccaaatgcaaccatgnnaaaatncttcatttaaacagttccagggaaagcttaagtggattggaatatggctggggcagcccttggaaaatggaaggggattattattggtcaaggggaaaataaaagcttggaattaaaggctggctggattccaaaaggaaaaaaaaaaaaa

SEQ ID NO: 18729 - DNA, 1001 bp, Homo sapiens
  misc_feature (1)...(1001): n = A,T,C or G
ccggctctcgggcatctggtggtactgttgtgctagttcacatatcatcaagaactgggataggtactttttaagctcaagcaatgtttggtaatgcagacatgtaatacatcttcccacctttcaaatattgaacatccctaaatttgaagtcatcgacaaaaccccaggcctgaagaaataaagtaatattaatctggtaatttgtcacggattagttgtacaactagttagaagtttcagaataaacatgcatttcataactggtcgaaatgtttctttttaaattctcgcgtccaaatataattatttggttgatgtctgaaaaacaaaaacaaaaaaaatgggcgctacggtttggacccttccagccaggatgcgtaagcttctcggccggccacgccttcnctctctgtgtgagatgtgagagagtcctaattattcacttgcatnctcctacgcgctcacacctgagacatacgactagcggcctccggtaccgttgcggctgccgcgcgatgcggtattcatccttcactccaaagcgcggtagataccggttactccccagaatctgggggatccacgcagggaaagcaaacatggtgcaagcagagaggtcacacccacaagggcgcaggcaacaccggtaagaaaggggccgcccgtctgtgctgtngcagttttttatgccaataaggccttcccgcgccccgcccttgaacgtagccatttctacaagaagaaatgcgaatccgcttaacaagattcgaggaagatgggccgaaaacccccgccccggcactttttcaacgactacccgggccgattcctcccctagaaaacctctccttcgtgccgcgtttgatgcgtccccgtacccgtggtcgctcttaaccgcataccccgtgcccgcccttttcttcncttctgcgagaagaggacggcgcgcttttccctcacaacctcccacggctctgagcggttaccccacgtagtgg

SEQ ID NO: 18730 - DNA, 180 bp, Homo sapiens
ccccgattataccaatatacaactctgccgtgcagtctactacattgggcaagaaacaaatgaaggttcacctgtaaattatgaaggaggctaagaaattgttacataatacgtaatataatctttctaccatgtaaaatataactctataaaaacagaattgaagcaaaaaaaaaaaaa

SEQ ID NO: 18731 - DNA, 229 bp, Homo sapiens
  misc_feature (1)...(229): n = A,T,C or G
gtgagaccgatgtcacggcatctccccaatttttcaccatacctgnatatgttagtctcctccctcatgtgaagcacggnaacgctggagagaacctggacccatttttacggctngagaaagcatgagaaaagaaaaaacctcaagctgtactgtaattccagctcatcacagaatagagagttattaaaatgatttctgctaaaatcaaattttaaaaaaaaaaaaa

SEQ ID NO: 18732 - DNA, 385 bp, Homo sapiens
  misc_feature (1)...(385): n = A,T,C or G
ctacagatcattattgtctccctgtcgcagtctcccctgncacctcagagaaagagtgggcactgtgagggctgcctagcatgccgtgagataaaggatgttctgttcaacatcatgcttcaggaaatatttctgccttatcgttcctgaaatgcctccccatctactctggctcttgtttagcatgttttcatttctagaacagtgtcaaggttccctgtggctatttgaaccctctacaggtcctggaatcctgactttgaaattgtctctcttgtcacctgcttggtgacatgtattaaaccccttctgatcatttctcctttcttctttactaaccttaataaatagctgtgttgttgattgactttgaaaaaaaaaaaaa

SEQ ID NO: 18733 - DNA, 279 bp, Homo sapiens
  misc_feature (1)...(279): n = A,T,C or G
gcggttctgccgtccttctgccttgcaggnacagctggtgccatccagatcgataaactggcctcatccaatctcttggcccccacccaggaactgactcagcacaagaagacagctctagactccctacgacttcctctcgcatccaaccaatcagcactcctgagtcactggctgcccacagcccaccaacttatccttaaaactcctatccccaaatgcttggggagactgatttcagtaataataaaactctggtctcctgcaaaaaaaaaaaaa

SEQ ID NO: 18734 - DNA, 404 bp, Homo sapiens
  misc_feature (1)...(404): n = A,T,C or G
gcggtctccggtatctcagcatgaaatgccttcacctcanaatacccaacctcaaaagcatattcaagcagttcttcatgactcccgtaaatcaagctctcatcattgagccatgggagcaaatgaatattctcttttaaagagtgaacaagcaaatgcttggaataaaaagaaagaattacattgaatcttttaaaagactcagttttccaacctgggctggctaagcagcagcctgaaggaactaagacagccctgcatgacctggccgctgcctgctattccaggattctctcctgcagcttctcgcctcgtttattctctagtaatgcagaatagcatgtggctctacccatgttctgacagactgaataaatactgaaagaatgctaaaaaaaaaaaaa

SEQ ID NO: 18735 - DNA, 146 bp, Homo sapiens
  misc_feature (1)...(146): n = A,T,C or G
ccggagaacaagcgagctaggtcctgtgtgcgatttttatttactttgtccgaaattcagcatgccagtggtaaactaatcaacttgtcactgggtacatggnaaagataaataaaaaatctgcaataccatgaaaaaaaaaaaaa

SEQ ID NO: 18736 - DNA, 216 bp, Homo sapiens
acagtgttccgagctgtctgcaaacgttagcaagtatttctctcctgctggtggaaaaaaagaagattgaagaacaggcaaaaactctgataggaaactatagtgcttatatgttacttgtcttatcaatattgacttttattggagattagattactttccagaagttttataaaatcacacaagttactttgggacttctgaaaaaaaaaaaaa

SEQ ID NO: 18737 - DNA, 212 bp, Homo sapiens
  misc_feature (1)...(212): n = A,T,C or G
tccagggattaactagggctctaaaattactgnacctatcatcactctgcananaagccacgtgatacactgagacattctgtttaccagaagtttccagtgagagaaactttttcagaagtctcctattgcaattgacaagtcttgttgttctataatgtcattgaatttgtaaactattaaagtaatgctctttttcaaaaaaaaaaaaa

SEQ ID NO: 18738 - DNA, 178 bp, Homo sapiens
  misc_feature (1)...(178): n = A,T,C or G
ttgagccgattgaaggaaatagtacaccttccaanaaaaacatcttcagggggaaaaaagacgcttgtccagcagtttgcttcttgtgattgaactgaacctgtaaggattcatggataaaatgaacaggaatagatctgaataaagcaaatctgcataaatggtaaaaaaaaaaaaa

SEQ ID NO: 18739 - DNA, 207 bp, Homo sapiens
actggtctgcgagtacctgcagaatttcctgtcaattcttggctgatcaaaaatcttcaaagtagaagcatttctaaccattgattatatatcttcagtcttccaaaatattattttccctctttacatttttggtatcctcctttgaaaaacagaatatgtactcacaaaaaataaaaacaaaaacacagaataaaaaaaaaaaaa

SEQ ID NO: 18740 - DNA, 271 bp, Homo sapiens
  misc_feature (1)...(271): n = A,T,C or G
ggtgtccaaagtggggcctcctctgtcactcagctggnaggcagcagcacaatctcagctcactgcagtgtctatttcctgggttcaatagattctcccacctcagcctcccaagttgctgggactacagtactggagactaaagaagtgtggcaaatgggatcaggtggaaagagcatcaagaaaccagttgcagtgagctgagatcgcgccattgcattcgcctgggtgacagaacaagactccgtcttaatttttaaaaaaaaaaaaa

SEQ ID NO: 18741 - DNA, 224 bp, Homo sapiens
  misc_feature (1)...(224): n = A,T,C or G
aagcccgttaaaccagcanatcacgtgcaggtcttctgctccaagccctcctttcaatgccacacanaacaatgaagatttgagggacgactcgtggtaagaactaaagccagagtctgtgatgcactcttcaaacaggactgaagagaatagataatatatctgtagccatttatgacctcaaggcacaatatctattttctgcaaacttaaaaaaaaaaaaa

SEQ ID NO: 18742 - DNA, 248 bp, Homo sapiens
  misc_feature (1)...(248): n = A,T,C or G
tccgttatacaatatgcctgtagtctatctactttgggcagtatacaaatgaagttcacctgtaagttatgaaggaggctaagaaatgttacataatacgtaatataatttctctacccatgannaaaatatatactctattaaaaacaggaattgcaagcacatgtgggaatgatatgttttttatgtcactggaaagtccacaaaatatcaaatacagctgtatttcaatgataaaaaaaaaaaaa

SEQ ID NO: 18743 - DNA, 1245 bp, Homo sapiens
  misc_feature (1)...(1245): n = A,T,C or G
cgggggcccccgnagnnggatntagnggtccaccccgcaccaagggggtttnttttctngngtngnganagatactccctactcttcgtaacgnctctggaggactaggaagagtgcccaatggnncgtnccccttgnncnctttgnncttncatnatnacnaacanacnatncncttnttnctttnatnncttnnctgnnaanaacatgnnaatggngaaagtgnnaaagnttgnactttncacacaccaggncnnccagctgttcttgtgattggagggacaaggggaaatactcgggccccatcaatggcctgtgtgnagtaattatattaaagaagacacgtncagggcaacacccctctctgtgaggcttaggnccttttatctggccagccaaggtggtgcaagaggagggagggacgcttgatacttctcaagggccacacttgnacctgggacaaaccctccttagttcgttttaattcccataagaaaaacctggactgtttgttgcgcccccatggcctaggaaaaacttacctttttataaaagaaaacaattagttggtgcaaccacggtctgggtaagaggtgattgaattaacaatagaaacaatgcttatgtagattcctcacatcaacaaaaaaaacaaataaaaatggggcctgcgttgcgcacctcagccgggtggaaagctctagcggggccgccttctcccttttattggagagggttagaattctatagataccttcgcgtagacctgtagctgcgcctgcgcgcgcttcggttacgttttccgtgctggcgcgggtagggactggatcacacctctactctctcaaagcgcgggggagcttaccggagttatctcctcacagatatgcaccgggcgattatcccgcgagggcagaaggacgcctagtgtgagcgatcatagaggccgagctaaaccagggcgcagaggaaacacccgcataaatacggcggccgccgggcgggccggggcagncactccttcaccactaagggacgcaccccggcaccctcggcgggacgggatgccccccgcctatnacnaactcccgtatggctctcccagaacacgctactggtgaggcggcggagagccgcgcgaccagcgcgccagtctagaagaatgagatataagagagcgtgatgccacgtcggagcgaggaacagncatctctatcgggcaggntcgctcaccgaaacactcgt

SEQ ID NO: 18744 - DNA, 169 bp, Homo sapiens
ccagtaaacctgtatgtgaatataatgaaaatggctacatcagcaacataaaagcaacctagattcctggattactgcttgggaaagaacctttaaatcaggaatgcccacgttggactttatgtgaatgagcaataaattacatcttgctaagctaaaaaaaaaaaaa

SEQ ID NO: 18745 - DNA, 210 bp, Homo sapiens
  misc_feature (1)...(210): n = A,T,C or G
gaaattcggacaatgtagggaaactcgnaaacagccactcggccccagaacaacccacaccgaagaaaacaaccanaagaattattcttcagcctgaaatgaagccgggatcaaatggttgcctgatcagtagcccatatttaaatatggaaaagtcaaattgagcattattaaataaagcttgtttaatatgtctcaaaaaaaaaaaaa

SEQ ID NO: 18746 - DNA, 184 bp, Homo sapiens
  misc_feature (1)...(184): n = A,T,C or G
gcgacacatccaattaccattttctgcctatgtgatatagnaaaaactaaggaagaagaagnattatgtgccttatactatgatgaagaaggacgcccacaccttacctaacatgtacattaacacctgcattggcaaaaacctaaaaaataaaatatttacttagcaaagaaaaaaaaaaaaa

SEQ ID NO: 18747 - DNA, 326 bp, Homo sapiens
  misc_feature (1)...(326): n = A,T,C or G
ccacggggataccgaggaataagtcgaagtggtctcttcttgtcatggagcacatgtggtcctggagaagctgtcacacggtggactcagnaatgtggtctacgggcactaatttcctctcagtccctgcctaagcaagattcattcttcctctgcctgctgtttcatttttttcttctattggctggtatatcttaagataaaaacttgtttccaaagggaaagtttcagaaatgtttctaaaaataataattcaaggtggatttccaagtagtattcctgggcaactgattaaattcttttgtcaataatcaaaaaaaaaaaaa

SEQ ID NO: 18748 - DNA, 256 bp, Homo sapiens
  misc_feature (1)...(256): n = A,T,C or G
cccgagcatgtcgagttcatgcgtttgaaaananaggcattctctgcctgcctgctgcttggacagtgaacttgactgttggccatctcagactgcaaatgagggcaatactatacgaggaccaaatgacaatgaaggaatcgggatccctggatgacttcatggaacaaagtcatcgtatctttcctggaatgccagcttccaaatggttacatgtgagagaaataaacgtcttccttgtttaaaaaaaaaaaaa

SEQ ID NO: 18749 - DNA, 410 bp, Homo sapiens
  misc_feature (1)...(410): n = A,T,C or G
ccgcgatcacccgaannaatgttacattatttgccgtggaatccaacacagtacatatctatcgaatggtaattgaaagaaaactggaaacatcacctgtatgaaaatagtggatggctctgttaacgaaacaggcatgctggtgacaacaggcaacaaatctaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaaaaaaaaaaaaa

SEQ ID NO: 18750 - DNA, 210 bp, Homo sapiens
cgcgggcactccgggagcagcactgggccatattggtgacaaggcagggtcagccactggaaaggaaagaggactcatctcaacttcagtcttcccttcgtcaacatttcaactacagtcacataaaagaaaaataaataatccttggtattcagctaaaatagattatcttataataattaaaatccttagaagccaaaaaaaaaaaaa

SEQ ID NO: 18751 - DNA, 148 bp, Homo sapiens
acgcgactttccgagccaagtgtcatacatgccgacactgtggctggggaagggagcgtgaagaagaaggcagtttcaagttcactcctggattgttgcgagcagcgtatatgactaataaaattcctcaatcttaaaaaaaaaaaaa

SEQ ID NO: 18752 - DNA, 1351 bp, Homo sapiens
  misc_feature (1)...(1351): n = A,T,C or G
cgctgcccccggtgctggccgccccccgtcccccccgaccccngganagnagtttttgtggtattttttggnnangggatngtttttccgagnannagacncngatctnnttnctttttnctnnctancnaganctcactcanactnnctgtaggaccaatgtgtctgctgcattgtgaggggagaaaancaatatcagttaactgnnaaaatacaaaagcaatgtgtgnagaaagaaggataaagtgtgtgcagtgagnagaagaagtctncttgnactcccctnnaattncagnctgtagggcttacacagnagaaagncagnagctccccttgtccttctnttttattgtgatagcagngaccccactctgagaccataccttcgacgtgtgatnggatngcacatcacttgagtgccatatgagttatatggcctttnagtaacccatgananatntntacgcttaacgccagaganataggtgatngcatatagtttcatcaacccacttgtctgggcgatgtgctntctgcttgttcaaattggagataacatatacgtgccaatactttctgaacacaagaaacaataagaaataataaacaataaaacaaacaaacaaaaaataaagaaaagaaaaaaaaaaatggcccctcgtttggccctcagcaggatggagagcttcttcgccggacaccgtctctgctccttatttgagatgggagagggntatacaatataatatagaagacccctccgacataccacttgaaccttcgccttgagcagctccggaaacatatatcggcttgacgagacaaagacgggtattaccaggctacatctccanagaggacgccgagaataacgcgctcttctctcaccctagagatcatggggtctatcaccccgccttagggtatataggtatacccatgctcgcgacagccaattagagcgctcccaatgtatgagaagtgcccccaccattaaaccccgttatacaaagaggtcccagacgaataacatgggactaataatattaccattaggcctacagacacaccccctagacccaacacaatccacagaaagagatgctaccatcgcaaccgcaaaggctggacaaataccctcgtcccagcacttataaaagaatagcctctgcgtcaacatcaccctaggataatttaaacataataaccacagatactctgaaaatccaacccatagatcgttatgacccaaaacaaccagagaaaatacctttactacccttataagtgagaatagaaggacatatatatccaaccacataaccacccaactcctctcacctctcccacc

SEQ ID NO: 18753 - DNA, 247 bp, Homo sapiens
  misc_feature (1)...(247): n = A,T,C or G
caggtccctttgtaatctcactgccgntatttcatcttgatagatttttgatctggctaatggttgcattttatcaggaggaagccttttcaactggatagtgtcaattattccctgaatatcctatacacggtaaccttatacaggatttaattgttgttgtttctcttcatttgagctaagtttttggaacggtcctcttataacaacaaacataaaattgtttttttacacaaaaaaaaaaaaa

SEQ ID NO: 18754 - DNA, 502 bp, Homo sapiens
  misc_feature (1)...(502): n = A,T,C or G
cggtgccgccccccccgggcccgcnngntngggattttcaaggggtctcccgagctgcacgccatcgagggcacatcatccaagcagcgaatggaacatcatcgaatttcatcgaaggagtcatcatcatatggaatcgagtggaagcattgagtgggctcaaaagaaatcatcgggatatggaattgaatggaatcatcacacgggactcgaatggaatcatcatcaagcggaatcaaatggaatcaccagccaatactaataattgatatagggagaatgttttgtttttcctagattcctcatgcagcttaataaggaccataataacttaactcttaaaacaaaggagatatttcaggcccaaagggaagcacggctggcgcctcctctgacattcacaaaataagggcgttggtgtaagttctgcatgaagctaaacttggtcaaagtttataagttcaaaagtaaataaaaggactatcttttaaaaaaaaaaaaa

SEQ ID NO: 18755 - DNA, 819 bp, Homo sapiens
  misc_feature (1)...(819): n = A,T,C or G
cagtgccctggcagtaggtctggcttcgccccctggcaggatcgtcttctcagcttacagtancctagtgtgattcaacaaccctcctctctgcccccacatgcccaactgatctggtggagggaactgaagatgaggcctctcaggcaccatggatgggatgggtgtgtgtgaaggttttcccttcccacccccccacccccccctccccctcctcctcctttttctccctctcattctttatctataacattactctccttttcctttttttctttagtttgacccgtctccaccataccccccctctcccccccccccccccccccctccccccctcctccctccttcctccctccctccttcttccctttatttcctaccgctctcctctaattattccactgcctattaacataaccctcacttattaatcctcttcgccttgctcctctatcctccctttcttcactccccccctctctccctcttttctccctctcttctcttcactccactccctagttagcactgtcagccatctcccccctcctcttcttgtttagtctctgatcagcttccctttctcacgccattccttcgggtcccttcctttcttcctttccctttccgtcctttttccatctctttcccctgcacctcacctcctaactactcagaccccatccttctagcccacgtcactatttccctgtgatatccatccccctctctcctctcctcccctccatctctttcctctactatctcttcttcttacaaccacccaccctaactataccctccttctccctctat

SEQ ID NO: 18756 - DNA, 394 bp, Homo sapiens
cggcgaggagactgcaactctggaacacagtgtaaaaacttgcaacagaacgacagtaaactttgtgaaatctgcattctgcgtgctattgaagcatggttcttttcaaactcatggcaaattacctcagaattaaactctataattaagggaagaaaccctcattctccctgtaataactgaatacctaagcacattaaaaggcctaaataatctggtgttttcccataagcattctgtaaagtttttcttaagctatgcggcagttataccctttgcttcctttaaaacaatatgaatgagcattttaaagagataaatggaatttataagctatcaacttctcgtcattaaaaaatagttaaagctgatttaaaaaagaaaaaaaaaaaaa

SEQ ID NO: 18757 - DNA, 439 bp, Homo sapiens
cgggtttcagcatttctgcaaggtgattgatcacactcctctgttttatccagcaaatggttctatcaacttgcaaatgattatgtcaaaaaagtggaatctgttcatctatgaaagcacaagatcgttttaagactctcagtcgtacagaggataacagaagggaaaataaagatactctgcaaattcttagcaaaacctatctataagtaaaactgaaatgactacaaagagttattatgaaacagaaaaaccacatcatcttcctctggaaaacattgctctcattgtcaatttgctttacattttaatgtgtaaatttgttcttgggatttcacctgaaagactcaaccatttggcattctgtgtaagacgtaaatgttattagaaacatgcgacaacatttattaaaatatatacggaaacaaaaaaaaaaaaa

SEQ ID NO: 18758 - DNA, 145 bp, Homo sapiens
  misc_feature (1)...(145): n = A,T,C or G
cgcgacagcggagcagtggtcattcatgcctacactgtggctgggngagggagcgtgaagagaaaagcagtttcaagttcactcctggattgctgtgagcagcgtatatgactaataaaattcctcaatcttaaaaaaaaaaaaa

SEQ ID NO: 18759 - DNA, 276 bp, Homo sapiens
  misc_feature (1)...(276): n = A,T,C or G
cacaggcccccgagtcccaacannaaaaaaagactccctcctacctcatttctcctttcggaggctagcaggaaattaaaaaaggaaaggagtttcatgcagtatttcttacagcaaatttctcagaatccagagatacttcttttctctgtaataagttgctgcagatacaaaggaacacttatgattgatgactatctctgtttgcatgagcaataattcctgaacacacagttcttgattaaaatacaaatgcattttccaaaaaaaaaaaaa

SEQ ID NO: 18760 - DNA, 301 bp, Homo sapiens
ccgggcggcccattagcacttgccttgggtgaaagtcacacatatggaagtgcttactgaattatcacacttcttaagattaaacttttaaggaactgaccttctgcaaatcctttaccaaagcttggaacttcagtccatcacattacagcattgttacagcttcaattaaattgtgtaaatcattttgatgcacgtacattttaaaattatatattttaattattcaagaatggttaacttccccttaaaccttacttttaaaaataataattaaatacacaatacaaaaaaaaaaaaa

SEQ ID NO: 18761 - DNA, 912 bp, Homo sapiens
  misc_feature (1)...(912): n = A,T,C or G
ttgggtcttttnnccgggagggtacgattttgnctacgcttccctggntgcggcagnccacacaactctctgnnacaatggctctcatttttttgagaagcagagcgttactggaacctcagaagcatgtctgagaagagaaaagttgtcatggaaagagctctgacccctcattcagctgaggctaccagagaagcagagtccctgcctctttttttatcaggcccttacccactcacttatttgtcgttttccggagcgcggtggcttgtgcgtgcctttcctcccttttgtctgactcttccccccttcggcgttgcgtggtgtcctgactccctctcatcctttcctctttccgcccgcgcctcgctcatcgcccttttgggccctccgcgccgcggctgtcgccgccggctgccgcttccccgcggcgggcggtcgtgctcctcggtcgctcgccggcgtccgcttgctcccgccgctcccgcctgcggtccccccggccccgcccccgcgcccgcggccgttgcgcgcccccgcgcctcctcccctccccgcggcccacttgcccgccccccgcgcccccgccccgcccgcccgtnctttgggcccggccgccgccccgcccccgcctcgcgcgccccccgcggccgcgccgctgcgtcgccgctcccgccgcccgcgccgccgccctggccgccgcgcgcgcgcggcccccgcggcctgccctccccaccccggctctgcccccccccgtcgggccgcgcgctcccgacgcgtcgtcgagctcgcgcgccgccgcctgcgctcccgccgcctccgtccgtcgcccgccaggtacgcgccctccggcgtcttagcggcccggcgcgtcccttgcggtcccgaacgccgtgaacaacagacacccta

SEQ ID NO: 18762 - DNA, 227 bp, Homo sapiens
  misc_feature (1)...(227): n = A,T,C or G
cagagttaaaaattccantnaggncagncaattccagtnccaacaaataagnatctattactgagcatcaactatggtgaaactgtgcttggtggaagttcaagaatgaatatatcaaaagtcacgtgcctgcaggcaagtcacaaccaacaacggagataaactgttaaactgaaaatgatccttgtatgaatcaaagatgctggtacacttgaaaaaaaaaaaaa

SEQ ID NO: 18763 - DNA, 141 bp, Homo sapiens
agcgaaatatccgaaaattgttgcagttgaaatacctagaatttgtcactgacttgtgttcctgaactatgacacatggaaatgtgggctaagaaaagttcctcttgataaataaacaattaacaaataaaaaaaaaaaaa

SEQ ID NO: 18764 - DNA, 205 bp, Homo sapiens
  misc_feature (1)...(205): n = A,T,C or G
cacttcgcccaagacaagtctcttccctctggcagcanaaaagcggattttctgctcaacctgctttgatcaccaaatgagtcaggagagaagaacatggatggaaatatcctcagtcaagaacttcacaagcaccagttgctttaaccaggggctctagaaattttctagaataaatgcttctcaatttgtaaaaaaaaaaaaa

SEQ ID NO: 18765 - DNA, 554 bp, Homo sapiens
  misc_feature (1)...(554): n = A,T,C or G
tccgccgaggtagcacagnaacaactggnatgtctggagcagccccttgcaggccgctgagaaagacagctgcagactatcttgagctaaaatcacaatgttagctccaccaagcagatgacagctgtgaaaaccagccaaaataaactgagcaaagccttcgaatgactgagacaagcagacttctcggctgtgtgaacattgtacactctgtgattggttgtagattgctgagatgatgaagctgcagagaagttgacattctacaggatgctattccatcagtggagagcacggagagaaaagatttagaaatgcctttaaatccaaacttatgagaagtcttccatgtggaggcaattacaaggattaaaacaaaatcacaatgtttatctccaggcagacacaagcctttcaaaaacaaaatagaaaaaagaaggggtgcggaaccaagagaaattttatctcatgttctgaagtggcaaaaacagagatgttttccccccaattatccagaataaaaatgtttggtcctccaaccaaaaaaaaaaaaa

SEQ ID NO: 18766 - DNA, 910 bp, Homo sapiens
  misc_feature (1)...(910): n = A,T,C or G
cagtggctacnttacaatggtaatcagtctgctagnaatctctatnatctccattacttactgaccacgcatttagaagatgacgcttttggggcttttgtttgaattttctctctctgatttttatgaagccaataaagcataggcttaaagctgacccatgtgctgcacaccagatgtgggtgacaagaaggtattactatggaaacttgaacactacaaaatgacacgccacacaccgccgaatgtaactgattgatctagcatatcttaaccaataccatgaaaagcacactctccctgccacgccacggctcacgccacaataaccaccaccacccacccaccaccacctaccaactcgccacccctccactccaccaccaccaagtagcatggactcgctccaccacggctcccacaccacagtaaactaaaagcggagtaagtcgttcagccacgaacagcgccgcaacaccagcggagcataccacaaccactccggcccctcgtntcccgactccagcgccagtcaacatatcccaaagtagaaactaacataagcatacccagcagtcctcaatcacggagtgcgcgcaccggatattatgtacagaatctcaacacaacacccaacatcaccccgcggacaaccctggcactaagacgcagcagcagagggcagaacaaatagcagccccctatatacaaaatgaacctacccagtcgccgatctcgggaaaaatcagattggttgccacggagtcgctctaggagaacaagcgtccgcagccgtattctacgataggtacgaccatcacggcacacgtcataataccagctcggttcgcatgatagtgccgcgatgcaacacgcggctcttgacatagcgcaacgtaagcagcgaact

SEQ ID NO: 18767 - DNA, 851 bp, Homo sapiens
  misc_feature (1)...(851): n = A,T,C or G
catgatttcttcagttgaatacctanaatttgtcactgacttgtgttcctgaactatgacacatgaatatgtgggctaagaaaagttcctcttgataataaacaattaaccataaaaaaaaaaaataaaaaattaataaaaataaaaggacatcttggactcagagggggagatctggcggacgcctttcctttaatgaggggtacaaaaagattcctcgtgacagactctcttaactcggaaattaccttacagccactcggtattataacacctaccaagacagtaaatacaatatgacagcataaatataagtattaccgtaggagaaatacaccttcacaactacgcacactatggcccctgttataggtcttacacggtttttgtaacaagcgttgtaagaataccacatcaatataagacacgccatatagaaaaatattaaatccgaacaaccaggaggactagataaataagcaaagattcggagttaattgccgcaccgtcacccaccttaatcacaacacagacataaaatcacagcctatcgagctatataaggcgctacactactatgcgagaagtgtagcaagtatcgcgcgcgaatcagaaacgcgagaaatatactcaaccctagacaacatgcgctcccatccatcgataatttcaacacaaacacgaaaatagtcaccgatgtgtgaatgctgttaatgctattagctctagccttgcttatatttaatacacgcatttaatatgagagacagttacccgaaggcgaggaccataaggtagatacatatgcagataagaatattgagagaatgtagagaatatgatctgactat

SEQ ID NO: 18768 - DNA, 256 bp, Homo sapiens
  misc_feature (1)...(256): n = A,T,C or G
ccgggaaaagccggccagcggccacctgtctccagctgtctgggnctgtctgctggnagcagtgacatcacagtgaccagcaaccacctcccctttgtctggagcagttatgatgtcattccctctggcagcgaagcaggatgttggcagctgggattcctccgggtcctcctgaagtgataattgccttagattttgttataaagtgcagctgctaattatcttgttaaatcacagccatataaaaaaaaaaaaa

SEQ ID NO: 18769 - DNA, 408 bp, Homo sapiens
  misc_feature (1)...(408): n = A,T,C or G
cagtgtgcctatgtgaggaatttgttncatgcgtgctactggggcctgttatgtcattttcagttttgcctctgctctctgcctggaatgctccataattgcttttcagtggcttgggactcagagatgctatagaagatcagtcagcagagactgcccctaccccaagacaatcagtggtcagcaaatcagcagcagcacctggtgccctacatagaccttccggttccaatgacagctgcttcacttctgccttcctccttccaaatctcccactaatttatcttgtggctgacccttacccagaaccacagagaaggggaaattataaaaaagcttagctaagttgatgcaataaaatagctataatattattaaataaatattcaaaccctaaaaaaaaaaaaa

SEQ ID NO: 18770 - DNA, 211 bp, Homo sapiens
acaacaacagaaaccagtctcccacaaaagttgcaagcacacagctcaggaatggacagactggcaggcaagacacagcaagaaggcagcagtctgcacaccgggaggagagtcctcaccacaacccagccctgccacaccctgatcctggactttcagcctccagagctgtgagaaataaatgcctgttgtttcagcaaaaaaaaaaaaa

SEQ ID NO: 18771 - DNA, 314 bp, Homo sapiens
acaggtcttccgattaccttgtgagcatattgttactgcgtgctactgggtcctgttatgccattttcagttttgcccctgctctctgcctggaatgttccataattgcttttcaggttcagcattcctggtggaagcaatctgggcctggttaaaggaagtggctgttccaaaagtagaagggcagacaaagccaaatctgggtgagagatgaagaaggaactccagagcaagccacaaacgactttagcttcaaatagaatcaaaagccaattaaagaatcatgctacatttataaagtaaaaaaaaaaaaa

SEQ ID NO: 18772 - DNA, 274 bp, Homo sapiens
  misc_feature (1)...(274): n = A,T,C or G
ccggctaacaagcctgcttgttcctgttcaccccanactctgggatgccagtggatacaatgtatagctcactgcagcctcaaaccctggtctcaagcaatcctctcacctcagcctcccaaaaaaaaaagccttatgaagacattgcaaaaggacaactatcctgcaaaaccagggaaaacagacctcaccagaaatcaaccctgctggtggtaccttgatcttagacttccagcctccaggaagtatgagaaaataaatatctgtaatttaa

SEQ ID NO: 18773 - DNA, 225 bp, Homo sapiens
ctctagcgaggacttccattactatgttgaataaaactgttccccttgctgctgccatgtgaagaaggacatgtttgcttccccttctgccatcattgttattcatgttaggctcctgaaaacaccacaaggacctaccctccgggagccagccagagaacccttcttcctgcactgtctccgttatgcccaacatttctgggcataagttttaataaacctcga

SEQ ID NO: 18774 - DNA, 587 bp, Homo sapiens
tttttttttttttaaaaccttgatgaaattttattccacatattgccacacttgtttggttgagtcaaattcaatattatttgggaatgtcaggaggaacttggcatccaatgctgcaaatacttctggtcgacaatacgtatttaaacaactgagtcaacagagccggcatctgcgcatctttttaccaacaagggacccaaaagtctgcattccaggcattgaagttagcaaagaccaatgtagcaagtcctataatacccatgatgtgtttgatgagcttcccaatgcagaatggcagcagcagtagctttttccttaaggcaacttatatgctgttctatgtgcttttcctggttgagtgacttactcatgagttacttctggtactttttgagagtagttccaagtggatggcagtcctcataatcgtggaagaaggtgagaggcacgccttactcatgttccctcctccaaattcagacacaatgtggagagatatactgtctgtactgccatgttttacaacaagttctgcatgctggattttgattctgacttctattttcttgggccataagttgaaa

SEQ ID NO: 18775 - DNA, 820 bp, Homo sapiens
cttggcgatcttggtttatttactttatcttgttaacaactgcaatgataacactgcgggttagggagcaactttcatgtttagtctcaaacgttttctcaagagtcggtgccggggcctcccagcattgcagtgagctcgggacattcttagctgcttcaaacaagaagatatagcctgtttaacttgccaggattcatgtaacagaggcctggtcccatctgggcatgtacaagacttgcttcatttacctggaaattgcaggtatctcttcctcataatgaggtttctgaaatattccttgtttttcagagactcaagctattagccaagtaggagctagcaatagctcttaaccaatggcaaaagggtcagatatttcctgtgctgtttttactgtttatagcagggctgacacaatttgctgtgggaagaaagacttgaacttgtcttatagattttctctccttgtgtgtgacttaacaggacactgacattgggtcctccctggaggtcatcttgaaccgaatatgcgcccctaactttctttccaaccggcacaacgggacaatttcttggctatatcttgtttgcttttcagcaacggaaagccaaaagccatcccagcacaagaataacttgggatgccttttggttctttgggcaccggtattttccctttgcctttcctatttggtgagaagggtgtagagaaaacaatgaaagggatatcctccacatttgtagggtttttaacaaccagcctattcctggaaataattttttatacttcgggaaatttcaagaaatattacgggat

SEQ ID NO: 18776 - DNA, 810 bp, Homo sapiens
ctcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcattacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacgaagaaacttactgaaagtgcagaaattagaatcaataatctaaagagtgagctgagtcgacagaaacttcatacccaagagctgctttctcagctggaaatggcaaatgaaaaggtagctgagaatgaaaagctaattctagagcatcaagaaaaagccatcagactttaaaggcgtctaagtcaggcaaaagagagagctgcttcagctttccagcagctcagtgtgattaccgtgccaaaaaaaaaagccgcctccctgatgaatctgggaaatatttagaaatattcttagttcactcacagaactttagagttgggaaagcagttggactaaaagtgtattgaaatggtaaagcctgcaaaggataatagttaaggcttgtgtaatttcgcgtaagcattgttggtcttgtttgaaggttattggaaaacagaccatgacacttcctggaagaaaaaaat

SEQ ID NO: 18777 - DNA, 541 bp, Homo sapiens
agctattgtggaggcagctatgtggagagacacatgtggcacaagatcaagggctgtcaacaaccacatgagtgagcttggaaacagactcccaagttgagcattcagatgagaccacagcccctgctgacagtttgactgcaacctttgagagtccttagccagaggcacccagttaagctgcactaaaatttttgaaccacacagattgtgagataataaatatttgtggttttatgttgtgaggttttggggtatattgccatgtggcaataaatagttaatacattatgtaggtgagaatcctattgtctgatacagtaatatgaagtattgattttcctggtgtgatgtggccattttcaaaaccaatatgtataatgtacacaccctgttgctttaccttcgtcttcaattttcagttcttgcttactcctctttccctgaccttgcacacaaaaaatcatccccactatttttgggattgatctactggcttaaaaaaaataaagctgtacttatcagatgaaaaaaaaaaaaa

SEQ ID NO: 18778 - DNA, 797 bp, Homo sapiens
aaactttttgggaaagttccccaaaactttggggaactgtgttcccctgaagtttggagggtgaggagtgaaagaggttgagaagaatgagctggctggatggagtcttgttctgtcaccaggctggagtgcagtggtgcgatctcagctcactacaacctccacctcctgggttcaagtgaatcccctgcctcagcctccctagtagctgggactacaggcacacaccaccacacctggctaattttttgtattttttagtagagacggggtttcaccatgttggccaggatggtctcaatctcttgacctcatgatctgcccaccccaccctcccaaagttctgggattacaggcctgagccactgcacctggctgctagttcttaagagggaggtatgagacgtatgtatagactaagtgaaaggaaaatatcttgggcccccaaaatcactaagctaaaaggaaaattcaagctggaaactgctcagagcaaacctgcttcccattctattcaaagtcatccctctgctcactgaggtaaatgcatattctgattggctcctttgtaaaagctaattagaaactcaaaagaatgcaactatttgtctctcacctacttgagacctggaagacccctccctgcttcaagttcttccccacctttttggacaaaaccagggtacttcttactgaattgattaatggcttgagcctccctaaagtgataaaaccaagttgtgccctggacacctggcacaggtctcaagacttcctgaagcttggtctgggcatgc

SEQ ID NO: 18779 - DNA, 879 bp, Homo sapiens
aaactttttgggaaagttccccaaaactttggggaactgtgttcccctgaagtttggagggtgaggagtgaaagaggttgagaagaatgagctggctgggttggacattcagaggtgacaatggccagatcaaccttgatggagtcttgttctgtcaccaggctggagtgcagtggtgcgatctcagctcactacaacctccacctcctgggttcaagtgaatcccctgcctcagcctccctagtagctgggactacaggcacacaccaccacacctggctaattttttgtattttttagtagagacggggtttcaccatgttggccaggatggtctcaatctcttgacctcatgatctgcccaccccaccctcccaaagttctgggattacaggcctgagccactgcacctggctgctagttcttaagagggaggtatgagacgtatgtatagactaagtgaaaggaaaatatcttgggcccccaaaatcactaagctaaaaggaaaattcaagctggaaactgctcagagcaaacctgcttcccattctattcaaagtcatccctctgctcactgaggtaaatgcatattctgattggctcctttgtaaaagctaattagaaactcaaaagaatgcaactatttgtctctcacctacttgtgacctggaagacccctccctgcttcaagttctccccacctttttggacaaaaccagtgtacttcttactgtattgattaatgtcttgtgtctccctaaagtgtataaaaccaagttgtgccctgaccaccttgggcacaggtcatcaggacttcctgaggctgtgtcatgggcatgcgtcctcacccttggcaaaataaaccacgagtcggccgaa

SEQ ID NO: 18780 - DNA, 277 bp, Homo sapiens
cgggacgagatggatgcaccctctgccgcagccacctcttctgcaggtgcccggcttctccagacttgctattttggaggggcaggtcagtgggaacgaccgactgccttgcatctcagccactcgtgggcctcagagtgtgggcaggggcagctgcagccctctcgagcctctcactccctgcttggcctctgtaagcctgtccgggagcagctcacagagcccctgtggtggagatgagtcacttgttctaaaaataaaagaggatcggcctgag

SEQ ID NO: 18781 - DNA, 337 bp, Homo sapiens
tgaggccaacgaggccatgtttttattttaaaaaaatacatataagctgggtgtggtggctcacacctgtaatctcagtgctttgggaggccaaagtgggaggatccctcgaggcaagaagtttgagatcaacctggggtaacataggaagatcttgtcttacaaaaaattagaaaattagctgggcatggtagggtgcacctttagtcccagctcgtcgggaggctgaggtggaatgatcacttttgaccccaggagttcgaggtaacagttagctttgattgtaccactgcactccagcctgggcaacagaacaagaccccatctctggatcgtg

SEQ ID NO: 18782 - DNA, 500 bp, Homo sapiens
ctttttatacaattattcccaaatcttctaaactgacagtgagggagagtaatttgaaaggactgctcaactcaacgtcatttgaagatttgcaccacagctgcatttttccaatttcctggcatctattctgctctcctggacttttcaaaaacaatttctttcagatccctggaggcctctcccagggcctgtggtgtggagagttggacttgaccctactgtaagagacccaacttccaaagactgcatcagatgaaaggctctccatatagactacagacttgtcagctggttaaggaggcaaacagaacagtctgctacaaactccagtccatgtatctgtgctgaaaataaaaggagtcttcaggaatcaaagaagaaaatatttttataaagaaattttattgcataattcttgtatacaataaacataggaaaagggtttttaatgaaaattcatgtcatttttcaaaaaaaaaagaaaaaaaaaaaaaaaa

SEQ ID NO: 18783 - DNA, 519 bp, Homo sapiens
tttttttttttttttttttgaaaaattgaaaagtgtaggaccttactttattcccaaagctgatgaagtaaacaaattcaattgtgtagttataatcataagggtgattaaggaatttactttcttctttccttcagaaattatcccctctgtgtagagacaatgtatgattctgtacctgttccctgtccttaattagatccatgagatctttgacaatgtgtactttgagtccttctttgggaaacatcgatagatgataaataaattttaaactgtaaaatgtccaaaagcagaaagtccaaaggatggtctaagagtatcaatggaatcagttattatatttattcatccacttacaattgtttttgaaaagtccaggagagcagaatagatgccaggaaattggaaaaatgcagctgtggtgcaaatcttcaaatgacgttgagttgagcagtcctttcaaattactctccctcactgtcagtttagaagatttgggaataattgtataaagct

SEQ ID NO: 18784 - DNA, 397 bp, Homo sapiens
aattggttccttctggtgggttcttggtctcgctgacttcaagaatgaagccgcagaacctcacggccttcctgactaccaacagccagcacttgtgactctttgtaaagagtttactcttatagaagaaaaatgcaccaacaatgtgaatgaaaagccagaaattctaggaaatagaggtctttctccatcagcacaactaatgaatgacataaactggtgtataattcattacttctccaggagaatgattctgagatgtatggtctgctttacctcccaaatataacttccttgataatatgctttttgctaaatttttcccttcttaccttaattcctcactttcttatcattattttcctgaataaactactagcacttaaaaaaaaaaaaa

SEQ ID NO: 18785 - DNA, 1176 bp, Homo sapiens
  misc_feature (1)...(1176): n = A,T,C or G
cttggctcaaaacattccagcagtgtcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactntgttttggtcctaggcattangtaatataactgataatatactgaaacatataatggaagatgcagatgataaaactaattttgaactttttaattatataaat

SEQ ID NO: 18786 - DNA, 411 bp, Homo sapiens
tgtgttgctctgttacccaggctggagtgcagtggcaagataacagctcactgcggcctcagttttctgggctcaagcggatcctcctgctttagactccaaagtagctgggactacaggataaggccgccaggacttcactttgtgctactgcaagtgcatcaaaaccaatattgtgtctttggcattcgaatccatgaacttctggaagagaaaccaaaaagccatgtcaggtatggctggagcctgcattttcatttgggagcagaagcatgtcacatagtcttctaaaaagagaaattttgctttaaaaatgacacaacaaaataaaatgctgactgagtcatggtaaaaagcagtctttgaatttgaataaagtgtagcagtgctgcaaaggcaaaaaaaaaaaaa

SEQ ID NO: 18787 - DNA, 938 bp, Homo sapiens
gcccagctcagaaatcagcgctgatcaaataaagcacacattccctttggcactaaatttgactcggcagcgtctgtacagggatcctggcaaaaccagaacattcagcctttagaatcactggggattggctcaccgctgtgtggaagcacaactgttatttctgaatgccatccacgtggctcagccactgagatgaagcaccattcagaagaagcaaatgtgtgctctatgtttcacccagtctgatttcgccaagatcacacagataggttctacaaagaaagcactattgccattatcatcgaaatacaaatctacttttggaagacaagtgccttataaatacaccaattgaaaaacaagcaaagtgaatttaagctacggtctcactctgtcatctagactggagtgcaatggctccatcacagctcactgcagcctcgacctcctgggatcaagttaatcgtcctgcctcagcctccttgagtagctgggacctcaggcatgtgccaacacactcagctaatttttgtatgattttagacgtggggtctccctatgttgcccaggctagtctcaaacatctagtttcaagcaatcctcctgcctcagcctcccaaagtgctgggattatgggcaagagacactgcacctggcccttgtctgttttatatagtgggtttctacacaagattgtgtgtaaatgtgttttatagcaaaaaaaatagtttgacaattagtaacattgacccagctgctaattgacagtgaatatttcacttcagtgactctacttgtttgttgacaaagctactactgagcaggggcagtgatattgtcaagtcctgtttgtgtgtgtgtgtgtgtgtgtgtgtgtacaaatatttttaaatgcttaccaatggttcaataatgaataaagcctgatcggccag

SEQ ID NO: 18788 - DNA, 721 bp, Homo sapiens
tacaaaagcaagcagagaaaaattttacagatgaaggagaccagctatttaagatgggcatcaaggttctccagcagtctaaaagccaaaaacaaaaagaagagattctaatgcctacctggatgtttctctgtctgaggtccttcttgcctggactactctgctccagcttctgcccaagagcagcttattttagcctcagcatggatgggctgtacataaagagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgtgagttttgaaggaaaatgaaaccttaaatagctccatcctgaaataactatagacagcatgtgaaaggagttgagcaatagtattccagctctgctgcatgaacccagtctagggaggttaccataatgcactgaaacagtggtgtcagggcaggagtacagcagaagcctccgaacccccaacagctaaattttatataaaatgtattcacctatatgaagaaatatgaaactgtctattatcttagggtgacatgtttgcatgatttttacttttcaaatattttataagctaaatgtaattcctttcatttaataatgccgatcgcaag

SEQ ID NO: 18789 - DNA, 779 bp, Homo sapiens
atattctcttacaaggaaactcttcattttgaaaatattttccaattgacacttcttttgcaagcatgagttacacctcaaaagaaatatgaattcatcaatgaaagaaactctacgttaccaaactttttttccatttcttaactagagtctggcataaattatgccctcaataaatatttgctaaatatttatttgtataaaatcttaaaataagttaaataaaagcatattcagaggatgtgttgtttctggttatgaattgagaaataatttttgtctatttatgtattattactctgcaataatcaagcataaaaaaggatattgcgtttcactttttagtactttatgtatataaactaatttatactctcattgtttaataagtacttgcaattttctaaatgtattacttatgtgctttaaataacattaatttcaatgtagagggaatttgcttgcctataatgcatttttcccaatatagaatgaaatgtattttgtcacaaggaaaatatgtggtttgaggctgacaatcatacagagtgcaaatgtatttgtggtggatcatgacatataagctttacacactggttatttcacgaaaatcgggagtcaggcaaatactttagaccataactttatgaagaagcaaatattatatgacttttgtttgcctttgaactgaaatactaacctgtaatactttctaccaaagagatatgaagcgcaagactaattgatgcgggcgattagagacagtttatgaggccatt

SEQ ID NO: 18790 - DNA, 674 bp, Homo sapiens
tcgtctggaaactactctctaatcctccaccgctacactttttggggttacatgattgatttacatcattacaattgatggacaaccttacactctacatctcggaaaacaatcattcttaccccagaaataatgaaactggatctttgcattctgtgtctccatattttatgatgcattgccattaccaaggatattttgtcgaatttcctcagtatatgttctggtctcaggggatttctccagtttgaaaatatcagttatggaattgaaccagtagaatcttcagcaagatttatgaaaaataatgatccaaatgtatccattttagcagtaaattacagtcatatttggcagaaagaccagccctacaaagttcctttaaacttctgatgttatgacatactaggacattggcctgtgtgggttgttgtgaatcatgaaaggaatctacttagctggtgaggaggaattttagatttttaaaacctgacgccggcgttagctttgatggggggaagtgatgaccctggctacttactcaattcactcgggagaaaggctgaggaaaacagatacaggtgccccaaatgaggggaaacgccgcaaaaaaactgagcgcataggccggtattctctaaccagagagagagaaagaggttaggtgatccaag

SEQ ID NO: 18791 - DNA, 628 bp, Homo sapiens
acgccgctctggttttattaaaagctctgatgtcttccaatgaaaaaagtggtaataagtcttaatgaatatggctattctatttcccgatttcttcaggaatgctctttttctgctttctactctgttctctaaaattctatcctgtagtgccataatactcaacaagtaatctactttgagattgaactttatcaaaaacttcagaaaatccttagttttgttaatgtatttgaaaaataatttatattattacaattttatcattctactgttaaaactttccacttctttaaactgaaaaacactggtactctctgcttgttagcaaggaatggttgagtgatgttgcagttctttttctactctaagtgttttgcctttggttgtatctgctttttcaccaattgaataaaaataggtacaccagagtatctcttccataactaaccctatttctcaggttgcattgagaaagtgttcaattttaacaattttattattaatatttatcttcatagaacactgtattcattgtgtccaacttctcggatttcatgatttatgggttctctgcaccactcattctttcattcaatatatccaggggtgtgaagaatctcgcaaa

SEQ ID NO: 18792 - DNA, 803 bp, Homo sapiens
ttttggggagcaggtggtatttggttacatgaatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactagaacattgcctgtgtagttttcttgtaaatcatgaaaggaatttagttagctgttgagtaggaatattaaattttatgtatttttctacctttaaataaaacattgaaacttcatctaaaatatttggaaagttacatatttcaagcttaatattttatgatgtattatgtaacattaatttttatatttttttcaaacaaaatgatactatttgaaaaagtttagaaatgcagaaagaacagagtcacttgttattctagtaccttggtaaattacgtttaatattttggtatatattctaactactacttgaacatatctttctaaaatgccagccatttgcatg

SEQ ID NO: 18793 - DNA, 515 bp, Homo sapiens
aacagtcgcaaatggaatttcaagaaacattctatatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtgggcagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacgga

SEQ ID NO: 18794 - DNA, 651 bp, Homo sapiens
ccctaaaggaatcgttgttgagaaagtgcgtaggagggaggaaccagaaaagtggcctcttcccccaatagtggattattcacagactgatttgccctgaatttgttccccgtcagcactaccaaaaggagacagagtcggcacctggctctcctcgtgctttcaccccagtgccagggacaaggaagatgactagttacggagggtgagggttgttttttgccaaaaagcctgggtagagtgatctgaattatctggcacagagtacctcctgtgtggaagggtccctggattttccctaacacccaccctctcccccttaagccatgctgatggcagagaagataaaaacttagaggaaacttgccatctggctttgcggaaaagagtccaccttacgcctcgaagacattttctttactatgggctaggatatcataattaaaggggaatgagcttggattataacactaatattattggagagtgtcttgctttcaggctagaagggatgcattgattattctagggccgcctttagaccttagaatggagggcaagaaaagagaaaaaagaaccgtaggcggagggttgatttgaggaggagtaggggtaacgctggggacttgccaagggagcggcgcagagggg

SEQ ID NO: 18795 - DNA, 325 bp, Homo sapiens
attaaaaggagcccaagccccatctcatcctagcacaccctcctccactgtcctggcagtagcagtccctgcactaggtcagacaatcccctttggggtacaggaaacaaagcaggaggagtttgaggtccctacactgcagcagaagaagaggaaggagtggggcctgaattgaccataaaggatgtaggggccacgttgttccactgtaatgtcaaggagggggtggccattgtttgtcccagcctggggctccccctctggtttcctatttgtagttactagaatgaaaaaaaaacatgatagataaataaataaatccaga

SEQ ID NO: 18796 - DNA, 501 bp, Homo sapiens
ttttttttttttttttgagacagagtcttgggagtgcagtggcacaatctcggctcactgcaacctccacttcccaggctcaagcaattctcctgcctcagcctcctgagtagcgccaccatgcccggctaatttttgtatttttagtagagacagggtttcaccatgttggccaggctggtctccaactcctgatctcaggtacccaaagtgctgggattacaggcgtgagctaccgtgcccagctagtttggtattttattaaacaaatgatatgtcctctactttttgcctctatgttcatatagcctaatgtcatcaagggtcatctatgttgagacaatgtgccaagtattcttcccttataaggctgactaatattctactgggtatatcccgggcgttgttgcccctgggcttgcttcttctttagattcagtaaataatgtggaaaaaacatagtgaacaattttgcttccaaccctgttgtaatggtgttgg

SEQ ID NO: 18797 - DNA, 135 bp, Homo sapiens
  misc_feature (1)...(135): n = A,T,C or G
gcccggagccgcccccccctggccccggacgcgctttgggtctcttggnnnngnngggtcnngtggngtcaccggcgccattttcctggngagtncgnaggtnatcgntnaagctcattatggccatagtaggcc

SEQ ID NO: 18798 - DNA, 582 bp, Homo sapiens
  misc_feature (1)...(582): n = A,T,C or G
caggatatgaccggttactcagcaaaggacctcatttggtattgtgaagcctacctgagaccacctgtatttgatgattatgtaaacatactacttttctgaagaaccacaggtggtcaacacttgagattttgcaaaacatcgtaaatgggaaatgaagtctctaaagaacttaacaattcaagcaggcgtgtccattcattcattattcattcatttatctaactctatctgggggtcaactatgtatcaaacccaagaatagtaatagtaagacccattctctgcctccaagaagcacagtctcacatggggagacagagccacaactaacaattacactccgtggaataacagctgcagtgggagaatgcanagaagcccacagaagtacaaggtgaatgacagaggaagggcgaatcatttaggcagggtaggagaaagaagagagttgagtccctgaggaggacatcccagacagagggaaacagccttgcaaaggaggcagacacattcaaggtcagggtggggaatgaaagatgcgtggagatgcngcaagggataagggtgaaaaggtggacg

SEQ ID NO: 18799 - DNA, 828 bp, Homo sapiens
  misc_feature (1)...(828): n = A,T,C or G
cctcaccgctctgccagggaggacatttttttttttttttgcttttcaagaatattctctaagaagtaaaaattttagccacatcaaacataatgcaaataattattcccagatttcaaccaatttgctaaatggcacactggcaggaattaaggaattcatcctgattcttctgttggttcttttcacttttggggtttcctttctggaataagagtacaatcttttttttttcctgccttgaggaactttaggagatttcagaagatattttctctttaaattcaacgtggcacaaaaggttactgggaagaaaaaacacgtttgccaatttggacttccaccaaatgttataattggtatcagaagatgtgcaagaatggactcattttgtagcagaatttacatgtgactgattttagccatggaaccaattttataatgtataacctacatctaggcaaaaataccagagcacgaggaaattttcttatgtgtcattgctcaacctctccctggtccttcccttgcctcttctcctgtgcctccaacgcacgtgtctataccccccactccccactccccttccgcccccgtccgccgcctctgttcctctgctccctttcgtcgttacttctcatcttgtcggttattcccgcccccccgcgcacccctcctccccgcttccccgcgcttctgcccacctacttccccacctatccccctctcagttcacacatatgtcctatcgcgactgattctcgcgttcnccactcttcttcccctctttcgttatctccgattctcatccgaccccgtctactccac

SEQ ID NO: 18800 - DNA, 131 bp, Homo sapiens
cagccactatgcctgccaatttgctatcaagagcgagatgagacgtctgatctgtcatcaccagcagcaatcttttagcctctttctcttaaaaataaacatgtaattagactttgtacaataaaaacaga

SEQ ID NO: 18801 - DNA, 126 bp, Homo sapiens
  misc_feature (1)...(126): n = A,T,C or G
ggcgggagggccagcccgggcacgacgagtttttgtattttgannngnngatgngtgttggtaaccggcgccttttcctgcgnggtncgnaggtntncgnanaannctcttatggccatagnagcc

SEQ ID NO: 18802 - DNA, 689 bp, Homo sapiens
caaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcccgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactgagcccagcgcccgcatggagccgcctctggagcttcctgttgttcatactttttccttcctgacatttgtttttacttacaggtgttctgctggtgacggtagcattacccaaataaactgtgcatatgaaatgggagaggagatgccaaaacgccagatgaaagcaatcaagtttcttcttttt

SEQ ID NO: 18803 - DNA, 475 bp, Homo sapiens
tctgtggaagctagaatgttccagagtgataccaatgacttaaattgggggtgacacatctgaacatcagcatgtgctctacatgctccatgtttgggtgatcccttgtccttcccgctctgtcccatccactagctcatgccatgcaacccttggaaaccaagtagaaatgagggggtgtctgatatttgcatatgattgagataaagactatggactggctggattttgtgaaatgaggtgtaaactctcaaatggaaataaaacctgatgcgggcggtgacctatgctggtcactgactgagtggactgagggttcacgtatcggagccggatcagctgcctaaatgccgggtttcggtgttcgccagatcagcgaataacgcgcagtgtgagccggacccggaaacggccggggttaggtaggtggctggctctccccccagagactgtgcaaatagtgggctaatgaata

SEQ ID NO: 18804 - DNA, 308 bp, Homo sapiens
tcaggttttatttccatttgagagtttaaacctcatttcacaaaatccagccagtccatagtctttatctcaatcatatgcttcatttagttaattggaaaaatctcagacaccccctcatttctacttggtttccaagggttgcatggcatgagctagtggatgggacagagcgggaaggacaagggatcagtggaggcctatcaagacccaaacatggagcatgtagagcacatgctgatgttcagatgtgtcacccccaatttaagtcattggtatcactctggaacattccctggaaggggctg

SEQ ID NO: 18805 - DNA, 711 bp, Homo sapiens
aatgggataactggccatccttcccagaacatttagactcctgactcccagacctggagtgacagtttctcatgttaaaatgatcagaatacctggcggatgatctctcgtcgctcggggacaagtttgtactggataacctcctccagctcggacagcatgtggcaagaaaccatggcctgatggaagcaaatcgcattccaaactaattactgcacgaacaatccaaaagacaggattaatttaaatcattccttctggtgtcagggtatctgccgatcagagaaaacaggcatgtttccagcagcctggatgaaaagagaaattcgctgaagaagggcattttcccagaactgaatggcttgagaggaggtattatccaatttctcatcgaagacagaaatgtatggcatccaaaactttaacatctatctaaggatggggctggttaccagaaagaccaagtaattatcgggtttgaactttcagccctgtccactgacatccaggaaaggtgaagaggttgaaaaatgaaaggcaataaaaactcttgaacaatgagcttccaggttgatgaaggtgctgggagggtgaaggtaaaccccagtaccacaggacagaagcttctgcactccagacccttctagaccttccctcattgtacctgttcacctctatcttttataacacccctttataattaaacaagga

SEQ ID NO: 18806 - DNA, 686 bp, Homo sapiens
gtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggcctttctatctcaagctgtagagattgaggggccaacccaaaccgtttctaaaaggcaatgaacctgaacgccagccacgttctttcttgaacccaaagaaaatgagatttaccctggtttggtcgggactttccatccttgcagatggctgataaacaaactcgccctttttggttaataaaacctgctccactgcctacgcaggatttccataaaattcacatttatgtttaacctcttggagggccgaaatattctcaacagctacggcttaagcccacccccattttatctatttt

SEQ ID NO: 18807 - DNA, 192 bp, Homo sapiens
gcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaataaaga

SEQ ID NO: 18808 - DNA, 207 bp, Homo sapiens
aagctgaactgacacgaaacaaaaaaagtccgttgttttggattgagttccatacttggctggcccagaggttgatctcaccaccattcagatatccaagaaaaagccacctgttggatttaagaaaacccagtaagatgttgctactacggttttttttgtatgtgtgtctctgcaggtagaaacctaattagccaataaaaccga

SEQ ID NO: 18809 - DNA, 633 bp, Homo sapiens
aaatgctaaacactgagaggtaagggacctctgctgcaccgccctggagggatttttgatccctaaataagaagaggtgaggaggaaggcctgaatgtgcttctgagaggcagtcaagcctggaactgtggcagccggcttgtgaccatgaagaaaccagcccaagaagagagggaacaggagcctggggcctcgaggactttgctgagccttcgtgtgaccctggagccaccttcctctggagttcttgggatgtcattggtcaagccaggggtgggcgaactttttccataaagggccacatggaaaacattttaggctctgggggggccatgaaatctctgtaacaaccatagacaatggggaaatgaatgggtacacctatggtccaataaactttacttagtaaaaaaatgccgtcgcggccattacctttgagggctcctcactcccttcagctcgagtaaagttgcgggatgcggaagtcagtcactcgacgggatggtgcgctgttcgccataactcgtggttgacacaggaagataagcgagagaccgacaacaggccggttatagtctgtatctgacctccccacctctcgagaggaaacgagaagaagagtggtagccggcg

SEQ ID NO: 18810 - DNA, 507 bp, Homo sapiens
aaatgcttactgacctctggtctaaacactgagaggtaagggacctctgctgcaccgccctggagggatttttgatccctaaataagaagaggtgaggaggaagcctgcccttcctcctggcctgaatgtgcttctgagaggcagtcaagcctggaactgtggcagccggcttgtgaccatgaagaaaccagcccaagaagaaaggccaacctgccaaggagggaacaggagcctggggcctcgaggactttgctgagccttcgtgtgaccctggagccaccttcctctggagttcttgtgatggcagataattcaatgttgtcattgttcaagccaggggtgggcgaactttttccataaagggccacatggaaaacattttaggctctgtgtgggccatgagatctctgttggcactacaaccctaaaaacaaccatagacaatgtgtaaatgaatgggtacacctatgttccaataaaactttacttataaaaataaatcccga

SEQ ID NO: 18811 - DNA, 703 bp, Homo sapiens
tctatctgcaacgactctcttaatcctccaccgctacagctcctgggctttaagctgtaaagactctcaggagctaggtttgatatggcacaatctcaaggcatcgctaagtctgaagttcttccaacaagcagctcaaagattagcgaatgcgtctcagctgtcctagaaaagtgctggcagcaagactgaagagtttctttttaagcgcatgatttgacagaaagaaacagccctggattaatgctcttgggggattcatcttctcgctctcgagaacagggacaccgcgctccgcatgtatacggacgagggagggacgtaccttacagccccctaatgggacaggccgaagcactgcgcagggcatgcggcgtgtgtcggcgtgctgcaagtacccgtcgcacgcggccacagcacaacgcacgaggcaggaggcgggcagcaccacacacgcacccgtgacgagatcggcgtgcgagacagaaaaggggcgtcagcgcgctcggcccgacggcgatcacagagatcctcgagcccagcagaagggcccaccataggcgcaaacagctcccgcgatcgaggcgctcggcgcgccacagcggacaaagaagagaagagaccgcatacgcacaagtagtggtagcgcgcgcccgacgcgccaatgtgaggtggagagagaccgcgagcgggccggacgaat

SEQ ID NO: 18812 - DNA, 426 bp, Homo sapiens
ctcctgggaagctctaggatgtgactttaagctggaaagactctcaggagctaggtttgatatggcacaatctcaaggcatcgctaagtctgaagttcttccagcagtaaaccacaaaggacaagcagctcagagattagcgaatgcgtctcagctgtcctagaaaagtgctgtcagcaagtctgaagagtttcccagaagccctgaaaggacgcaatagcatcatttagcagaaagaaacagccctggattaatgctcttttgggattcatcttctggctttgtgattttgggcaagttacttatcttcctccatttattcacatatataatgagaggagtagtacctaccttacaaacttttctgtgagaagcaaaaaaaataaaaataaaaaataaaaaataaaattgttaaataaaaaatga

SEQ ID NO: 18813 - DNA, 698 bp, Homo sapiens
agtgtcctaataacccagaacagaatatcattaaaagagggatggctcttgaaggagatattgtcagaaccataggacacaaaaaccggtatgtcaaagtcccccgtggtcagatcatgatggacacagttttgacagtaattcttttgggccggtttccctaggacttctgcatgcccatgccacacatatcctgtggcccccagagcgctggcagaaattgaaatcggttcttcctccagagcgcttaccactacagagagaagaggaatgactgcatgaatttacctgacttgttggcattgggaggcctgttactgtacaggaatggtaaaaagatgcctcctaaagggaaaaacttttggcaataagaagctgggcgagaaatatttacagctcgttaaaacggttctgtattagtaaataaacaattttgaaccgttaacacagtatttaaggttcccttgatttgcggctcaacataatatccgtgagtgttaaatgcccccaaagtgtgcagagctctggggaatataaaaaatatctgggccacaagactcatatgggggctaaaaacacggaattatcgcgatgcataatctcccatcaaacttgattgacggcagttatggcgtgggatgctcggatggattgagtgaatcggcaagttgatgttccaggcaaggaacgagtaatcg

SEQ ID NO: 18814 - DNA, 633 bp, Homo sapiens
  misc_feature (1)...(633): n = A,T,C or G
tnatctcctttcaagattcaagatcgacaagaagctattgactggcttcttggtttagctgttagacttgaatatggagataatgcttagtacctgataattcaaaaactgctgacaatgcaactaaaaatgcagaaccattgatcaatttggatgtaaataatcctggatggctttggctaacctgcttcagattcagcgtcatgatgattacctggtaatgcttaaggcaattcggattttggttcagggcagttgctaaggcaaatcaaacaaaagagggcttacctgttgctttagacaaacatattcttggttttgacacaggagatgcaattctctgcgattgctgcacatagaggagctcagagagctacagacaaaaatcaacggacccctatttgcctgttcacgcagttattggtagcccaaaaacgttggaagatgaaccctttgagactccactttctgtcctacttagagcagcagggaaccaataccttagtggaacctttagaaataaatatcaacatctcgtggtactagactacaaatcacccacattgctatatgtttagaagtaaagaagaagatatgaagcaccttacctttgatatggagattaacctaacg

SEQ ID NO: 18815 - DNA, 698 bp, Homo sapiens
tatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaaagaagctgctcaaattctgcgattgctgcacatagaggagctcagagagctacagacaaaaatcaacgaagccatagtagctgttcaggcaattattgctgatccaaagacagaccacagaccgggaaaagttggaaacatgaacacttgaggacttcagcttcttccctacttagtacagttggggaccatacacttctggcatgatgggaaatcaataagttccatttctcgggggaggaagccccataaaatggggttgtttctatagatttcccaccattgtttatt

SEQ ID NO: 18816 - DNA, 328 bp, Homo sapiens
atataatcatcaagaattcatcatgatcaaccagtgaagcccttggatcgagcagtcttctggattgaatttgtcatgcgccacatcgagttgcagcccatgacctcacctggttccagtaccactctttggatgtgattgggttcctgctggcctgtgtggcaacacaaagtgttgtctgttttgtttctggaagttcgctagaaaaggaaagaaaggaaaaagggattagttaaatctgagatttgagatagggatacttcagttgattccagcaataaatattgtgatgcaagatttctttcttcctgtgacaaaaaaaaaaaaa

SEQ ID NO: 18817 - DNA, 393 bp, Homo sapiens
atataaagagaatattatgaaatcatcaagaattcatcatgatcaaccagtgaagcccttggatcgagcagtcttctggattgaatttgtcatgcgccacaaaggagccaaacaccttcgagttgcagcccatgacctcacctggttccagtaccactctttggatgtgattgggttcctgctggcctgtgtggcaactgtgctatttatcatcacaaagtgttgtctgttttgtttctggaagttcgctagaaaaggaaagaaaggaaaaagggattagttaaatctgagatttgaagctggaaaacctgatagatagggatacttcagttgattccagcaataaatattgtgatgcaagatttctttcttcctgtgacaaaaaaaaaaaaa

SEQ ID NO: 18818 - DNA, 1029 bp, Homo sapiens
ctcattggtggaaggaacttgccttgtctcagctgtcatgtaagacatgctgccttgcttccccttcaccttccaccatgattctaagtttcctgaggtctctccagccatgcagaacttttcaaacccctggaatcatctgattggttcgcttaaaagtccaccttcgtccaattggttttctcaaagaggacagatttgcacatggcaaacgtggctcatgaacaaattctctatgtgtccccatgaatgaaaggccagttgctagagaaagaaaatcatatattgggcagatgcctaaaagttgttacctgatgactgtgagagagaggagaagcagtaaacttttagtggaaaatgaataaataaaaggacatcaggacgagatgcaaaggaaagatgagaagatgatgactttgaatcagaatggcagagagatttgaaggccacaatcacagaagaatcatccataatcgaggggggtaatctctctactcttggggctcaggtggacgattgagtaagtattcccagatacatatatgtttcagatgtgtagatttatagtatatacttgcatcaggattaggcagtatgagattcaacctatgaatatttccccacttctgttacttcttctacatttataaatcaagagtaacacaaaaattcatttcataatacattattttgatattctttcatcatttgaatgaaaagcagcttatatttaaaagggagagaagaaaaaaaaccaactaaccttgagtttctgctgaagtagctgaggatccaagatgctctaggctgcaagctgaagtttgaagaaaattcagcctgctgacttttatcctctcttttggacaagatgactgtgggcaatttgggcctctggctatgaaacatgaacctgtctatccgcgttattaatggatacttgatgggatgagctaacaatgactttggtttctttgaaaaaaggaaatttcgtgagataggaaaagccaaataaacctgttacctgtaagg

SEQ ID NO: 18819 - DNA, 482 bp, Homo sapiens
cccggtgctgggtaaattagagaaaatgaggaacaaaaccacacctggaatctgaaactaaaattaactttttccagcaatgtcctattgtgtccggaattggtgggttcttggtctcactgacttcaagaatgaagccgtggaccctcgcgctgtcagaaagagataaatgaattcttagagtttgggtgcacagaatattgtcttatggaacttcaaaaatcgttagatccatcttcataaaaagaactcttgcagtcaaataacctgtttccaggaaaggaatggccatggcatatggaccaacctcgacttgcggatgaaactacactaatgggcatcaagtttatttgaattcgagatataaactgaacgtctgccagagaagacttgatttgatatttttatataatctgtattttagtaaactaaagtctatgtatgtaatctgatatatatgtaataaatagagatgcggccag

SEQ ID NO: 18820 - DNA, 640 bp, Homo sapiens
cccggtgctgggtaaattagagaaaatgaggaacaaaaccacacctggaatctgaaactaaaattaactttttccagcaatgtcctattgtgtccggaattggtgggttcttggtctcactgacttcaagaatgaagccgcggaccctcgcgctcaaaatactcttatttgagcctaagaagagaactaagaggagaaaggaatgtgcagctgtgagggtcttaaaagcaaatgaatctaaggtctgtttcctagtgctacctttagggtctcttacccttggaactctacacagctgtcagaaagagataaatgaattcttagagtttgggtgcacagaatattgtcttatggaacttcaaaaatcgttagatccatcttcataaaaagaactcttgcagtcaaataacctgtttccaggaaaggaatggccatggcatatagaccaacctcgacttgcggatgaaactacactaatgggcatcaagtttatttgaattcgagatataaactgaacgtctgccagagaagacttgatttgatatttttatataatctgtattttagtaaactaaagtctatgtatgtaatctgatatatatgtaataaataaatatgcataataaatagcgatcggcag

SEQ ID NO: 18821 - DNA, 226 bp, Homo sapiens
tttttttttttttcatgatcatagttgattttattggaaaaataaaggccagcaaaagttctcatttggcaaatatcaggtcaaataacttaaaaatataatttcctgcctgactttctttttctcaatgtgaggtgttcttgcctttcttggttgtttgctttctctctggtgcttcttgggtttccttttcttgtgctacctcttcttctgggaccagtgactt

SEQ ID NO: 18822 - DNA, 481 bp, Homo sapiens
  misc_feature (1)...(481): n = A,T,C or G
cgaggcctgcaattttctgctccttgattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaatagaatgctactgaagaaatggctggtgcaattcagcaagttctcaaacagtagctgccacttcaagctgggagagaaatgagagctctgctcatggtgatccagtatctccagaatccatcaccactgctgacctcccactccatgtctccaagtgctctgctatacctgccaccagcagccgccacctccagactttggaaggttataataagacctctgttctacgatctgccttctgcttcaacatcctcactccccacaaacaattctaataaacagcaattaatctgannaaaaaaaaaaaaa

SEQ ID NO: 18823 - DNA, 465 bp, Homo sapiens
  misc_feature (1)...(465): n = A,T,C or G
ttgttgccaccgtgtgagagtgcctttcaccttctgcctngatgtgaggccttcccagccacgtggcaactactacttatttaaaaatacacaagaaactgttgactatcacccatggagggaaggctgaagaaccgagggtctggtgtagaagagagagttcctgaaaatgaacatttttgtccatccctgctgcaccacttcttcaagtataagatatatactcacttgtccagggacatcccagggaaggtgaacttgcccaggcagatgcgatagacagcgctcagaggaatccgctgcagctgcacacaactcagcatgatgaagtcgtatttgcagatcaagagagtcttgtctgtgaccagtagaattctctccttctcattgttccagtggtctatcctataggaatcatcatagcaaataaaaattgatgacacagcctaagtaaaaaaaaaaaaa

SEQ ID NO: 18824 - DNA, 981 bp, Homo sapiens
attgagcctcgggatggaataactgtgagatgtgtttgttgcattcacatatacaggttctgttgatgtgatggaatacgtttactgatttgtgtatgttgaaccagccttgcatcccagggatgaagccaactcgatcatggttttggtatcaggatgatgctggcctcataaaatgagtcagggaagagtccctctttttctgattgtttggaatagtttcagaaggaatggtaccagctcctctttgtacctctggtgcaattcttgcagccctattttacagctcacagaaattaattaattgaacagtgcttctgatctggaaagtgatggactcaggcttatagcataggcagcctgactccacagctcaactattaaacactactctcatcaccccacagggcctgaattttctgctcctgaattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaggtggttacaagaagaaataaaatgttggctggcagaagcagcagggaagatttcatattgaagactaactagttctgagacgttttggatgtcttcttgcaaacaaaatagaatgcaactgaagaaatggctggtgcaattcagcaagttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctggaaaa

SEQ ID NO: 18825 - DNA, 1292 bp, Homo sapiens
  misc_feature (1)...(1292): n = A,T,C or G
tctgttgatgtgatggaatacgtttactgatttgtgtatgttgaaccagccttgcatcccagggatgaagccaactcgatcatggttttggtatcaggatgatgctggcctcataaaatgagtcagggaagagtccctctttttctgattgtttggaatagtttcagaaggaatggtaccagctcctctttgtacctctggtgcaattcttgcagccctattttacagctcacagaaattaattaattgaacagtgcttctgatctggaaagtgatggactcaggcttatagcataggcagcctgactccacagctcaactattaaacactactctcatcaccccacagggcctgaattttctgctcctgaattcaaacattaaaatgtgtggtatatcagtactgggatttatgaggacaatgtggttaatttaaatgccttttggagcaaataggacgtatcttattccaattttttgaagatagagaaagtgcgtggtcctgaacacaacagaatagaatgcaactgaagaaatggctggtgcaattcagcaaggtaaaagattatcttacccccagctggttaaaggcagaagctatgaatttgtgctattgtctgtgggctcctttcagttctcaaacagtagctgccacttctagctgggagagaaatgagagctctgctcatggtgatccagtatctccagaatccatcaccactgctgacctcccactccatgtctccaagtgctctgctatacctgccaccagcagctgccacctccagactttggaaggttataataaaacctctgttctacgatctgccttctgcttcaacatcctcactccccacaaacaattctaataaacagcaattaatctgaaagtgtttttgcaattttaatgtatgagatatggtttctctcaaaagctacactgctcttgtgtccttacaaggtattttcttagcaagaataatctgtttgcatgggtgttaatgactaaatccctttcttgtaaagttatgcccatctgtcacacaagaagaatagtaccctttagagagcgctgaaatgtagggaaatgtagggaaaatgagcagctattcaaaaaggtaaaatgctgccacagagcctgataagagcaattaattaaacattaagtgtagaatagggaatatatggcatgggataaattatagtcacaattcatgtttcttttgtctccagaagttcacacacaaaaacccatgcctttacaaaacaataaattcagtatgcgnccaggg

SEQ ID NO: 18826 - DNA, 715 bp, Homo sapiens
  misc_feature (1)...(715): n = A,T,C or G
ttgggccgtgannaaaaggnggagaactcttaatttcaccgctcagcttcaatccactgtatgaagacagacaacagtttaataacaactgatcaggaggtgagctggatctatctgcacatgcacctaggccacaggaagactgaaatagaggagatctcgatagagcacgtgagaggactagaaccaaaccataccagtcagcccgcactggtttttcacaggggcagaagatgtagccgccttgctgtgaaaatttagagagctctctactccatctcattggctggaatcataatggtatctgcatctggaactgggccactagtataacacctacaaaatgcacaccggcccttcagaccatatggaatcgtgaaatcccagcaattacggaaaaaaaagttatctcccattaaggacactttccagaaggctacacaatttcccattattagcctatcctattggcaatgcaccaaacccaagggaaaatgagaacagtggataccatatcttagaacgcacagctaagccagacttcaaaagatgtaaaaaaaagaacgccggccgccgttaccttaacgcacggataattctaaactagaacaaccatggcatagagaggcccctatgggaatagataaacgcacaccacccgcacgtaatatcacctccaggctaaaagagagacacacaatcagaagccctaccg

SEQ ID NO: 18827 - DNA, 586 bp, Homo sapiens
actccagtttcttcagctttggccctcttgggccttcgaacacagactgaagactgcgctgtcggcttcacgactttggaggttttggaactccaactggcttccttgttcttcagcttgcagacggcctactgtgggacgtcaccttgagatcgttgatatggacaggagacggaaatactgggtagaaaagggcagttccctggcaaagcctcaccctcaagcctggatacctgctgtcttaaacgaaaacgaaaacaggcatttctgtgttcatgctccaaaagttatcttttggcctgccacaccccctatcctgcacccatatgaatcccgaaccccagactccagaagcagaccagcaagcccgcagaccagcagaaggatggcagaacgatgtggcagagaaagggagaagaggaggaacatctgaatgccaaaatgagttcagctgggggcagtcagagaggagtccagccactgggcagccagaatccaggggaggatcacctttccacttcatccccttcctctgcctccccatccatcctgctgaaagccacctccaccactcaataaaacctga

SEQ ID NO: 18828 - DNA, 576 bp, Homo sapiens
tttctaatccagctgtaatgaagacagacaacagtcaaattaacaactgatcaggaggagaagttcatactccttgagctggatctatctgcacatgcacctggcccaggaagctgaaatgggagatctgatgagcagtggaggactgaaccaaagcccttggcttttgctccataccagtcagccgttctggacatacacatgggcagaagatgtagccgccttgtgtgaaaatttgagagctctctactccatcttccgctagtataaccctcattggctggaatcataatggtatctgcatctggaactggccactagtataacacctacaaaatgcacaacggccttcagaccatatgaaaagtctacagggtgagaatctgagaatccagcaatgaggagaaaaaagttatctcccattaagaacactttccagaagctacacaattccagttattgattcatcccatttactagaacctgttcatctggctatgcccaaaaccaagggaaactgaaatagtggttaccatattctgtaactcagcctagcctagcttcagaagttttaat

SEQ ID NO: 18829 - DNA, 645 bp, Homo sapiens
cagggcaaagccaagaagtgattttcccccctccctgccacgggaactgtgacctaattctcattcctaatcacagaatcaaaggagaaatttatttcaatgagccaatctgaaagagctatttgccaaatggctttctttccaatacttaatgaaaagatgcattttgtactactttcaaaaagtgatatggacaggagacggaaatactgggtagaaaagggcagttccctggcaaagcctcaccctcaagcctggatacctgctgtcttaaacgaaaacgaaaacaggcatttctgtgttcatgctccaaaagttatcttttggcctgccacaccccctatcctgcacccatatgaatcccgaaccccagactccagaagcagaccagcaagcccgcagaccagcagaaggatggcagaacgatgtggcagagaaagggagaagaggaggaacatctgaatgccaaaatgagttcagctgggggcagtcagagaggagtccagccactgggcagccagaatccaggggaggatcacctttccacttcatccccttcctctacctccccatccatcctgctgaaagccacctccaccactcaataaaacctaccattcatccttggaaaaaaaaaaaaaaaaa

SEQ ID NO: 18830 - DNA, 375 bp, Homo sapiens
  misc_feature (1)...(375): n = A,T,C or G
acatacttgcaaccagagtcatcaattttgaagacagcaaccaagccaagcaatgtgaggttacagctatgaaatagaatatagatggggggactatagacacagcctgccgttttgtgctgattggtaaagtgttccagccaactggaagcaaatatttctcagaagcagtttcctgctctcatcctctcctcgccatgcccactgtgcccaacatggctccagctgggtcacagcaagcctccgtcctggaatacagcatttccctatttaaatctctaactttgtatgtactattttcaatagaaagcagatggcgaccagaaaataancccattccttctttcacaccgactacacgacaccctccgcgcc

SEQ ID NO: 18831 - DNA, 764 bp, Homo sapiens
cgatttctcattgtcttcaccaatcttctgaacccgtgaatactttttgcatgatgatttgaagcagccaggaggccaagacagcggccaggagaagcagcaaggaattgagccttgtacatttttctcaaaaaaataaaagatggggaaccaccatgctcgagataagaaattagtctgtgaagagaccttcaagttctgtaaatggtagaaaaaaatttaaatgagacatatctttctcaacttgcatcccaattattttcttatttttgtcattcactgtaacctagggaaaacagaattcagaatcacatggcagtaatgattttcatgtcctttccctaactataccatgactccgctcccctaacacacctaggtgtctttctttcctttgtggctcatgcaatttcttctgcctgcaattcccgtaagaatggagactctgggaatggatctcagaattattcaggaggaatatttttcatgatgtgtgagtgatcaaatctatgggccaagcaacgtcaaagagtgaatgaagagctcagaagttgaacacatcttagaggaaagatgaaaattttggttcacggggcggctggaatcaactagatggaagtgtaagaaggaagatggaaatgggagactacaaatatgaaacagagcttctaaggagaatatagtattctaaaaaagaagctttttattggacaccaagagtcggcgtaaatcttttgaaatgaatattccaagtgctacaaata

SEQ ID NO: 18832 - DNA, 769 bp, Homo sapiens
  misc_feature (1)...(769): n = A,T,C or G
aaagaagaataaatgggacattacacaagatcaactgcaagaacaaaccagcaatcctgagaggaaccacagaccctctgaaagaagtggactgcttctgcaggacctgggagacaccccaaatactgttcaatgaagaatgtacagccatgtaggactacaattgggggaaacaggaataatctaatggaaatagaccgagtcgcgatacctatcaagccccggcagctcagcttcttcttggcctctctgtgcagcatttctttctcccagatgaggtttcattgtgctgcccaggatgagccactgtgcccgnccaaatgagctatttatgatgatcataaggacacaagataaggaaatccaatcagttgctacgtgctgatgattctgattctggccctgcagtatcgcttgcatgcacctcctcctccctgtgctcactgctggagaaaagagaaccttggctgatgatttatggatctacaagnaatcgaagcttaactgccacaaaaataactttatccagtcctccccccctcccatgcaccttctctagttagcgctgcaagaacttggttgctcaggtggaaggcatatagattgtattgtatttgaatagctccccaggtagcacagtaatgtctctgcacttgattaaataagtcaggtcaatttttctgcaagttttcctccattgcagcactaacatccacatttaatttgttgctttatttaacaccatcatctgctttcagggcaaaaataa

SEQ ID NO: 18833 - DNA, 362 bp, Homo sapiens
ctcagatctaactccagtccaatatcccctaagaagccttctctgaccactccagggcacaatgatctcaaggttcagcatctccagagatgagctttccaaatacctgatgaagatatgcatgagtcagtgatgccacaaaatgccacagaatatcatggagagaagtggtttggatgacattacacagaagccagttgaaagcctgaagaaatgacggttaaatgagttcaagaataaaatacatgagtttaaaaagtactcagaaataaagtacctccatggattaagacttcaaagaaagatactagaaaatcttttttaattaaaaaaaatgccttatagttttaaaaaaaaaaaaa

SEQ ID NO: 18834 - DNA, 539 bp, Homo sapiens
cctcagatctaactccagtccaatattccctaagaagccttctctgaccactccagggcacaatgatctcaaggttcagcatctccagagatgagctttccaaatacctgatgaagatatgcatgtgagaaggaattaatgacaggcattaccactatattggccagaggactcattagctgattccgcaggatatgtggataccaaaattacctcagggccatttgctgtaatgaactgccgctggggagagacatcataaggtctgggatggtctgcagcaagcggtgaaaggagtcagtgatgccacaaaatgccacagaatatcatggagagaagtggtttggatgacattacacagaagccagttgaaagcctgaagaaatgacggttaaatgagttcaagaataaaatacatgagtttaaaaagtactcagaaataaagtacctccatggattaagacttcaaagaaagatactagaaaatcttttttaattaaaaaaaatgccttatagttttaaaaaaaaaaaaaaaaaaa

SEQ ID NO: 18835 - DNA, 388 bp, Homo sapiens
atctaactccagtccaatatcccctaagaagccttctctgaccactccagggcacaatgatctcaaggttcagcatcttcagagatgagctttccaaatacctgatgaagatatgcatgtgagaaggaattaatgacaggcattaacactatattggccagaggactcattagctgattccgcaggagtcagtgatgccacaaaatgccacagaatatcatggagagaagtggtttggatgacattacacagaagccagttgaaagcctgaagaaatgacggttaaatgagttcaagaataaaatacatgagtttaaaaagtactcagaaataaaggcgcagcggccgatggaattttgtaagaagatatgtgtgtgcacgggggggt

SEQ ID NO: 18836 - DNA, 720 bp, Homo sapiens
tcatctacgttgctgcaaacaacagaatctcacttttttatggatgaatagtacttcattgtatgcctcagagcatattggtgaccggcctgggcaacagcgctggatgccatgttgtgcaggcattctgtgcactgaccccgctgctgcctgcatcttctttctgcggtctactttatgtacccttctacatgggctacttgttaattgtaccttttaatcgctggattaatcgcgtgaagcctccggaactggtgctttagaaatgagcgaaaagtgtaatttgcacagttgcgtgacgcttcccttaatgtgggggtaatgctgtgatggtgtgctcactgagcgcggcaggagtgggcatagagcggcggggagcgggccgtcgcgtcgctaggatgcgggggggttggctgggagggcgctcatgggggactgtgatgtccccctctcacaggtaccggtcagaggtgtgggtcgtgagtggggcgacgcctgatggagcattacggagacttgtcctggagtgacgcgcacgagcgagtactagctggagtgtgagcgctcgagcaacgaattaggattcatgtgcatgtcagtatttttcatgcagcggaatacgtgtagattttgtagaattgtctatattgatttataatttatcgaattctccgtcatccagcctccatcagataccgcaatatggcgtgaggatgactg

SEQ ID NO: 18837 - DNA, 284 bp, Homo sapiens
caaggctgttgtcatcctgccacttccctgaatgctcattgggtcatctctgtcatggacgcaagactgttgccaatatgatcaaggggaaaactcctgaggagattcgcaagaccttcaatatcaaaaatgactttccctctttttttgtaaagcaatgtctgcctagtttattgtccagttaactttagtgaccttttaaaagttggcattgtaaaaaaacgtggtaactggaatttctgtcggattgtggatcgaaactaaaatcgaaatcgctgacagtt

SEQ ID NO: 18838 - DNA, 112 bp, Homo sapiens
attccatgctggtttccattgtggggatggcactatacacaggatacgtcttcatgccccagcgcatcatggcgatattgcactactggggagatcgtacaataaaccaaga

SEQ ID NO: 18839 - DNA, 263 bp, Homo sapiens
agaactgatgccaaagcctgcattttgttaccttctttggaatcattgggaatatcccaagtttgaagtctgatttgtttctattgctctggtttgggacacatccatggaagcctagaagaggagaggattatccttttaaatttagccattttccaaccttttttttaaatttgctttgttttgttttctctcagcaaatgtgttaaatgcctaccatgtgttaggaatttttacattatgtcatttcacataaatgtcga

SEQ ID NO: 18840 - DNA, 801 bp, Homo sapiens
tcacctgtgaagatggtaattcctaccagtgctacagatgtcactgcaaatggacaagccaagtctagaagatgctaggtcgggatgggacagccagaggctggaagatgattctaagaccaatgaaacagaaagggaagcatatcacaaaccagagccagacactctgctaggttctgaggattcagagaatgaattatttcctttccactaagaagtcggttagaacttcaatcgagagaacacacagagcaaactgggtgatcaaccatgccttgtgaaaaccatctaggttgtggcaaaatgggattaagcacttgactttacaattcaagggttaagcttatacaaggttttttaaactttgtccgtgatgaagacccaaatacaaggaccttatccctgtaactggtaaggcggcaagaaggagagaattcagtggtgctgtcccccaaagttctaaaggacctttcggctccattgtggcactaagaaccaggggtgtggtgcataaactccttgcttggcctggagacccattcccagaaagatggtgttcggccctgcagtacctcaggattgttgcttggattgagtcacacccagacacttctacaactcagagctcactctccactgaggaaatacctcaaacccagttgaaagggaggccagctctgtcagcatgtgacaaaaaggaaaaagacatgtcatcttcctaggatccttctagaaacccaataaacctagatgcggccgaaatctttttcgggcccgcaataaacggggcgcgggatggca

SEQ ID NO: 18841 - DNA, 670 bp, Homo sapiens
  misc_feature (1)...(670): n = A,T,C or G
ctgtcgcccaggctggagtgcaatggcgcgatctcggctcactgcaagctccacctcccgggtttataccattctcctgcctcagcctcccgagtagctgggactacatggcaggattgtaaatgacaacctaacaattaaatatgatgatattaaatgagctgaaatgtgcaataacttaataccactcagaaatagatgtggggaacctgtgcaaaatgaaaaccggtgccggcggttgggttgangtaagaggaatggataatggcggcgggctaacgggggggcctccgggcaggggggggggggacccgggtcgacgcacagggaatggatggtggcgataaaacgggggaaccccaaggtacgaaaaggggggggggaaagggggggaaacaaaagaaaagggggggggaaacagggggagcgggaaaggaaggggccacaaggacgggacaaacaaaggagacgggaagggggaaaaaaacatcgggagacggaaccacgacgggggcaccacaacgcaggggggaacgacaacgcaaggcgaagacgggacaaacaagggaggagggggggacaaaagagacaaacaaaacggaaggaggggaagaaaaaaacggagaacgggaaggggggaaaacaaacagaaaaggggaaaaaaaaaacg

SEQ ID NO: 18842 - DNA, 518 bp, Homo sapiens
aaccacaacatttggagattaccaacatggttttcagccctcagctttggcgagacttcttccttttcattcttttctgggcaaatctaaacctttggagaagtagatgagtgaagtcaattgcaaagggactggatctctctctatcacccagactggagtgcagtggcacaatcgtggctcactgcagtcttgaactcctggcctcaagagatcttcctgcctcagcctcctgaatggttgcgactacagggacaggggaataaaaatgtgatgcattggaggagaatcacaggactcaacaaataaaccttgagatgtcattgtcacctgtgtgtactttatgagaatacacgtagagattaaccctttcctggaaaatgaacgtctattgcttcttttggggacagcatgctttatagttaggacattcttctttatatccagcctgacttcttcatgctgtactagccttccaatccttaactaaaaattttttaaaaatgaataaacactga

SEQ ID NO: 18843 - DNA, 595 bp, Homo sapiens
tgatgactctatagctgattttctcaatagtgatgaggaagaagacagagtttctttgcagaatttaaagaatttagatggactctcgtcctgtcacccaggctggagtgcagcggcgcaatctcggctcactgcaacctctccctcccagattcaagcaattctcatgcctcagcctcccgagcagctgggactacaggcgcctgccactacgcccaaccaatttttgtatttttagtagagatggggtttcgccatgttggccaggctggtcttgaactcctgacctcaggtgatacacccgcctcgacttcccaaagtactgggattataggcgtgagccaccgctccaggccctaagcccccctttcatcacctcctgctcctgactcatctaaagccttggttctcacagtgtggttcatggagcatcagaatcagctgggagcttgctagaaacgcagcattgcatttggaaatgggactagaagatttagagatgctgaaatcactcccaagcagtttttaaaaagataaagggctctggaagattcccagttataacaaaataaataaatcccgatgctggccggaa

SEQ ID NO: 18844 - DNA, 789 bp, Homo sapiens
gacagatcccaggtctaaaccctagccaaaaccccttgtgttagaggagctcaccctttactgctgatgaaatctccatgatgaagtgctttcctggtgacacccagagatcgtttgctatgtgaatgcttttcttgctcaaatttcaacaaagcatgattgccaaaaaagaaaaaaaaaagaagagaaaagagaacagaaaagaagaaaagaaaagaaagaaaggagaagagagagaaagagagaagagaagagaagagaaaagaagaaaagaaaagaaaagaccagaccagacccatagaatcctatgggatccgctgacatgtttgtctgaacttcgtcttccatatcactgtcaagatagtttttctaactcaccactccaaaatctatgaaaagcctccataagcccctagttgccctccaaattataactgcattcggttcacacttttccctcctcctgaagtgactttccttcttattccgcttttaaaaactttatcacctgcaaaattcacttcaaaaagagctccctccatgaaggtttaattactctcttggccctaaaggaatgacatctcctgtttggcctgttcacattgctgcactgcactggtaactcttaaacgaaacccatttttactcttacctcttattgctactttatgacaggggcttattgcctctctcaacctcaactaaactatttaagagaagtgtactcatctggttatttcctgctgagtctagtccaatctcttataatttttagaccattaaagagct

SEQ ID NO: 18845 - DNA, 885 bp, Homo sapiens
tatggtggctgatgaaatgggtctaggaaagacaatccaggcgattggaattacttacttctataaagaggaatggcctctgttaatagtggtcccttcgtctctgaggtacccttggacagaagaaattgaaaaatggatcccagagctaagtccagaagaaatcaatgttattcagaataaaactgatgttaggagaatgttgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagagtctcactcccatcgcccaggctggactgcagtggcaccatcatggctcactacaatctctgcctcctgggttcaatcgattcttctgccttagcctcctgagtagctgggattacaggcatgcgccaccatgcccggctaatttttttgtatttttaatagagatggggtttcaccatgttggtcaggctggtcttgaactcctgacctcaggttattaatcattctttattccagtgttttacaaatttgtggtagctatgaaataattggtggactattatacatataggtggatgacgtatatgtaaaaaaataaaagtagagttcgcccgaaaacttgtttttgttgttgtgaatttagctattct

SEQ ID NO: 18846 - DNA, 742 bp, Homo sapiens
cctggccgcatccagatttattgtgtaagagtgaaagaacaatgcttccacagtgtggaaggggacctgagcaggttgctgctgctggcttgagaggccagcttttactcccttatttggccctgcccacatcctgctgattggtccattttacagagtgctgattggcccatttttacagagtgctgattggtgcatttacaaacctttagctagacacagagcactgattggtgcatttttacagagtgctaattggtgcgtttacaaacctttagatagacacagagtgctgattggtgcattttttacagagtgctgatgggtgcatttacaatcctttagctagacagaaaagttttccaagtccccacccgacccagaagcccagctggcttcacctctcaatcccccctctaaacaggacaccccaactgctgttgggaattgggcgatgactactgtagctacttcctgctggataggggcgaagaaggggccctacaattgtagtgtcctccagaggggaactctttaggccagtgaaagggccagcaggtcagtccaggggtccttggtagaagttgttagttgagctcatttggggttccatttgtaagaccatctgtagcttgatggccttgatcctgtgagaagagtgagcatgtgctaggtcagtatttggtcctcttctccctcacctccttggttttgtagcagatttctctgatcttctcctgct

SEQ ID NO: 18847 - DNA, 886 bp, Homo sapiens
aggggaaattttcgagactctcgtgtcagaaccaccgctacagttctagatgaggatgattttctctctgccattggatgtcccttggtatttcgatctccatgaaacttaacatcgtcccatttttccagttgtgtttgaatgtctatgcacgtaaccagtgtttgactagctcattgtgagagatagaaaattcaaattggagaaggtccctacagctctacctttccaccagtccctgctgtttcactggccctggcactgcactggagagactagcttctgagcaagatcggtggctccctggcctggaatctcttcacccagctcacgtaggaaagccacagaaagacaaagaaaccacttgcattaaccctttgtggcagtctacaacaatgactgcagcactcctctttaatctccaagcttttcctctaggtgggggatggatttttgctgatgtctcaatactcttctgtctgcttctcccttgtactcaaggcaggggccgggctccattgaactcacaacctggatttctttagtagtgcatgggcttcatgagttaaccattcctatgggatctttaggatggtgtgtcaaactttactcttaataatcttgctttctgattccaattccaagtcacagtggttggatgttgttggtgaagtggaaacatctggctctgtcacggcttagtgtgtgacttgaagtaagtttcttgatctctctgagtttcagtttcctcatttgaaaatggggaattaattgtcttttagggataagatgaggattaaatgatctaatgtatgtaaagtgccaggcatacaataggtactcaataaatgtgatttccattcttttacaaaaaaaaaaaaaaaaa

SEQ ID NO: 18848 - DNA, 647 bp, Homo sapiens
  misc_feature (1)...(647): n = A,T,C or G
actagtgaatgaagaacgaacgctggaagtagaaatagagcctgggagtacccctttattggagaaggtgagcctcacgtggatggggagcctggagatttacggttccgaatcaaagttgtcaagcagaggagatgatttgtacacaaatgtgacaatctcattagttgagtcactggttggctttgagatggatattactcacttggatggcccgggataagatcaccaggccaggagcgaagctatggaagaaaggggaagggctccccaactttgacaacaacaatatcaagggctctgtggattttccaaaagaacagttaacagaggaagcgagagaaggtatcaaacagctactgaaacaagggtcagtgcagaaggtatacaatggacaataaaattggacttttgtttaaaataaaaaaaaaaannnnntnnnnaannannnnaaannnaaaannaannaattttaaatgcggccctttccctttaggagtactaactccttgccctcgttcgttcggttgcgggagcgggatcatcttactaaaaggcggaatacggttttcacagattaggggataccccggaaaaactggagaccgaaaggcccggtgtgggttattcttggttcgccccttaag

SEQ ID NO: 18849 - DNA, 1220 bp, Homo sapiens
tgtctcactctgtcacccaggctggagttcagtggcatgatatcggctcactgcaacctctgcctccccggttcaagcaattctgcctcagcctcccagattcatggctgaagcgtctgaaacaagactaacaagactaacgagattaacaagagaaaaacatacaaatttttaaaatataagttgtatgtgacatagaagcatttataaagaaaagaagaccagaagaaacgggtagacctgggtatttttatgctacttttgatgaaaatgggaatgcttttggagacgcatgagtgaataaaaaaatatgatctaatggtaataaactagaggaaacagagcaaagtctgttcagatcttctctgtgatgctttgtcttcagagctccttcaggttggaaggaatacctttacttgggggcatgtcaattcgtttttctcacttgattcatctttatgacttcctgaggacagatctaattctaaagtaaccagaagcctggcgcatctcagagcagcaaatccctcaaccttggagcacaaatgatcgctgatagagtctgcataaaatcatcttcctctatctgacagccatgagcagagccttgggggtaaaaaaagccacagccttaaatctcttcactcagaaattaccatgaagataaaataaataaatggaaaggactatcaagaagccaacaaaacataaacaccaaaccaactcatcttgtttcactttggaaataaactgttcccagatgtgagaccaacaaaattaatattaagcaattaaaccagtaaattataaactgatttatcatttgggaagttcaaagtacagagagatgaggtacctgtagccagaattacacatcatttcaaaatatgtagacaaaaagaaaactggatgaacagagaaacattgcagcaatgcacagtcttaggacgaatgttgctgtttgcagacagagaaatgtttgccatcctgtgtttagcctcaaaggcttactgagataatagcattgttggccaattgcttgaaaaattttcacattcaatcccttcatgcctatattggttgggaagaggagggaaagtcagttcttaactgattacttctcagggaacttctaatatttggaccgggcacttccattcaagggaatgatgggtgctgttatttgcacagatggtcccatgagtttggagaccaagcaa

SEQ ID NO: 18850 - DNA, 230 bp, Homo sapiens
atctttgcatagatgtgttcttcatttatcatggtacattcctaggagtggaattgctgtgtcatatgagaagaatatatccaggctgatccatcaatcccagaaggagaacaagaaacacatggagcagagctaagttacccagcctagctcagcctagatcagcatcctgtaacaggcccccagccttgtgggctaaataaacatgtgttgttgtaaaaaaaaaaaaa

SEQ ID NO: 18851 - DNA, 897 bp, Homo sapiens
  misc_feature (1)...(897): n = A,T,C or G
accctggttgaaggaacatgttgttcttatggtggagggcagaaacccaagagggctggagccaatccatctgcctggaatttgaatgtggtatctggagcttcagtagtcatccaggactgtaagtgtgaaagccatgcactgagagtggtggaacagaatccctgttttctttagacgctgactcctgctgtctaccagatcctcgtggtgcaatgactggtgtagactggcttgttgaagtcactctctggatctgagcaacgctggctgagccgtgatgaagtattcctatccatccactatgcttcacagtgggaatctctcactgttcatcaccgctgccctagcagccgcagggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctgctacgtgctaacatgtggctagtcaaacaactctccttttcaaccgccaccaggcacagtttctgcttatccctgagtagcagtgttcagtttcctgccagcctgtggagtttttcaaacaagccaatcacctcctcctgtgggaactgagaagcaccccaccctctcgatantacaaagcccctgcttgttccctagcgcaacccccatgtggtcctgtggagcatatggtatcttcctcttctgggcagtgagcatatgtaactaataaacagtgatggggcca

SEQ ID NO: 18852 - DNA, 763 bp, Homo sapiens
agaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaaggcctttgaagacaatttaattgaagcaaggaaagaagttgaagtatcacagagtaaatacaatgctctaccattacagttgagtaataaacagactgaacttatccagaaagatatggatattaccctggtcaggaaggaactgcaggagctgcagaatctttacaaacagaacagtacacataccggccagcaagcagagctgatccagcagcttcaggttctcaatatggacacacaaaaaagtcctgaagaatcaggaagaaggttaacacagctgaaagttttcatattcaaaagtacctcatcggccatccttataagcttaaaaacgttattggtttacagagatctgaaatgaatt

SEQ ID NO: 18853 - DNA, 543 bp, Homo sapiens
ttggaataacgacgtgcttgccttctgaggttaaagctgatgtttgccccccaaggaaacctctttccatcaaagcatctctcaccatcatccctggcctacagagggcatccgcttttcaagaatgccaactcctctctcaccaatgtgtgttttttctgaagggttccagaagcaacactttgttaggagatgctgcagaagccagaggattgcctgatgcctcccagctgaatcagcaaagctttcctctaatagcgttgcttgattaaggggttttgcttcccaaggaatggccttactgttcaaattcagatgcactaggcaagttcagaagacaagagtgaagatgagacgccaacagcctcacactgaggacgattctttctccagctccccactgcacaagcaagcttggtattcatcaatatgacatggtctggaagttttcctgtatattcatcagcttgggttactaaacaaagtacaaaatacttagtggctttagcaacataaatttactttctcagaaaaaaaaaaaaa

SEQ ID NO: 18854 - DNA, 777 bp, Homo sapiens
ctccaccgctacaactgcatcacagtctttctgcacttaggatcgctagtcagcacttcagccgtgcacgtggtgaccattttacacagcaccatccccaagaaaaaggacaaaaatatgaaaaacctggcactaaatggactgtgaaaaggacatttcttcacaaaatgacagttgaaacaggaagtcagagcgttgccttgttcattcctttttagaaatgtgcttgtcggttgactcaaattttttgccgctctgtgcatgttggtgaatatctgcaaaaggactgtgggtcgggcgcagtgattcatgcctataatctcagcactctgagaggccgaggcgagagggttgattgaggccaagggttcaagaccagcctggtcaatgtagtaagattacatctccacaaaaaataaaaaactagctgggcctgttggcataagcctgtaatccctgcttctccagaggctgatgaggtagaatcccttgagctcaggagtttgaggctgcagtgagctatgactgcatcactgcacaacagaatgggacacagagcaagaccctgtctgaacaaattaaaataaataaataaatagggcatggtggcttatgcctgtaatcccaacactgtgggaggctgaggcaggaggattatttaagccctggagtctgagactagcttggacaatgtagtgagacctctactctataaaacataaaaataaaaaataaaataaataatagccagtaacaaaataaaaaggtatcgcacag

SEQ ID NO: 18855 - DNA, 625 bp, Homo sapiens
cagaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaagagcattcatgggcatatgtctcacagtgacatgcaggcaagctcacagacatcgtctccacaccaaggcacatgttggagttgagtacatcgccaatagcagtgcaggaaccgctgctcctttcagccaggcccagaattcttcctagaaagcctaatctggaaatacattttggaatattagattaaataaaacactatcggccagg

SEQ ID NO: 18856 - DNA, 787 bp, Homo sapiens
gtcgctttttatttttctaaatttataagaataataattttacaatattttttgcatttgttgttaggtataaaactatagtgaaacatttgaatacagataagtttaagttttcatgtgtatatttaaagtacaggcatgctttggagatatcatgggttcagttccagatcaccgcaataaagcacatattacaatatcatgagtctcacacatttttgtttgtttcttagtgcatataaaagttaactatcccatagtctattcagtgtgcaatagcatcatgtccataaaaacaatgtacgtaccttaatttaaagttgttttattactaaaaaatgctaatgatcgtctgagtcttcagtgagttgtaatttctttgctgctggagcatcttgctttgatgttgatggctgctgactgatcagtgagtgattgctgaaggttagagtggtaaggcaatttcttaaaataaaacaacaataaggtttgacacattgattgattattcttttcctgaaaatttctgtgcgatttctgtttgatgaaattttatccacagtagaactgctttaaaaattaaagtcaatcctctgatacccttcattgctttatcaactaaatttatgtaatattctaaatcctttgtgattatttcagcaatcttcacagggctaggcacagtgacttatgcctataatcccaggacttcgagaggccaaggtgtgaggattgcttgaggccaggagttcaagaccaccgtgggcaacatagcaagaccttgatt

SEQ ID NO: 18857 - DNA, 761 bp, Homo sapiens
tttttttttttttttttgttatttaagtcaatattttattgaggtataattttcatagggaaatatgcacaaatcataagagtgcagttcaaagaatttacacaaagagaacactcaaaggcacatcaagaagcagattttacagaactccaggggcacctctccttccagccaccccttgcttctccttgagtggccactgtgttgatttgcaactcccatagtgccaaattccattgtaaggttcaagagaaatggtgacagacagagcccttgtcttatccccaacctcagaagctttcagtagcataccagaagtatgatatattctcaatcacagtaaggaacttcctttccgtttgagctttcttgcagtgtttgtcaggactcagtgttgaactttattaaatatcctttctgcatctgtggccttgtggattcaggatgggtgggcagagaacctgtctatgctgggcaccgcctcgtttgcaaactctgaaaggataatggaaacacactccgtcttccacaaatgttttcgggatgtgggaaatccttaggtcttcctctccatccaccctaatggagtactcgtaaccagcggctttttacttccgggctggccatctgggactttgggacagtggacgtgtagctgagctagaagggcttaccttctttggaccaagtgattaccctaagtaacctggccgggtttttcttctattgtgcgttaaactaggatgccctaggactgataa

SEQ ID NO: 18858 - DNA, 782 bp, Homo sapiens
  misc_feature (1)...(782): n = A,T,C or G
gttacccggcaagtttacagagagggaaggagagcagaatatttctgcccagaagttgcatcaagatgaccaagttgccatgaataaatcatcacagaattttgaactggaaaacagaaacaaaagcattgaaagctaaaatgctcgcgtaatcctttcttgattctgtgtatcacccttggagaagtctgcattgtctcttgctgtaggatgactgcatgggacacacttagtgactcttctgaagaagctttctggtctgctttccttttcccatggtttttaaagagaatctagctttcttgcccctgccttctgctaaaataaatgttaaaaaaaaactggaaaaattagtgacctacagttttccagggataagactcacctatggagaagcattattccgacgacgttttttgctgaacttgaagcattatttccagagaaagggaagtcagaaatgccttgtagacctctcctatcgtgtccggaattggtgggttcttggtgtcactgacttcaagaaggaatccgtagaccctcgcggtgagtgttacagttcttaaaggcggcgtgtccgaagtttgttcgttctgatgttcggatgtgttcggagttnattacttctggtgggtatcgtggnctngctggctcangagaaaagnctgtggaccttaccgctcattggctaaaacacattgatacatttttttgcgcaaagatggaaggctccctttgtcttcacaaagccagtaggtaaagacattctaatttttactttt

SEQ ID NO: 18859 - DNA, 808 bp, Homo sapiens
aatcagcgtggtatttctatgttccttacgttcagatgcaaccatggaaagcataactgcttgtttacatgcattgcaagcacttctagatgtaccttggcccagatcaaaaattggcagtgatcaggacttgggtatagaattgctgaatgttctacatcgagtaattttaaccagagaatcaccttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctggcggggtgctcttcctgaaggaagcatctcaattctccctactatattgtacctcacaatcggggtcctcagagagactgctgtgaagttaccctgggggccagttttcttcgacagttgcagctttcctacaggctctaaaaggaatattatcttctcccatggcccgggcagaaaagagccgtactgcttggactgaccttctccgaagtgcctaacaacatttcttgactgttggatccaagtgtgaacccaccagaacttgtaaatcagcttct

SEQ ID NO: 18860 - DNA, 335 bp, Homo sapiens
cttctagtgaggacgttgccagctccccggagcgccactacacgcccttgccttctgcttccagggaactcaccagtcaccaagatttaaatattccagtgttgagaatccacagtaaacttgctgtactctgtcactgttgaggaatgggacattcacatgaatcaaatatgctggtaaataaagaaatatggagaaaaatatagaggtgtcctggggaagtgtcgctacgtttactatgggaaaaactcagagggcaacaggtttatccgagatgaccagctctgaagccaacttctgtatacctttcaccatttcatgaaaataaaatcaga

SEQ ID NO: 18861 - DNA, 555 bp, Homo sapiens
  misc_feature (1)...(555): n = A,T,C or G
gaggaacactgcacttcagttttcagtacaagtctttaattcactctgattggactagccttgataactgcccatcttgggcagtttctgcagtggggaaatggaatgtgctgagtgcccagcccaggccaagtggtccactctggggtcacagggacagggagagtcaatatttctaggactacatagctttctaaacagaaatcagggcttttggaagggaganagagaaactgcccatcttttctttactttattggcatatgtttaatttgttccagtcantgtctccacaaggttaanaatgtgtttgccagatgatctgggaagacctaccattaccttttgctagagggtccccatcccaccccaccttccagctccgaatttgccaagtggaagagcaggccctgggaagaaacaaaacaataaaaactactggatgatttctactgaagaaggctctgactcccccatgaacatctttctcatctcaaataaataaaatgcagcgggggcttgaactagccaccatatccctgaaaaaaaaaaaaa

SEQ ID NO: 18862 - DNA, 1496 bp, Homo sapiens
  misc_feature (1)...(1496): n = A,T,C or G
cggccgcatcggtttttattcacacttattcagcaaaccttctcagtacctactacccatattgccagataccacgtggctctggggccaaaagctcagtcttggccctcagggaccttcatgaaaaccaataatggttggacagtgggggaactggggagctccgagcaggaggggttggtcacagacttgctgctgccagtgaagagggaccgctgccactccaggcggccacagagtgtgagggagcacagtgggaggcaggcagccgagaggtgggtggggccagatcccagggctccctgagtgcctgggctggaccctgtaggtgacgggagcccttgcaggggtgagtcagattttggtttgtttaaaagagaaaagtgtctgagttagattaaagccttccatagttttactctgggttcagggaattcatggcaggaggggatggggaggttagaggcacggaggtcaggtggctgggtaattgttcaattgctgactggaggaatgttgggacttgcagtgtgcaccattggggcccttgttgtatacacctattatttgagcctaaccaggaatcttgcagacttgttccccagggggcgctgtgcccactgattggtccagtggccaaaatgagatgtctttgcgcctgaggcaaaccaaagcaacagaggacatttaggctggatgaaggcaggctcagggggctaccacgaccatcaggcatctgaagcccctctgtggagacccatcagactcgctctgtgttgccccggggcagggttggggatgaaagggggcaccagtaggtgagaaagtgctttcttttccaacaagcagcttagccggagataaagggaagtcacagctggctacctcggcggggacgcggcctgggaggcagggtaggtcaagggtggctctggaggcagacagcaggattggatcttggctccgctgtgttctagctggtgatcctagacagcgtttgaatttctgcgtgcttcatttttctcacccaaatttcagcctcggttcaggttttgtgtgtccataagctactttgctagcttaagtcatcttgttggatgtatgcaggcctcctgagggaagtcaaggctggagggggtcctgtggacagccagtgggtgcaacaccagggcgggagcagattcccctccttgtaatttgttccttccctgtagctctgtggtcatcacgtcaccaaactgaagccagaagtaagtgcttctttatttatttgctccccagtgtcgcctctatgacctaatgctgtccttcaaggcaatgaagtgtcagaaattcacttccacaatgctctcaggcattttctccccagcctttgcttctcttcatgccccaaagggaacttttcctgcttcaaggtcgcctgctgtttgctggatacaatgattacactatcaacgtctgggatgtctcnaaagggtcccgggtctccatcctag

SEQ ID NO: 18863 - DNA, 761 bp, Homo sapiens
ccggtctgcattcatcggttttatttcgaaatctaaaccattgttttatgtttattttatcaagaaatagagttgaaacatgtcaggcttaattccattaggctgaactgcccagaacagagccctggggtttggaagacagaatctgaaaggaagtgtctccttagctaagcatcatcaagaagccaaacaacaaacaacctcaaaacaccactgttgtcagggtagttttctattgtgggagactatccctccaaaatcccactctgacctaaaagtgacagatcttttaataaaaccaaaccgtaatttttcaaccattacaagccaccatgtatatctgtgtatgtgcatacggctgtatcagatcaattagtgtttagtattcattgacgtccacccaagtgcttactgtctttagaaatatgatacaaaattctgctgccagaaaacaaatattattcgattttgatgctgcagaattgtcctcatgcagagaatgtaacatcttctcttgtcctctgaagagaatcctgtaacaaagcaaatttaggtgtactttcaattttaccatcagagtagtccacgccagatgtcttcagtctcttaggtctccataagagtttgtttcctcatctccaaagcaatttcctgctctattccagttgaacaccaagagaaaaacaatgcagccatacaccttcccttcctcaccagatgctgcagcctggagactgtgggcagagccttatcttctatct

SEQ ID NO: 18864 - DNA, 789 bp, Homo sapiens
cggccgatctttttttattctttgatagcgtttcactcttgttgtccaggctggagtgcaatggggtgatctcagctcactgaaacctctgtattccaggttcaagcgattctcctgcctcagcctcccaagtagctgggattacaggcacctgccactaagcccagctaatttttttgttattttagtacagacagggtttcaccatgttggccaggctggtctcaaactccagacctcaggtgatccacccacctcgacctcccaaagtgctgggattacaggcatgagccactgtgcctggtctggattacatcttaacctacaatatttcatgaagttaatgattttaaataaaaggaaatcaagtaacatctgaatttctatgtctaaatacatttagatgatagtgactcctgcaacttgttcaaaattatttggaaatatgtcatttttcttgaaatgaacttggttttaaaggcagcaatttggtctttataaggagtttctgaatctggattgggcgatgggattcgggcaaaattggcgaaatccaaggagaacccgaccagcaaattttgggaaaggcccacgaaggctggggcttaccgatgagagaaacaattggtacttggagggtccgttggcaacattgggttttataaaacaccggcatttggcggggaaaaggtccgtaattacacgtgtaaaaacgagaacatgttcaatttgtttggaaagaacaaaaattgtgtcggggtgtgtaataaaaaaaaaccatctcggttt

SEQ ID NO: 18865 - DNA, 1080 bp, Homo sapiens
tttttttttttttttttatcttactatatttgttaatttatttcattcataaattatatcgcagagggagtttttatttattactgaaagataggcgagatcaagcaacatgaccaaggccagcaaattgataaggagagaaattattgcatttgaaatccacctactaactctacaccctagcttcttaccaaaagaaatcaagataaacccctgaaagttaagcttccttgtaagggtcactcataggaaagtttgcaatttgcaggatgagtccactatagatgtttcccttgatgtactgagtattcagttttatgttctagcagagtttctgtcctttgtatatttaaaagattgtgcgccacacttatctccactcagaaggaatataacatttcagacccctggatttatttcaagcatgttttccctccgcaatatctcccacctggactttgagtccatgcgctcacctcattggtacacattgtagtcatatctaggtccttacgtgacccttacctgagatagaaacttatcaacaatctcaactctactttctggatgggtaagacttagcacttatatcacattttggataccctgtccaagttacaaccactaccatattgacatcttaaggtctcaagcatattcagaagtgtacacatgttctctgaggtcattgtcagtggttctccatgtatttcactcagaccagcagcataagcatcagtgatgaacttaatagaaacacagattcgtgagccttccccagacttcagaaactctggaattggggctcagtgacttctgtgttaacaagtccccaagtaattctgattaacaaaatttgaaattaaatttcctcttctattctttattggattaatctgtgggactgggttttaacttttctccctactcatagtcttctcttgaatcaactaagcagcctgttggcatccctcagaagactccagtggagaatctttccttgccccttccagcttctgatggctccagatattccttggcagcataactccaatctctgtctatgtcttcacaaggcat

SEQ ID NO: 18866 - DNA, 779 bp, Homo sapiens
ctgccgatctggctttattttgtgtatttaagaagaagacaaagtcatgttgacatctttctcttaccttatatcagaaaacctaaaacatttcgatttccacttaataaacataataaatagaatagttttaaaaggacatttacattctttacatcatagaagatatttcagtgacaagatataattctatgcatcaagtaatgacttgagtaacaaaactattaagtattttatttatattcatatatttatctaatatgaccaacatattttatagcaacatatttattattaaataatgattaatatacttagacattgagaattgtatttgttcccacaaaaacattttaaaaattgaatgtttaataaaagagtttcatgatattatgatgtcttagtttcctctttcgtcaaatgagaatattggacttcacaagctgaagtgttctcttaattttaaaagtgagtgatgccaatgtagatactttactgagagttatcatgcaggacaggtgttccatttaacctctctccctttagtattccgaggttttgataaagataatgatggctgtgtaaatgtattggagtggattcatggattatcactgtttcttcgaggatcttactgatagcatcaaattcatgatttgttattttcttaaaaagattgctttgaagtgtttgatttgaatggtgacggattcatttcaaaggaggaaatgtttcacatgttgaagaacagccttctcaaacagccatctgaggaagac

SEQ ID NO: 18867 - DNA, 918 bp, Homo sapiens
cttgcccaacagaaggtggaaaaaatcactgaaagtaaaaataaactggcctatgaaaacggaaaactccagataaaagttaaacagctagaagaacaagtacagtcttttactgacaccagcttacagaatgatcatctacgcaagatgaataagtatttacagactaaatatgctcaggtgtgattaatatctacaaaagcggattgctgctatatttcgtttttaagaaattgtttgatgtctttttccccactttaccacacaatcccagaaagataaatatgctgtcacttgactcagtctaacaaactttttttcaagcacctagtacatacaaggttctgctaaagcctcaaaaattgtaaagatacctgaagcaggattgagacattcaactagcttattataggtaggaaatgtactccataaactttattagagaatagaaagttatgcttttaagaaaaaatagattgtattactgaacattcatagggagcattattatgagtagaagcagtgagaaatgctttcataaaggcagtgctttttaaaattttggcagttgtgaggaacaagtatctttgttttttgaattaaaggcaaactcagaactcagtgccaagagggtacacctgcagcaggcagatgctcacctgaaagaagtattggtaatgaaagtgcttacttgtcagcatggtggctcttgaagctaaaaacctttcatagttcacataatattttaacgaatgaatagaaaaagttaagcaagataacaaaaacatttagtgaagaacataccccaggaaggtgttaccagaagaaagtgactcatttcaattatttacaaatttagcactcatatcattaggttattttttaaatcattaactcttaataaaagcagatcggccg

SEQ ID NO: 18868 - DNA, 425 bp, Homo sapiens
aacacgacttaaaagtggcttcagaggaaaagcaagaaacgcttgaaagaagtgaaaataaacagccagaggtgtcaaagcccacagaatgtagaacacccagagtgaaccctaatgtgaacatggacttcggatgatgatgtcggttcatcgaaacacccagagtgaaccctaatgtgaacatggacttcggatgatgatgtcggttcattgaaaacacccagagtgaaccctaatgtgaacatggactttggatgatgatgtgggttcatcgattgtaccaaaaatgcctctgtggtacaggatgctgacggtgcggaaggccacgagtgtgtggagcaggagtatatgggaactctctgtaccttccacttaaatttgttgtgaacctaaaattgctataaaaaataaagtctgatcggccg

SEQ ID NO: 18869 - DNA, 1159 bp, Homo sapiens
tccgggcgcactcttcgtttattactaagatgaacttgaaaacttaaaaggaaattaaaatataaatactacagagtcacataagcctagattcaagtcctggctctgctttttaccagatctttttcctgttatttaacttctgagcttcaatttcctggggctaaaatagtacttgcctcataaggactaaatgagaaaattcctgaaaagcatttattacagtgtctggtgtattgtaagtagtctagaagttcgttattatttttaactttcacttataaatattggaatattagctgaaaggaactctagagatctatttcaatctccttgttttacctctataggaacttaggttcaagggaatttacgttgcttgtccaaagtaaaacattttaaaaagtcttgttaaggatggtcttttgccctatgtggcatagaaatttcagttaaatcttaattacattcattacttttagtaaataaaaattaagaatctagaagaatagccaaggttacctgaaacagatgttcctgaattcttctctcctctcttatgagtatcactaggagccagtttataagtcaagtacatgtggggttggtacctttcatctgcttggtcattgatcactcatttggtgattggattcttctgagtgtcaggccctttagggaaaacagctgtgattttttagaagctccttttaagcttttctgatgctcaggctcatcctgtccattctatttcagtgccatgaatctggccaaatttgagaaaggccccagggaaattttcatccgtgcatgtaccatgtactgtttaaggcgttgcggatacatcagtgagcaagaaaggtcccttcttcccggagcttacagtctggtggggtaagacaagcttgatttctggagataggtgaaaactgttagtcatggacataatttgggaagtcctggacaccatattacctaaatgaggctgtataagtaggttcaagtacttaacaagtacttccagtctttctggaatctccacccatgctgtttaccatgcatgaatcggcagagcccagttaattttccagcgattccggtccatagttagaaaatgaggacttgttgatgcccatactttcctcatactctacttctt

SEQ ID NO: 18870 - DNA, 895 bp, Homo sapiens
ctgccgatcgtcgtttatttgagggatctaaaaaagtcaaactcatagaagcatagtgtggttgccaggagccaaggtgggggtggggcaatgaggagatgttggtgaaagggtacaaagtttcagttagacagggtaaataagagtgtactcttatacagcatggtgactacatttaataacaatatattgtatactttaaagttgctaagagattagatcttacatgttcttacaacaaccaaagtatgtgaggtcttggatatatcaattagcttgatttaactatttcacaatgtatattatatcaaaacatcacgttatataccatatatgtacaatttttatttgtcatttatatgttaataaaaaataataataagtaatctgagtctttaagaaaaaaagaaaattatctttacaggataagttttcagtttaccaacaaaaagaaagatttaagcagaacttttacttatctctggaatatctttttatcaagataaggagatgaaaaataaattcttcatggaaaccaatttcaaaaggctataccactcttttacaggaaatactgtttcacaccattacatgtaataagaattgattgtaaccagctcagtttggtaatacaggtgcgatgttagtcgcaataattacttctgacactgtcacaagcattaaaattgtttaacaaatatttcacaattggaaatattattctaataagtggattttcaccaaatttcctgtgtatttcgtgaactgggccaaacgcctagatgattctttttcccataaaattcaattgggaggggacaaatatttcgttacaagtttttaattaggttccaattaaagcacaaaaacttgtatgaacatctaaaaagaaact

SEQ ID NO: 18871 - DNA, 903 bp, Homo sapiens
  misc_feature (1)...(903): n = A,T,C or G
cagtggcttgaaaccaataaatagaacattaatgaagaatatgagatgaagcaagttccagcaccatcacaggcaaccaaaatcctcgtgtaggagtttgataggtggcagattctgaaagctgagataatgtttgtgctcgaagtatatcccaaacgactgcagaaaagtaaaatttatttaaggaaagcctaaaatactacaaattttagcagttttgagataatttgcctatagaatctctatttaaaccaacacaaatgcccaacaacgatacactggattaagaaaacatggcacatatacaccatggaatactatgcagccataaaaaatgaagagttcacgtcctttgtagggacatggatgaaactgggaaccatcattttcagcaaactatcgcaaggacaaaaacccaaacactgcatgttctcactcataagtgggaattgaacaatgagaacacatggacacaggaaggggaacatcacactctggggactgttgtgggaggggggagggggggagggatnnnnttnngagatnttcctgttgcttnntgacgagttaatgggggccacacaccaacttggccgatgttttcctatagtaacaaaccttgccacttgtgcgaactgcacactaataccttaaagtttaatggtaattacacatcacttcaattaaccccgatgccgcgccctccactttatgtgagggtaattaataatcctccctacctacttcctcgctacgggcgtccgcctccgcgacgcgctctagctcacttcacggcgaacatatggtctccccacaatataggagacccgacggatcacctcgtactagaagccacataaggccgtacctcttaangcgtgttgttgtcgtatccacaaccct

SEQ ID NO: 18872 - DNA, 740 bp, Homo sapiens
  misc_feature (1)...(740): n = A,T,C or G
tggcttgaaaccaataaatagaacattaatgaagaatatgagatgaagcaagttccagcaccatcacaggcaaccaaaatcctcgtgggggaggttgataggtggcagattctgaaagctgagataatgtttgggctcnaagtatatcccaaacgactgcagaaaatttttcagaaattaactgggaagatgaaattttctgctataaatatggcggcaaatgaaagaatgatgacactgttgaaaaaagtgggtggtgaaataaccacatggctggttctgaacatttacaaattattgccaggaggggtggtttcccttttgggcgtcctggaaaggccttagaaatttcaaagaggcttgggctcctggttccaaatataccgtggcaagctcttccgtttgggggggtggaaaaacaaaaaattcttttttgttgccccaccccaccctacctttatggggaaaaataatgggtttttgtttaaggaaggccttggaatcaaccactggtttcctttttaaaatgggatttgggggctaatttaaattgctggcgtaagtgtaaagtgttaaataattcaaggcggggggtttctttaaggaggggtaataaggaaacatcgtgaatgaattatgagcggagggctatagatgggggggggtggatgaatcgtcgaagggggggtatgttatccacaaaataggggaacaagtgaagggggggggggagggggggg

SEQ ID NO: 18873 - DNA, 756 bp, Homo sapiens
tacagtggcttgaaaccaataaatagaacattaatgaagaatatgagatgaagcaagttccagcaccatcacaggcaaccaaaatcctcgtgtaggagtttgataggtggcagattctgaaagctgagataatgtttgtgctcgaagtatatcccaaacgactgcagaaaagtaaaatttatttaaggaaagcctaaaatactacaaattttagcagttttgagataatttgcctatgtaagctgatatgaaattaatccattattcaagtttttcagaaattaactgtgaagatgaaattttctgctataaatatggcagcaaatgaagtaatgatgacactgttgagaaaatttggttatgaaatagccacatgcttgttctgacattctacaaatattccatgaggttgttttccatattggctccctggaaagccttagaaattctcaagaagtcttggctactgattccagatatccgtgtcaaggtggagcaaagtctcttcctcttgttgactggaacacagaaaattactatcatctgcaccaccccaccctacctttatctgtaaaataattgctatatttttatgatgccattgtaatcaaccaactgtatcactttttaaaattgtatctgaggctaaatataatttactgcctaaaatttaaatatattaataaacttagtaccgtgccgaccccgcttttttttttttctatattattatatataatattatatataaatttt

SEQ ID NO: 18874 - DNA, 293 bp, Homo sapiens
tttttttttttttttttttttaagtttattaatatatttaaattttaggcagtaaattatatttagcctcagatacaattttaaaaagtgatacagttggttgattacaatggcatcataaaaatatagcaattattttacagataaaggtagggtggggtggtgcagatgatagtaattttctgtgttccagtcaacaagaggaagagcttgacacggatatctggaatcagtagccaagacttcttgagaatttctaaggctttccagggagccaatatggaaaacaacct

SEQ ID NO: 18875 - DNA, 877 bp, Homo sapiens
cctggacggcaactcgttttattatctttattgtaattattattatactttaagttttagggtgcatgtgcacaatgtgcaggtttgttacatatgtatacatcggccatgttggtgtgctgcacccattaactcgtcatttagcattaggtatatctcctaatgctatccctcccccctcccccctcccacaacagtccccagagtgtgatgttccccttcctgtgtccatgttttctcattgttcaattcccacttatgagtgagaacatgcagtgtttgggtttttgtccttgcgatagtttgctgaaaatgatggctcccagcttcatccatgtccctacaaaggaccgtgaacctcttgattttttatggctccaaaggatcccatgggggactatgtgccgggcgttcttaatgcaatggtatccgttgctacggcatttgtgttggggagaaagagagattctctgggataacgggagtaattccatatcaagctgaacataggcaaaatgatctcaaaactgggtgaaactttcagactcgaagggtttcctaaaaaaatttcacttttctgggagcgatggggatatacctccgacacaaccattttctcgagctttggaagccggcgccgatcaaacaccagagaagagattttacgttgccgggaatggggcgggaactcggcacaatataagagtcagaattaacggggctggtgagagggtacagggccctgtgggccgggattactaagaacaagcagtggaggttgagggcgggaacggtcgggtcagaggccgctgctcccggggcatttgagctggagcggtctgcgtaggcacgaagaggccggggatacgcggtgttg

SEQ ID NO: 18876 - DNA, 997 bp, Homo sapiens
tgggcttgaaaccaataaatagaacattaatgaagaatatgagatgaagcaagttccagcaccatcacaggcaaccaaaatcctcgtgtaggagtttgataggtggcagattctgaaagctgagataatgtttgtgctcgaagtatatcccaaacgactgcagaaaagtgctcccttgcaggctctgaacctctgggatccaacaattaactcacacatagagaagctgaagacttgaggttgttttccatattggctccctggaaagccttagaaattctcaagaagtcttggctactgattccagatatccgtgtcaaggtggagcaaagtgtacatctgctttatcactcaaatggctcattttataagtgaatttattatttgatttattttctattaaaacacacatacaaacatacgtatgcaaagattcataaacagattattttgtgcttttggtgattgttttatcattttaataggcaataagacatattagcaagtaacagaactatttatgaaaacaacctagcacaacattcatattatcgaaagatactgtaattgcccctgagaaccaaagtaaaatatatcttatcattctcaaaaaatatatattaataatgttagagtaggatatagataacatcagactccaaacattgattaggtgcttttatcttgtgattgcagctcttcctcttgttgactggaacacagaaaattactatcatctgcaccaccccaccctacctttatctgtaaaataattgctatatttttatgatgccattgtaatcaaccaactgtatcactttttaaaattgtatctgaggctaaatataatttactgcctacaatttaaatatattaataaacttaccagtctaaaaaaacaaacaacatttatagtatttgttaaattcgttctctttggcccctaatgttggagctctccggcccattaacttttattgcgggatactccatgact

SEQ ID NO: 18877 - DNA, 331 bp, Homo sapiens
aaatcgaatgcctgtcttgaattcatgtgaagcacagaggtgccagatctacagtataatgaagaactaaggctgcaaatgcgggaattgaaagaaccatctttaaggaaaggatcaccactccaagatttaacaaaaatataaaaacaccttccgtgttgcttagtctcaaagaaagcctgcaaatatggatactgaataagctttctcaaggattcttctaaatccagtcccatctctgtgggacgctcatccctgttggccatttccatctgaatcactcctcctcctgagtttaataaagcacacgcggcccgtataactctcaaaa

SEQ ID NO: 18878 - DNA, 1182 bp, Homo sapiens
tgcccactttgttcatctctgctcactgggggagccaggacacggatccaggttttctgactccaggtctcaggcttgctccatagcgccacctgctggtgacggcaatcggtaggcacccaaatcaagactcagatttcctcatctcagaagttgtccacttcttctccgacctccacggtaactcggaaccacaccgtggagttatccctgtgtcctctttctcggaagttccacatccaacccctcagcaggtctcagcggcactctcaccacctcctctgctctgttcctgtttctcttggatggccgaatgtttcctaaggagtgtctgctgcttcacgcttgccccctggagtggcatctaaaaggtgcaggataccctacaactaacaggcatgatgccatcaagacatcttgagcctggctacctcccgtggcctgtattttgtccacaggaaactcgcgcagtctcactacagcaaattgaggtggtatggggtgcctgctgctgcctctctcttcacctttccacagagggctgccccagcctgactcccacttccagagtttctccagccaggagaatcctgaaatctctgtaaataagcaatccaggagccagagaatcatgggatctcatataaacaaatcatcaaggaaaaacacagccagagtctccatttggtaaacctccgtgactggggatccccggccacccagaaagcagtattgcctgccatgcatgtcatcactgatttttactgctgcagcagactccgtcagacctgcctgctgcttcagcgaattgttcagtgcacaccaccagctacctgctgtaagcattcacactcctctacctgcctggcagcatttctcagctgaacacaggccaggccagaagtgccagggatttaatgcccttagaagtagctctctaccaatgacaaatggagctggtggatacattctcagcttcctcccctctcaggtggaacagccctgagatgtgctctatgcaatctcccacaagtccccagcaggctcaagctcccattgtccaaccctggtaacctgctcattgacacccctgtcttgccttcccttcctggcctcactttctcactctcttactgttgcctcctgagatcgcatccaaaataaatgacctgcacccaaaaa

SEQ ID NO: 18879 - DNA, 873 bp, Homo sapiens
  misc_feature (1)...(873): n = A,T,C or G
atcctgggaggctnganagcttgtcaaggagcacagacccacggttttccgccccctagggtccaanctntttcctggacatnatgcatgcaatgtcgacacgccctccagtgtntgtggcgggnaaaggatgtttattcacccccagacctttcgatcctgtgctgaaagtgtccctcagcctgtttccttgaaaaacccaagggctttgagcttattactcttgctgtctcttggggcccacgcggtcaagcttcaactaccgtatccctcattgaagggcgacctcttgttcttttcttcctggcccgtggcgctcaggcggggggcttccggcccccttctttgtctagtgagaggcttatagcctccctgatgctccgcgggggtgcggttttcttctttggccgtagcgcgtaccacctctacaacagtgggggagaagagatgttcttcacatatgcgggggagtctgacctggggggtcggatgagcgatgtgcgggcgggttgctggtccaatcctgctgcccccggggcttccgcgtgcggggtggccgcagcgtatctgcctcccgcgcggcgttggttccggtacgtcgctccggtagagtcggggcacgggcgggcagtgcttgttcggctgcggaggagcgtctagcctgtgcgcaggcgagttgtgcgggtggcagggcaggggcgcgatgngagggcacggaggcggcaagagaaggggcggatggcggctgggcggctgggtgggtgttcgcaccgagtgctttggcggtggagttggttgtgtggttgctnggcgtgcgcggttggtcctgcgcgaatgcactggtggacggagcctccgttgcactgtgaggcg

SEQ ID NO: 18880 - DNA, 736 bp, Homo sapiens
  misc_feature (1)...(736): n = A,T,C or G
gtgaccaacggacagtgacccaccgcgagagataggcctangatcnncactgtcttactnaagatactcggactangtggaaccgttctgntancttnancatgtgctcnctctgcgtgattagtgcaanaanactcccttccttatgcntactgngatagnttagtgnnncgnggnnggngtnnatttggnttananngctgtgcttacctncccatgcangataaantgatcccttcntcctcattccctntgggtgggaaccatccnttacttgcggacactagacnttanancctntctantngcaccatcacccttnanaactntcagnnatttgtcatgaatgttgcatgacaacannnggccaataaaaaggancctttctacatgcnantttgggttnanaaatcgaggggtgggccatagatgcctctaccatatgacctgngntaacnctaaaagtctctcgntntnttggntaaangggctncnaanaanactggtttnttnnttttnccttnanaaaaacanggncctnnaatnttttaaatggncggttntcnatnnttnatnaannatnntncaaagtggnannntnaangatctttctttttngaagaaaaacgacaccgggtgnganangggagnttcccnttnanggnanccnnttnnccnnngngangnnanntnnnattttncccttnnngggnnntnaananannnganngatcgc

SEQ ID NO: 18881 - DNA, 176 bp, Homo sapiens
  misc_feature (1)...(176): n = A,T,C or G
gggttcgttacaagttgnagttgaaaacaagaaaaaacttgcttttggcgccatcaaaaaggaaagccagatactttcctttctacaattgaagccatttactactttctggnngactaccatactngatatattaaaaaaaaaataaagaacttggcctcgntggcctnannggg

SEQ ID NO: 18882 - DNA, 826 bp, Homo sapiens
cctttgatcaccttggagggaagcatatccttcatatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggtgagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagctccatgttcctttccatgaagatgccagcactgacacctaagatgtgttctgctagaaaagatagtaagaagcaagcaactttaccaaaatagtgttcacagcatatataatgtcctttagaatatatgtaacaacttgtaatcttttgaaaaaatacaggataaacacttctacaagtggtgtggaaaacatctaaaatattgtcaaaatctgtcaacagtttcatactcatttcagtagaaaagcacatggttctaattgagattattcttatatgcaatgtaaattttatttagttttgttttcttatgcaaattttttctcacaaagcatgtgttcattgttgaatgtcctttgatgcaagttaaatatatgaaacgtactttctgttaccagataatttttaaatttaaatttccttcttaaaattttgtaaataaacacagatgcaggccg

SEQ ID NO: 18883 - DNA, 468 bp, Homo sapiens
cctgcctgcatccgctttttatttccttcatatggtaacatatacatccaatatgtgctccccttgcacatctattcacaagtgacttccaaatgacaactgctttgatatttaagcatgtgctaaaagttatcttagttgagatatgaaaaatgctttagatggataacattctgagtatattggattagtcacagcagaatttactttagttagatgagttctacaaatttaaagctttgaaaagctactacttttacttctaatacatccagatgaacacgatgtagcaatatcagcttgtattccagagaaatctcattagtttttctggtgatggaaccacttatccacgtctgttggtactgtgcaggcagattcacagggtggtggtaaaacatccgcgaatggctctggcagcatcaggatcacacttgaaggggctctcagaacaaagttgtattcatg

SEQ ID NO: 18884 - DNA, 1173 bp, Homo sapiens
ggaaagtcttgcccgcaggtgttgatgacatacttccagggaacttcagaggccacaaggtcttccaggcagttcaggtcagcctggagcctggagatccccccatagacaaccgactccttcttggaagccagaaaagcatttgggaagcagctgagtaactgtttcactgcacctttaaaggcatccgtcgccttctgatccaggtgcacacagtagacattttggggcatataaatcgccctgaagagcctctcaaaagtgccgaagtctttgtggatggtcactgtgtaagctaaagggaacccagcctcttcttcagagagtgtttctgttacatagtggcttcgaaccatgtactcatagcaggtagcttcatcaagggtagttttcaatgcattttctgttgggtaaaaaactttcccctcaaaaatctgatgacaggcttctgctaacagtgaagcatcggacagagctgccctcaaaaaaaggtttattctcccaaactccagttttgtaaacaaaatcaaaaatcagggcagagataagggccgcgctaaaaagacagtgctttccaagagcccatcattcaacaaccaggaaatgagtaaaatatctctctcttgagataggatcagagtgtagatatatttaacttacattttctccggggtccgaaatcatcctcgtgatggctgaagctctcgtctggctgttccctgtcccttcagttcacggttctggtcctttttctttcttcttcccctcttcacttaccactaggttgcattttcacttttccgtgacacatttctgaagtggctcctttgcatttggcttgcctgttctcctgctaacctgcaacctgtgtctacacaaaaacagatgtcctcagagaggttctgattccagggggtccacctgttcccaccatgaaattgcaagtgggtgaggtgaccattctgcaagtcatcggctctaagaccttaacctcagcctcttgtcccggccagagtctagtaactatgtcccctcccctgcttcctgttaatcattgtgttcaacagcctgagtttatttgcttaaactgcactgccaagctacgagcttcagtttaaagcatgtgaatactgcctggagagatattactatcaataaatgtagatcgggaag

SEQ ID NO: 18885 - DNA, 787 bp, Homo sapiens
cctgtgaaatcttaaaggactacacactatactgaaaatgcctagtggaaaaaagacgccatgactaactgattaagaatccacagcagagacacttttcaaaagaagacatacaagtggccaagaaataaatgaaaagatgttcaacatcactaatcatcagagaaatgcaaatcaaggccacaatgtgaaaccattttatagcgaggcagaatggttattattagaaagtcaaaaaaacagatgctggcagtgatggggagaaaagggagggtttatccacgattgggggtaatggaaattacttctgaccctatgcagagcagttctgattcctcaaaaaacaaaaatggatctacctttcaacccagtattttcattgctgggggttaaacaaaaagaaattgtattgttcttcccaaaaaatgacacctgccctcttgtgcttattggatcactttctacaacggctaggacgtggatgggccccatggtcctcattcttagaggtgttgattattaaaaatcgcggtcccttattctcggtcggtgtcttttggggaggagtgaaaaaaaatgaagtttattgtctttctcgcgctttttggcccgcccgcgctctgttcgcgtgtcattttgtcttgagaagtacaatatccgccccgattcctccatttttattttttgattttacctagtcggttgtatgtatcttatagtgcgtcacccgccattctgtttttttgttaaggccgtaaatcggggcagtttttggggcttttgcatg

SEQ ID NO: 18886 - DNA, 1030 bp, Homo sapiens
cggccgcagagctccaccgctgaggccaacgaggccaggcatttattgccataatctgtgagaaatttcatcaactatagaaaatggagttgaatacacaaggaaatttatatcaaaggattgttgtaagtaaaagatggaaagggaagtagattcacatgtacaaagtactatggtgctgttaatttttttttttactctttattcttatttcagattcaaggggtagactttgggatttcatgtgtaggtttcttacatgggtgtatttcctaatgctgagatttggaataggaatgatttcatcacgcatgtagtgaggaatatccaatacttcgttcttcagcccttgctccactccatccctccttctctgatagtcccccatgtctattgttgccatctttacatccatgagtacccgatgtttagctctcacttgtaagtgtgaacatgtggtatttggttttctcttcctgcattaattaacttacgataatggcctccatccatgttgctgcaaaagacatgatttcattttttttcatgactgcatagtatcctatgatgtatatgtactgcattttctttatctaacccacttttgatgggcacctgcgttgattctatgtctttgctattgtgaatagtgctacaatgaccatactagtgcatgtgtctttttttggtaaaacaatgaattttctttttgttatataccccacgaatgggattactgggttgaatgtgagatccattttagtttttgaggaatcaaaactgctctggatagggtcaaaacttatttacattaccaccaatggtggattaacccttcgtttgtttcaaattacttgcagcacctctcttgttgagcttctactaatacacttctgactagctttagatggctagcactggtgagctggaagtccttcctctgatgatagggatgatgaacacgcttgcagtatttcgatggccgtgtgtgatctgcttccgaagagattatgtgcggatgttattaatt

SEQ ID NO: 18887 - DNA, 279 bp, Homo sapiens
cggccgatcctgatttatttgaaagattattatcttttgccccagagcacaagctgtgggagaaacaaaatgaccaatttcaatattattgacattataaacatttatactgaagacaaaccaaagaataacttagagtgttaaatgtccattctgttatagaagagatggcctttctcttttttcttcgtgttgaacagggaaattttacatgggacaatcatggtggaaggggaagcaaatacatccttcttcacatgtcagcaggaaggagaagtg

SEQ ID NO: 18888 - DNA, 834 bp, Homo sapiens
  misc_feature (1)...(834): n = A,T,C or G
gtattctggaaacactctcttaatttttcaccgctacancnttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggttttaacattttctattcnatcaattcttgacctaacaattgctctggtcatggcaagtgtacaactagtgtctctgttccaagccaagtctatcgcgaatgtngatcaatactggaagggtgaacctcgcgatattcctttactgtaaagccaatttgcggtactccacatcacgcttactgtgacctgactggacaaaaatcatcgtgcctgcaatcatcacggtgcaaggcaagcatgtgctgtgtagaggcttccgcaacatgaaatactatcattattacaccgaattcaactacccgccttacgcccgccatttaaaccacaacatatatttcacataaacacgtggaccccgcccaattatcaaatataatatagcccaatatatcaacaccacgtaattaaccaaagcaaccgagccgcacactagttcctttgttatattattatttcccccccccctcactattttcctctacga

SEQ ID NO: 18889 - DNA, 799 bp, Homo sapiens
cggccacattctgtctttattttcttacttctacttttctatttaaaaaacttgtaaagaaaaaagaagtaaaagactaaagtcctcataatatacctgtattcattggctaggactgctgtaacaaagtactacaaaccgggggccttaaactacaaaaccgcatagtgtcacagttctggaagctaaaagtctgaactcgaagcgccaacagggatgaaaaataattttttttgtgaaggggaatatgacccaggcctacttacttggaatggggaagaccatgtcgtccccgagccccttcccatggtattacgtaagtgcgccccctcctctgcctccgcgcctgtgcttctcccactcccccaccgccgtcgtccgcctcccttcttccctgatccacgcccctttatccttccctcccgacatccccgccccctcgcatcccgcgtccacctttcttccgtccgccccccccccccccccccccgctcgctctccccactcccacccccccgcccccccccgcctgccccccgccccgctagacccccgccccgccttctccccccgcacaccgccctcgtccacgcccctcccctcctatgcccccctcccgcccctctcaccttcctccactaaactcctcgtattcctgtcccccgccgcagcactcatcaccgcacatcaccacactctctctctcgtggcgcccggctccctcgtgacggccctagcgcttccctacccgcccccccccgtcgcgccgcaacaccaccacgaaataaaagacaaaaaa

SEQ ID NO: 18890 - DNA, 955 bp, Homo sapiens
atctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatctaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccaccaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagaccgattccggccag

SEQ ID NO: 18891 - DNA, 399 bp, Homo sapiens
aagaggaatcaattctggaccggaggatgtctccctgcctttgccctgcctgcctccccccacatccttctctggcaaggggaatgaggctgagaatgacctccatccgcaggacgagagcagattatggacggcagagctgtaccttgtgattgaacagaatctgatcaggaaccttggcctgaaagctcggcagactgaacgcttcagtgggatgcagctcatttgaagtcatccagacctcaagagctcctttctcctgacctttgacgttggctggtgcctggtgtgcatcatggggagttccccaaggacccagatgcctgccactgtgccatcagggaggtctggcctccaaaggcctgggcagatcctgggagagagggaaaaaaaaaaaaa

SEQ ID NO: 18892 - DNA, 760 bp, Homo sapiens
tatagaggtggcataaatctggaggttctgcaaagtcttcccagaggtgaagtattcaggctgatctggaactctggctggataatggagaagagcaatctgggcactgttaccactgggcagaatgacatggcggccatgccctcttcataatctcttgttgtgatctatcactgggacagaaggaagatgaaaacatttacttcagactgtttactactgttcgattctatttttcctttgattttctcttctcagtcataagtggaaatggaagggattcattcaaaggtaaaattctgagattttggaggaagaagttggcccatagaagaatcatccagttagaaccccaagatcattatttggggcatctaattattaatgtgggatgctttataaagtgtgtatgggggtcttgaaagataaagcctgtgcctctctcagtgaattcttaaattttcccttccttctgcattttgaatttgaaccaagaaaatggaacaacattgtatgtttccagtgaagataaaaacatctgttgaatatcttgagtctagaaaataacattgaaaatatagtggttgaggaccaattcctcatcctgaagtttacaatgtaatgaaaaaaaggaaatgtataattttaataaaaatgcatgcattgaaatgtggtgagtatgaacatgtgaagataaaatttaaaataatatttatgaggatgtactagttaagtgtaataaagaagtatcccgtcaggc

SEQ ID NO: 18893 - DNA, 660 bp, Homo sapiens
aaagaagcctcagcagtctccaaggaggtatgaagttggatcacctctgcccatttcactttgctgatatgaggatatattgagagagagagagtgcatgtgtgtgtgcatatgtgtgtgtgtgtgtccagaccaacaccaggcataatactacaacaagatacgtcttgtgctgctgggagagcttacactatagtctgaacttctacagagccttttcctactgtaaacctcactcaaaaatgacagccttccatttcacaagaatcagagtcttgctatgttgcccacgtggtatcaactcctggcctcaagtgatcttcctgcctcagcttaccaaagtgttgggattacagatgtgagccacagtgcccagtctgtgtgtgtttttataattggaagtacatgacatcttttacacaatatgcaaatgcatattgaggaaggagggagagcaactatgtctaaaagtaatcacaataagtcttgacccattaactgtacagatcaaaatccacaccaattttagattcagagaacactatgtctttttaaaaatctatttagaaactacttacagtattttttagaaaatgcacaggaacccctgttaagaaataaaatattccttgcaatagtttgctgagaaaaaaaaaaaaa

SEQ ID NO: 18894 - DNA, 1027 bp, Homo sapiens
  misc_feature (1)...(1027): n = A,T,C or G
aaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcagctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacagtgcctatgattgggtctgaaaggctggccttgctcccagtngtttagaaaagcagctagatgtgcacaggtttcctgcgggtgacagagaggccagcgcagcgcctgctgttcaggagcgtctcagaggcacacgagagcctgttggctgctcgcgcagagagcgcatgtggacacctggacagccgcgtgacttggaagcatgggagtttatcctctcaagggtggtggatgagaccaagaatgcgtcagtgttcatccacttctgtgctaacttacaagtttctttctcttatgaggcactgtgctgttttagaatcactttttatcgcataataaacatgaacagaaatataactgagaaatggagagaaaaattcaatgtgcatcaatttgtcctaggaactagtttcaaagaatttagatttatgaaaagcaaaaagtaatgagtaaatgatctaatggaaattatcccattcaataaatagctaccagttataataaaggaaaataaaattcataaggtttagagcaaggtgatccagaaactctccaactaaaatttcctcttgctgaaaatgtccaaaggattgtattttgtgattacctcagattgctgtaaactcttttttgctgaataaaactgtatgcgcaagc

SEQ ID NO: 18895 - DNA, 1077 bp, Homo sapiens
acacacaagcctaaaagatgaacgatacggtgtttatacttctccctaggaagagccataggccttgggccccatcaaggactcttcagtgtttgaattttaagatttgcctccagtatgaaacgagaggactttgccttcactactcagcttgaagaaagaggaagagatttatttggggtggagaatgtgaagccatcccagtgactgcctcttccacaaattgtctttctgttccaaggcaatgacctcagtgttgtcaactaggaggcacctgagctagtaaggagaagccaagcaagagagagatttgcctcatccccactggttaaatagtttgctcataaaaaatttcggaaatatatttattaaggataactatgtgcaacagtttctaaaatgtcatttgggatgttgcatgagtgatcaatgttagggtggcatgaaaatcctgaactgtagctagcaggctttagcagctgaaggcattttgtttaatactgtaaatacagtaccagagtttaacctgcattgacgattattttacagcctgacccatggaccacagagtggttaaaagcaagggcattagaggcaggtggcctgagggttcatgtccttggtgcatcatttacaatctccatgaccatgggcaagttacttaacttctgtaagctttagttttctccccataagttaaaataaagctgtaccttccttatgagtttggtaagacaaataccttagacagtgcatataaagtaattaacaccatgccttgaatgcagtagttgctccaaaaatattaattattgccactaccattctactatcattacaattgttattttttcatatatttgctcaaaaatacagtggaaatgtaagcatgtaaacgttattgtgttcagtataatatacaaacattagcataagtaattcctttctcatgagcttttgcagagatcacctgctaatgaatgtggaaaaatagaaataaatttagaacatttctgtagaatcaaagttattttcaggttctctaacacttgaaaacaataaaagctgatgcggccg

SEQ ID NO: 18896 - DNA, 826 bp, Homo sapiens
attagctgttacaaaatcttgagcatttcttaagattcctcctagaaaattccagaagtcctagagattattttaaatatgctcattattaacctcctagataccacttagcacctgtcatttttctctacccctgtttcaacggctgtagtaatggcttctggagaaatggcagaatcaatgagaattagccaaaccaattccatgaacaattccggtaagtcatgtcctctccatttctgcaagtcaggattaggcttgcttcagctcacactccagtgctccaacaaatagagaaaagaaacattcctcatgcctcttgaactgccctgctgtaaaatccatatgttgaaaacatcttaaggcactccaataaaacaatcttcttttttcaaatgtgtaagtattatgttgaacaactatggtctaggttgacagagagaatatatcttaagagggacagacctctgaatggtactgctcttctccctctgcccagatgacatctccatcctcccaactggtgcaagtgtgtggaaggcatggatgcagtcaatattgaaagagatcacattctaggagtgtagtgattatagcatgttcctgcatgctctgggtgagatttgcatttttgttcatcaacaatgaagctcagtatcattctttgaaagattcactggacaccactcttcaagggcagcaagaaagatgatacatctttcctggggcactggctaacactggaagaggctgcttaggggctgaggggctgagtggtgctcttaacaacatcccaggaataagcagacagaagctggaggccagg

SEQ ID NO: 18897 - DNA, 907 bp, Homo sapiens
ggaggggctgttgagtacaacgtgcggatatcccaggaaactgtggctgcctgaaacgaacaatgaaaagaaattgagtcctccggcttagaagtgtcgagcagaccagcacactgaacacacaaaagatctctttaatgtgtctccactgaagcaaaaatgaattgatcaaatacaaagaaaactgtaaacaatcatatttggctccaaaacatgtctcatctcctctaaagaggtgaggaccaaacattctacatatgggaagatgtgagcattaatagaaacgaggtgctccaacaatataaagacacctactgcaccaggacctccccctggcaaagactctgaggtctgtggtctgagtttaccatccaagaaagcccagtgaagagggttgcctgctgcgaggcctgcagacatggtctagggaagagaaatggactgaagagcggcccagcactgccagctctcaccggctccataccacctggctgcccgcatttctccttcagggccagcctcattcctgcacagggcctttgcccatgctcctctgcctctccaaaagtctttttctttcctcattctttagaaatctcaggttttgtataggtgccagctccttttcaaaagctttctaattcatccaacacacatttttcttccctgaatgctgttatttactctctgtagcacacatgaagtctgcagcttacccatagaatattttaggccgaaaggttatgctgctgatgaattcagccggtcattttacctgtgtgttttattgtttataagcaagccacattacatctgctttgggggtaaaatataacaactgtaaaataagttttgccatgttccttattactcctttgctatgttccattcattccttttaaagaat

SEQ ID NO: 18898 - DNA, 378 bp, Homo sapiens
aaagagattataaatcttccagtgaatgaaaaaaattttcttaaagctgcatatactccaagaaaaaaaccacaaatgtttttctgttttgcctgaatacatgatttaaacaagagatttccatagaagggcgctttcatggaactatatgatcatatgggcaacattctgttgcagtctaccttctgtctgacggatatgccatcctgaaaaaggaaagaagctgaacttcaagttcctttcatttagccttggctgcttggaaggctgagatgggaggactgcttgagcctgcagcgagctatgattgtggcactgcactccagcctggacaacatggcggaacaccatcttaaaaataaaacccgttcggccagg

SEQ ID NO: 18899 - DNA, 817 bp, Homo sapiens
cctcacaatcaaggacaaattcctgaatgcaacatttgcttttccgtcttgcgcgcttcacctcactcatccctgcagaagtacaagtattcctggcttcttcaagtctacgcctaagaattaagagccttggggagaagggcactgcatcgaccactgcatctcaatcattgtggcagacgtaccacagcactgggaagctgggcggggcaagaatctcaggctattactacagagttgggaagaaggtttaggatcaagatagaggtgactgaccaagcatttctccttgttgccgccatgtgaagaaggacgtgtttgcttccccttctgccatgatcagaagtttcctgagtcctctccagccatgctgaaccaaaacatgtcccaatccctggtgttgaggattctctggggagaagactcaccgtgaagaccttctaaggctgaccccgggctctcatgtttggtgtcatgaataaacttcaaaatcatccaagctttatcatgttttccaacctaagaaatgaaagtggacaagtgaagcgctaggaataacacacttaccctccctgattttccaatagccgtcttgcattgtcagatcaaatgaggtgtaattgtgcaaatgtatctcagtacatcccattggaacatacagactatttggatatcactgaatacatgagcagttcaaataatatggttataactagaaatagtatctccagatggtaagatttcgtctataaaacaataaaccatgttgcgtccgattagtaatatgatatcggaatgacataaatgtgtcaccgcg

SEQ ID NO: 18900 - DNA, 787 bp, Homo sapiens
atggttggctgtgactatgagatcgattccaatgccaccgaggatcgctgcggtgtgtgcctgggagatggctcttcctgccagactgtgagaaagatgtttaagcagaaggaaggatctggttatgttgacattgggctcactccaaaaggagcaagggacataagagtgatggaaattgagggagctggaaacttcctggccatgaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcaccagatgtacttctggcagtacggccactggacagagtgcagtgtgacctgcgggacagatcagagatccatgtgaaaaaatggcaagacaatagtctaaactgagctcactggtatgagagccagccgactttccacaggttagtgcttagaggtaaagggactctcagagaccacccgtgacagttttgtctccaaaccagttgttgtttttttcctcccctaagcggatttgcttttacttttgccttacaatgaaaagtgacgctctgacttttagggaattaagactgacttctcctcaggaacttgaaaaaaaattccatgctttacggagggtt

SEQ ID NO: 18901 - DNA, 636 bp, Homo sapiens
tttttttttttttttttccgtcttcgtgtttatttctttcatcttttccattttacgagagatgctcatttcaacaaccagacggcggatgtgacgggagaagcgtcaaggccaggagtttgagaccagcgtgagcaacagagcaacacacgtaggagagcccagctgaaagaaatgaaagaggaggaggaggaggaggaggaggaggaggaggaggaggaggaggacgacgacaagggggggtggggggggaggagaaggaaagaaaagaaaagaaaaaaaagaaaaaggaaaacaaccaccaccaagaaagttaagattctccaacggtcggaagttgaagaccagcctgaccaagatggagaaaccccatctgtagtaaaaatagaaaaattagccgggcacgatggctcatctctgtcattccagctactcgggaaggctgaggcaggagaatcacttgaacctgggaggcggagggtgcggtgagccgagagccgccatcgtactccaccctgggcgacaagagtgaaactccgtcgtgcccacgcgtgtcatcacagcactccgggaggccgatgcgggaggatctctggagcctaaaagttcgagatcacctcgacacgtgagatgacg

SEQ ID NO: 18902 - DNA, 781 bp, Homo sapiens
aaaggtgttcacatcagtaatcatcaaagaatgcaaatcaggcctcgatgtgaaaccatcttatagcagtcagaagggttatttttagaaagtcaaaaaaacagattctggcaaggatgtggagataagggagggttaatacacgttgggtggtaatgtaaattagttctgacactatgcagagcagttttgattcctcaaaaaacaaaaatggatctaccattcaacccagtaatcccattcctgggtatataacacaaagaaaataaattgttctaccaaaaaaagacacatgcactcgtatggtcattgtagcactattcacaatagcaaagacatagaatcaacgcaggtgcccatcaaaagtgggttagataaagaaaatgcagtacatatacatcataggatactatgcagtcatgaaaaaaaatgaaatcatgtcttttgcagcaacatggatggaggccattatcgtaagttaattaatgcaggaagagaaaaccaaataccacatgttcacacttacaagtgagagctaaacatcgggtactcatggatgtaaagatggcaacaatagacatgggggactatcagagaaggagggatggagtggagcaagggctgaagaacgaagtattggatattcctcactacatgcgtgatgaaatcattcctattccaaatctcagcattaggaaatacacccatgtaagaaacctacacatgaaatcccaaagtctaccccttgaatctgaaataagaataaagaacgatcggccag

SEQ ID NO: 18903 - DNA, 205 bp, Homo sapiens
tttttttttttttttgtttctccagatggaacacagtttattactaatatataattattgtcttttcctttctctgttttctcttccttcttgttttacactagtggttcttgtgcaggtcttgttcagcgttgcgtaatcatccagaaagatgacaatggatttgggctgacggtcggtggagacaatccagtcttcgtacagt

SEQ ID NO: 18904 - DNA, 710 bp, Homo sapiens
ctggccgcatcttgttttatttggggagcaagaatttcagtttggggcatacacacagactgggtggtcttcagtatgtccaaagagcaaagagaaggttgtaggtttcataaaaatgagaaatgttatggattgttaggaaagcaagttcattagcactagcaacgttttggggatccggcaagctctgattggtgagtgggtgaaactagtcttagatttccgcaggttgtttctgtagctattagatcaaaccggtttcaggttgcaacacttgttccagcagccagggttggagacagttatactcttggagcaatgttacgtggtccaagtgctttttcctgtggtctcataactctgcttggctatgacaacagtgacctttgtatgatcaactttcacagtggccacaggagaagccgatttgagcccatgcccatgccttctggctggctttctctcccttgctcctggcagggcaatgcagggtgagtgacagaagtggactcagctacaggcaacattgagtgatctaggttccaagtatggcactttatccgttgtcttatcaacataaagatacagcgctttgaaattttgtcaaattcaggtttgagcagcctgatgcagaaattcctgggtcagggactccagggcggggatttggaggggtgagctggctgcaaagtctctggtcaatgtgggtt

SEQ ID NO: 18905 - DNA, 586 bp, Homo sapiens
gtctcaattttcctgggtttgaattcctagtctcagcgaattgggaccaaacagctggctgtcatcaccaatttgagcaacatggggccctgaaccacctccaactgaagaatgagctgaagggctctttcccaccatggatgaaccgagagagaaagaacactttatcatcacatcacttgttactcccttctgcaaaaggcaaaacctccttgaccttcacccaggccacaagattgctgtcgggatcctaataaaataaatttgatgaggcacttcagcttccttgaaaagggatgagacagatatgtcatttttattagtccaaacgtgaaagtacttttaaaaagcattctagctactgaaatgtgcgactcaactttatccagttgacattgtctatcagcattaggctgaaattagaaataagcttgtttttaatgacttgtttccccagagaaatttatataaggtagatatgtaacttattattttccaacaccatggatcatccaaataaatattatgcagtcattaaaatcatgttctcaaaaacaacttgactgacataaaaaaaaaaaaaaaa

SEQ ID NO: 18906 - DNA, 785 bp, Homo sapiens
  misc_feature (1)...(785): n = A,T,C or G
agacagggtttggctaatgccgcccaggctggtcttgaactcctggatgcgagcgatcctcccacctcggcctcccaaaatgctgggattacaggcatgagccactgcactggaccatgaaagtttgaaagaagtcgtcttatagatggttatgaagagttggaagtttctgaggaaagagagccttgttgctgaagtctgctggtatgcatgaaggcaaatagctcttccatagtgtaaattcccactggggggtcgtggtcttcattatatactggaaacagcatttggtaagagaattatccagtgttccaaatgccttgtgctgagactgctgttggattcaaaaaagaatggttttgtgtgagaatattgtttttggggctaagctacaaagggcaatccttaaaagcttttggaaagaacttggtgcaaaatattcgattggcttattttgggtttgacatcctgatggcgacacctcctcccttttttcaaggtgtgtcctatattgggttttttggaatagtctgagggtcttgagttagggagaattaacctgatttggggtgtttttttttctgtctggtcgaataggttgtttctttcgagttctacgatttcctttttttgtaagaagagtacntcttagcgctgcttgctccatatttgttaggttaggtttcgcacgcgagttgatgtaccatatggctgcgatttcgctgaaagtcattattttttgtgtgcggcttcgttttagtttggtaaattgtgatggattgttt

SEQ ID NO: 18907 - DNA, 693 bp, Homo sapiens
  misc_feature (1)...(693): n = A,T,C or G
aatagtgtttttggtgctcagctacaaaggccaatccttagagccatttggaaggaactgtgtgcaaaatcttcgattgacttatcttgattatacatccctatggcaacaccaccaccctcttccaagttatgtaccagaaggcaatgctgagataatcgagggtactcagttgaggatactcaccagatttggctgctttctctcctgcttccccagagtctggcctcttctggttttagcatcttcattttctgcagagatggagtctcaccatgtnnggctggcctcaaactcctgagctcaaggaatcctcccaccttgacctcccaaagtgctgggattatagaaatgagccaccatgcctgggctcccaattctcgaagttggagaaaacggaaaaaaggtgatattgatgatctttcctgagtcctattatgtgcctgacattgtttgagaagctgaacttctcaagggagagatctgttcttcagaccagagggaaatttggaagcccaaatagagaacagtatttctagatctgacctttagactataagaggcacctaattccttaaaatagaatattgttgcttttcattatgccatgcacatgataagggctctgtatatattttgggatgagggcaatagtattgtccatgtttctctaaaataaatctggatcggccg

SEQ ID NO: 18908 - DNA, 513 bp, Homo sapiens
ctatgtttttgctcaccgaagctaaatatacatatgaattgattccacagccatggaattgagaaaaaccaggaagtgatgctgaaaacataaatgaaactatggtattatttagaaaaaaactttcaaggaatcagttattttaccaattccaaaagaatgaaaaaagtgaagactcagaaaacgtcagatccacgatctgttgctctaaacgccgtttcttccggagaaccttaaagataaatatgcaaccctttacattctccagtgatgtcaacagcctaagctgaatttcaaattacatcgagtcaatgaaaaggtgaatggatttttagagcaactcagattcaaagaatcaaatcgcctttattcttattttaaggaacatgactgataacctgtgcagaaaataaaaaaaaaactaactatagcaatcgcagcatatgtttaacctaacaattaaaaatatataactgaaaattacaataaaaaaataagacaaaaaaaaaaaaa

SEQ ID NO: 18909 - DNA, 411 bp, Homo sapiens
ctatgtttttgctcaccgaagctaaatatacatatgaattgattccacagccatggaattgagaaaaaccaggaagtgatgctgaaaacataaatgaaactatgatccacgatctgttgctctaaacgccgtttcttccggagaaccttaaagttaaatatgcaaccctttacattctccagtgatgtcaacagcctaagctgaatttcaaattacatcgagtcaatgaaaaggtgaatggatttttagagcaactcagattcaaagaatcaaatcgcctttattcttattttaaggaacatgactgataacctgtgcagaaaataaaaaaaaaactaactatagcaatcgcagcatatgtttaacctaacaattaaaaatatataactgaaaaatacaataaaaacgcga

SEQ ID NO: 18910 - DNA, 286 bp, Homo sapiens
  misc_feature (1)...(286): n = A,T,C or G
ggttccttgcctgtatctccccttggntcaatagctaccanatttttnggaagaggangaactgaggtntcatcacattntanagcgctngggattcccatattggagaactaaaaaagagagatgaaagngacagttgggnacanttcanagccctttaaagnagtccttttnaaaaaatccncaattttgnaaataaaaanaaaacaccaaagngtttctggncntttgnaanannncatcttttttaaaancattgaagagattaaaaatttttttnaantgg

SEQ ID NO: 18911 - DNA, 725 bp, Homo sapiens
  misc_feature (1)...(725): n = A,T,C or G
aagaggaagagaccaagtactgtcttctatgggagggcatggcaggaaggcaccatctgagcccggaagtgggtcctcaccagacactgccgtcacctccgcgctggacctgcagcctccagaactgtgagaaatgaattctgctgttcatttatgggccccccagtctgtggcttttgttttatcagccccagctgactaagacaagtggtgtctcttaatgaattgatgaattctttgtgttttgaagagtcttcatggatggtacttcagcccgaggagatgcngtgtgctttgtaananatttgaggggtgaagtcgccccaagttttacatctgtaacaggctttgaatgactgttcttgcctcagtgccaccagagtcagtggcgcaagggagaatcatcggaggaaaccccctcactggtgtggaatcggagcccccttcctgcgcttggagtgggggttcagcagcaggttttgcctggcattaaacagaagcattgctgtatcttaccagacaggaatacaggcaatgctgtgaagcgtcagagggaattccgttggttactttcccatacggtcttgttcagctgcttgttctcagaaaggtgtgtttgttggtggaggagaatgcgaccaaggagaccatccttttcatgaaggcacaaacgtgaatacatatgtgtcttttaacgcctataaataaaaaccagtccggccaaa

SEQ ID NO: 18912 - DNA, 771 bp, Homo sapiens
caggccaacattttgctctcccatttgctgtggccatcacctctaatccagtcaatgagagttactgaggattcaaactctgcaatgtttcatgaggaaacaatgacaatgggccacagacagtgggccggagaggaagatttctcagctccttcacgattcctgtgacctttacagagctggaacagagacctctgcgagaactttgccttcaatacatctgatagctatatcactcaacacatttacagagggcagagggactaagaaattgaagagaaaatggctaaaaggaaaaacaaaagcatatcaagagattttataacattttgaaattcacaggtaaatttgccagaagtttggcagtagaagatattatctaaaaccaattatcctattttaatcatctacatttgtttatcaatcctgatgctgagaatgtttctcaaggaaaatagttgcaataaatccagaacttttaatccaaagagaaccctgttttagtgatttgacttaacatcccctcccaaagaacactggaaggaaaataccgagaccttggcaaaagacaccacctgccggtggagattaaaataatattaaaaagttcttctttttaaagaaaagaaaattgaggtggagggacagaagaatagatataaatttaggaaaccatttagaaatcccctggcgcgctctccttttggggggggtataaagaactcggccattgcatctgggcctagaaggtgggaaaggaaggtttttatt

SEQ ID NO: 18913 - DNA, 901 bp, Homo sapiens
tggccgagagctccaccgctgaggccaacgaggccagtaatttattttcagaatgagctagaaaattaattcattaacactttatcctcagcctcccaggaccaaatgttggactgaagcactggtgcaaaacataaagacaaacatttctccttaagtattgatctttttagcctacgagcttcggcgacaggtgtcttgctggttaacctatttccatctcattactttggcttctgcaaatacaatgccgggaaagattaaatactgtaagctgtatccagtcagctctccattatctgcattaatcgaggccagtactgagtgggataatccacagaagtgcctagtccccagatcatatttaattgatttggggtggcaattgatggtgagtgtgtgtacatgtgcgcacacacacacacatatgcttttggtgagggtgaggatcgaacttactcatctctgatgtggcatcaggatcccattttggaggcagtctcatttgggggcacaccaagggaatcccagaagcctgctataggacacaacatggcttctagtctcccgactttttgtagggaagaagaagcaaagtgagagtccaggtgttctttgagggtgaggggggcaagttcctggtggcatttctccctgcaacaatgcctcccacctggaacaagttaggcgatttccgggtgaactaccaaacccactcttttgttctctcttttggcccggtgtaggggcttatgcccttaatcccaacacttttgagaggtcaagggcggcaaaaacgtatgaggcccagatttcaagaccagcctgagccaacataaggggaccctgtctttacaaaattctaaatctaacaccgctggggacgacttttgtggccctg

SEQ ID NO: 18914 - DNA, 139 bp, Homo sapiens
cctggccggaacagctccaccgctgatgccaacgaggccagaagtttatttatttgggatgcgcggaggctctgaacggagaaagtcgtcgatgcctgcactggtcttggcctgttctttatgttccgcgcggtgacag

SEQ ID NO: 18915 - DNA, 1395 bp, Homo sapiens
aaagtcgtgggaaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagatttttacagccatcttcgacatgaacacggatgtaatcatactctcacaattcatgtactacaggttaaagaatcagaagaaaaaaatgatattccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaagcacaatctttggaatcactctatctttggtcaggcaaatgtttaaagagcaatattatatacatctagggtaagaacaattcattaatttagatgaatgaattgtcaaaaggttgttttgcctgtaaatgtgagtaaattgaatatcaagtcatcatgaaatgtaaaaaaaataaacaaatggcctcgttggcctcagcggtggagctctgcggcag

SEQ ID NO: 18916 - DNA, 291 bp, Homo sapiens
ttgtctttaatacatactatacaccttaaataacaccatgggacccatactaagttcactggtgatgctggaagtactcccaagaagcagagagaagtcatgacatttacagtaaaaagtttaattccttgatgtgtatagtagattgaggtctgcagttgtggttgcccatgacttcttttctccttactgtggactagcctcctcttagacaatgagcgctggaagcaagcagatgttcctgcagaatttcaggatcttgttgattctctgtcagatgggaagattgct

SEQ ID NO: 18917 - DNA, 491 bp, Homo sapiens
actgcctagttgcaggaaaacaagctcgggactccaacttattctatgttatgttgattaggtttctcctcgtagtgagagacatgggcaccagtaactaccagagacacaaaacctcacagctgaacctcaggtcttgcctgtagtaccttatgcagctatgtgagacggaatgatcctagatgacctcaattacatgtctggaccttcgctggagtgtctggacattctttgtctgtgcagtgtctctctccatgtgatttatcatcttcaaggaggctaaactgtgcttatttgcagaataagagtgttgggattctaaaagggcatattctattggttaaagaatgccatccaagattcaaaaggaaagggaatagatttattggatagcatggtgactatagttaatgacaacatattgtaattttgaaaaatgctgagtatacctattaagtgttctcaccacaaaatgaattgtatgcgggccg

SEQ ID NO: 18918 - DNA, 812 bp, Homo sapiens
  misc_feature (1)...(812): n = A,T,C or G
cgttttagagggaggagaaagggttccaaacagcggactggtgtnaattttcccaaaacttgggactaaacacgaaataaataggatgaaatcataactttcatccctctcacaaacattccctcctctctcaagctccctatggtggtcacttccatattttaccagtctcaatcctaatatgtgtctgataagtcagctgttcccgtataaatgaaaggtttccatagataacattacattttcctctcatgaatcacacttatgcattatagagttgatcaataaaaactcttcaagattccttccactgtagattcccaaaagccccacagaagaggagggagggaaataagacagcagactcccaaatttagccttttaacactccttccctttgtgccagcaggtccaatagaacggaatgtttcattcaatccagtgacttgagcaagcgcctctctcctgaatctactgtttctcaagaataatgagttttgatgcagctagttagcaaaaggcaggaacacaaaggcaactgaaccttccaggtgcttaatatttaaagatccttaatacttgcagcagcattagaaagagaattagtgtaaaactcccaggtattgaaccaggactaagcactcttattcccagtgaactgtcacaacaaacctctgggataagagctattattactcccattttatagaccagaacaatgaaactactcccagaggcagacttacttggttcggaggaccagcatggcactgtccctccgatcctgccacagagcatgcaataaaggcaga

SEQ ID NO: 18919 - DNA, 975 bp, Homo sapiens
  misc_feature (1)...(975): n = A,T,C or G
tcagcgcgatctctctttatttatttacttattttgagatggagtctcactctgtcacccaggctggagtgcagtgggacgatctgagctcgctgcaacttctgcccctcctccctccaggttcaagcaattctcctgcctcagcctcccaagtagctaggattacaggcacacgccaccttgcccagctaatttttgtatttttagtacagacagggttttgccatgttggccaggctggtctcaaattcctgacctcaggtgatccacctgccttggcctcccaaagtgctgggattacaggcatgaaccaccacacctggtcttgttgaggattcttgcatctatgttcatcagggatactggcctatagattttttttcttgtgtccatatctagttttggtatcagggtaatgctgccctcacaggatgagtttgagaactggtatgagttcttctttaactgttcagtagaattcagcagtgaagccatcagggcctggacttttctttgatgggagactctatattactgatttaatctcattactcatagttggtcttttcaggttttctatttcttcttggtccaaatttggtaagttgtattctgttcaagaatttatccatttccatttgggttccaatttgggaggatataggggggcgtaaatagctctagggagctctggatttctggggagtcggtgtaatggcttctaaggccctgaatgtttaaacaccctggtggggggggtaattaaagaggaactgcacttaaattcgagacgtgtgggtagaaaccttagttgggtaagcaataaacgggaaaaggccctatggcgaaaaaatacttgggatacacccgggagatatccaagggttctaaaaaatatttggggtttagcgtgggtaagtgcagaagacaaaagagggggggntctcgcggaggagggaggttagggaggggagg

SEQ ID NO: 18920 - DNA, 645 bp, Homo sapiens
  misc_feature (1)...(645): n = A,T,C or G
atccaccgctacacgcccactttcaaaggacttaacttgattttgaatgaaaagacatgcagaaatgttaacgcatttcctcaaagttacagggaggtggccaagatggtcgactagaagcagctagtgtgcgtggctctctcggagaggggcaaaaggggcaggtaaattcagcaccttcaactgaaacatctaagtacttgcattgggactaatagaggaaacaactcaacccatggagaatggagaaaagccaggcaggatgacggcccacgcaggcatgacacagagacaaagtaacctccccagcccagcgaagtgccttcaatggtgatacctccaggttggggaagaaacataaggactgagatcaccggagagatacagtgggcagcccaggagtgccaagccaccttctacagccagcactcaatgggagaggaacccacactttcagnagagcattganaaagaaaacagttacaactgagaggaaacaggggagccacatagctggacaagagtctaccancttgaccagnntgcctaagtgccantctactggatnacaccccaaagcttcaacacaaaaaatactttgctagcaactttcttccaaaaccagagacaaaaaatcagcttcaa

SEQ ID NO: 18921 - DNA, 598 bp, Homo sapiens
atttacactgactgggccaaccactacctagcaaaatcaggccacaagcggctgatcaaggacttgcaacaagacatttcagatggagtactcctagcagaaatcatccagattattgcaaatgaaaaagttgaagatatcaatggatgtcctagaagtcagtctcagatggtaagatgagaagatgaggttcttaaccaaatagggaagagataaaatactggaatgctcttaaaggtttaataaaatcttatatatggcatactgcaaaattgtagcactatgactcagaggagtggaatattgctaagttagtccagtcacatgatcccttgactttgaaaatattcatcttctggaatggctagaaaaagatagcttaatgaagacaaatgctttattacaagtagagttctgagctataaagaaatactaaatgaaaatctttactttggatttttcttaatgatttcattatttttatacaaactttcgaaaaatatgtataaacctctagtatcaggggaatttatatgtgaagtttttagaatataccctaaatgatttttaaatctgcctgtctctagaggggctcccc

SEQ ID NO: 18922 - DNA, 869 bp, Homo sapiens
acaccatgtaagacgtatcttgcttcccctttgccttctgccatgattgtaagtttcctgaggcctctccagccacgcagaactgtcttgctctgtcacccaggctggagtgcagtgacatgatcacggctcactgcagcctcaacctcccaggctcaagagatcctcccacctcagcctcccaagtagctgggactacaggcatgaaccatcatgtccggctaagttttgcattttttgtagacacagggttttgccacattgcccaggatggtctcgaactcctgggctcaagcaattcacccctgtaggcttcccaaagtgctgggatcacaagcatgaaccaccatgcctggctcattctatctttcttgaaaaaacatcccaaagaagaagttcaaactactcggaataatttaaattagatctggtaaaagtaggtattaaaaatctctcaagaactctcatcagactgaacaagcaatttcagtgagcctacagaaatgtggaagggttatggttatggctccgtttacaaagaatctggacaaaagttgaaagcacgcaatttcagtatgaatttacatccttcgttagaagaataaccccttatatgcacacaaggaatttctcctcttgtcccccattatcaccaatttttaaaatgtgattataactatgctaacaaacatatctacattttcttaccaaaagactggaatgaattctcctcccctctccaccaccaaatctatcttggtctttttgaatggtggaaatatgggtgattgttttcctctcagcttgtccacccttgccaaactttccttaatgattacaaaattccttttgaaacttaaaaaataaaa

SEQ ID NO: 18923 - DNA, 908 bp, Homo sapiens
  misc_feature (1)...(908): n = A,T,C or G
ctccaggttcttgggtgtttggactcagactggaagtatatcaccagctttcctggatctctaccttacagatggcaggctgtaggacttctcagtcttcataattgtctcttcacccagagacacaactctccaactccaatcaaaaaaatctttgggcagaagattgattgatccatcttggatgacactgtcatctgtggatggaggactatggatcagaccctttaatggctcagctgcagtgttcaacctgtggttagaaggagttgacctgtacaacttttatgtcatggttgtgaaggaatattttccaggagaatgtaactgctctgggcagacaaggcaatgtgttcagcagtatttcataactaacatgatgcttttcacaaattagatgctagaaaattacttattctactattacactactagatttcttaacagctttgttaaaatataatctcacattcaatagcatttacnaaaagtggttttttttatattcagagttgtgcaaccataaccatgatctaattttagaatattatccggaaacttggttttagcctagtgagaatttctaatggaaaaaaactgtaaaatagttaaatgggggtttgtttaagccactgaatttgtggtgattgattattggtttataacaataagaaaccaatatggattcactcaccctgagattctgttttctcatatttaaattgagcataataatgtatatctcacaggattttatggaattaaatacgataatatgcatggtagaaacttctgaagactcagtactaataaatttatcatttaagtttttaattttaatgtattatagtccaaatattttacagtttattgtaaaagattatacaaaataaaacagtatcggcagg

SEQ ID NO: 18924 - DNA, 838 bp, Homo sapiens
  misc_feature (1)...(838): n = A,T,C or G
tctaagaggatccatggcgtttactctctgaagacgttgaatcagactgcctgggaattaagtgacaggaggctgagtttgtggggatgtcttatgccttactgaaactgatgggataagtggaaatctgcttgatgaaaggaaactgcagagaagagaataatttgcaacccattcttctgaggcccaaattaactcaataccaacacaacataaggacactataagaaaactgtaagtactcttcataagcacaggtatgataatttttaaattaaaatttaataaatgaaatccaacaatacacaaaattgattctacattgcaactaagaagggtttataccaggaatgcaaggttagtttaccattaaaagaacaaaatcagaaaagtatgtggtcatctcgctagaggtttaaaaaaaagcatttaagaaaaataaaaatctatttatttataaaaatagcaggaatctggggaagaaatcntttgttctcagtctcaagaagggcattttgaaaaaaatatacaagtaaaatacttatttgtaaaagaatgaatctttttccatttaagattaagaaaaaagtcagggatgtttgcactcacaaattcttttcaatatttcagtataaaaagtcaagagaaatacataaaagccattcagatttagtagaagctgtaaaacagtctttttgtctcataaaatcatgtatatataaatcctatgaaaacaacacaaaaatacttaaagtaataagtgtttttgtattacctaataaacccggcagcggccgggccnggctcgcgcgaacaatcacagtatatgaacattgca

SEQ ID NO: 18925 - DNA, 693 bp, Homo sapiens
gatgtcatcttggtcatcttgtgaaagggccctgaaaaagatatcaaattatcctccatgaaagaaaaaatagacgacctaggaacaaaactacaaatgcagtttggttttccctggatgggaggtctgaggatttgggtctacaaggccatgcagcacaaccaactgctgagctggagatgagcaatccccaaacagaaaacatgctcaaggcatgagagaatcatcaggacagctgatttagaacaaaaaggcaacctgttacatacaaggttgtaaatgaaacaaccaccgtcacagtgagtctgagggtgagctgggtgagctctgatttaccatccataatgtaaaatggagcatcctttaatgctatcacccagttggactcctaggcctgagtgccctcctccccatacctctatcccctaccgtgggctttcccctgccctcacaaaagcaggagacgcagggccacccctttttcaagcttacgttgaccagaagcacagggggttcctatgtggcaagactctgaacaatgccaggcaggagccagcagatagcttcttcccccttgcattccagatggactttcctcagacacttttggccctgaatctcatacatgttattcagctctcaataaatatcttttaaaaaaataaatgatgaatgaatgaatgagtgaattaa

SEQ ID NO: 18926 - DNA, 501 bp, Homo sapiens
ctctgtcccatcagcttcctccacagagcctgaaccggcaccagctccactctgcaggaaggaggatgtggaaatgaagaggcaggctctgatgactcaacacagccacccaaacaggcaatctccctgggacttgctcaggggatttttacccccctacatgaagcaaagaaacagtgagtttcctccaagatgtcaaatccaagatgggtgttcctgatctgcctgtagctctcctccaacccagactcctttcaaactgtggctccaccatcttcaatatggagcttccaagattgccctgctgccctgcatcaagcctgcaaaagaggatagggggtcaggccactcatatttcattggcccaaattcagtcacatggccacactcactgcaagggaagctgggaaatggagtctagctctgtgcccaagaagcaaagaaaaacagatttgatgaagacttagtcaatctctgcaacaatgaatacagatgcggccg

SEQ ID NO: 18927 - DNA, 1065 bp, Homo sapiens
tttttttttttttgaattttcaaaattgcgtttatttttagcaccaactttaaggatttttattatgacaatagaggttaatgagcattttcacaagataaacaaaaaatccccccaaatatgcaagtgttttaacataatgattgcagtttatttttcactcaggtcaaatccaagatgggtgttcctgatctgcctgtagctctcctccaacccagactcctttcaaactgtggctccaccatcttcaatatggagcttccaagatcgccctgctgccctgcatcaagcctgcaaaagaggatagggggtcaggccactcatatttcattggcccaaattcagtcacatggccacactcactgcaagggaagctgggaaatggagtctagctctgtgcccaagaagcaaagaaaaacagatttgatgaagacttagtcaatctctgcaacaatgaaacagataagaaggcaaaagaaaaagaattttacaacctgaggagggagagaaaattcagttaacaaaaagatagactacatgtcaaggtagtctgcagaattctacctacccaaattatgtgttaaattgtgaaagaagttatgataaaaataggatgagggtgaaatttgaaaaatgctctggggacacatagcacactccttccctggtgacacagtaggcagaaccaagccgactataaaaggaagctcagtgtgtttaatctgttgctccggataaaaccatcctggaaaaactcccagttttaccatctaactgatcatcagtatctcagttatacaaataactccagcctgcatggaagaccttcttgctccccttgacttgtaaaaataactttgtttcaatgggaaaaagtgtagaaaatggacgttgaagccaatcaaactcatagtatcaatactttgtggtaaactttaggagaaagttttgatttattggaatcagcttggtttggtatttacgcgctttaaatgatgtagatatctgacttattacctaccatttattttggaatgtaaccatacctcaattgatattacctga

SEQ ID NO: 18928 - DNA, 593 bp, Homo sapiens
atagaatatggttagaaaagggaaacagtcataatacacacctgagctccccagacctttggactccaggacttattccagtgcccctctgtgatctcaggctttcggccttggactgagaattgcaccgtcagttttcctggttctgagatcttcagacttggactgagttacactaccagcaccccagggtctccagcttgcaaatggcctttcatgaaacttaatatccataaccataatgtaaaggtcatgtactgacattgtggagatcttctaaaattcagtgaaataaaagacgaaactaccattaattttaccatccagactgcaccaaaatgttaacaatactgttttctctcctattaataaacctgtacttatattttataaaattgggagcatatttcatacttttataacttgtgtttttcatgtatatcatgaacattttccaagattgttaaatactctgaaaacatgatttttaatagtaatattaaatatttgtaatattccttttgatagtccactatttatcctacatgatctataacataagtataaataaaaacatggcctcgttggcctca

SEQ ID NO: 18929 - DNA, 516 bp, Homo sapiens
aaattgccacagccaccccaaccttcagcaaccaacaacctaatcagctagcagacatcaacatcaaggcaggaccctccaacctccagcaggaaaaagattaccacgttgctcaaggcccagatgatcattagcacgttttagcaataaagtattttttaattaaggaatgaaagtgtgtgaaccatctagtggaacggtgtgaatactatttcaatagtgctgttcctgcagagctgtctttctctaactgatctgagaaatgatggaggaagacagagacatgcacagggagaacatcatgtgacaacaaaggcaaagactggaagttatgcagctgcaagccaaggaacaccaaaaattgctggcaaactgccagaagctaggaggatgcaaggttagaattccccaagtctcagagggagcgtggacctgcccacgccttgattttggacatgtaacttccggaaatgttagacaataaaatgcagttgttttaaaccaaaaaaaaaaaaa

SEQ ID NO: 18930 - DNA, 740 bp, Homo sapiens
cggtcgcatcgccatttatttaatatagttatggagttccaattaaagttctaagtggatccctatatggtttattacaaaggagatcacataatagcagctaaataaaatgcaggtcagatcttctattctttcatttaaaaaaacaatgtttattagaatagttggcaagatggccgaataggaacagctctggtctgcagctcccagtgagatcaatgcagaaagcagatgatttcttcatttccaactgtggtacctggctcttctcactgagactggttagacagtaggtgcagccaacagaggacgagtcaaagcagggtggggtgttgcctcacctgggaagtgcaaggggtcagggaattccctcccctagccagagaaagccatgaagactgtgccgtgaggaatggtgcattctggcccaaatactaagctgttcttcctaggagtcgcatccctctaaccatgagtatccctaccgtgcctcccccatctgtaaccttggtgttcaaacacaaaaatgggtggccttattggcagacacagtttaatatgacggattcttctctcaaaccctatgccacactgtagaaagaatgagccctactttacttagcaaaggggtccgaccccagagagcctatagtgataagctctatcggccgccctacggcagatacaagaaagaacgaattcacccacgcgaatgcctgctaagtcattagagaatgatg

SEQ ID NO: 18931 - DNA, 877 bp, Homo sapiens
gttgccgcatctggttttatttcttgtacatgatttcttttcttgatggatgaaaaatatgaaaggaaacttttatatctgttgcctagttttgtacatggatctcattttacaagagaatctctctgcaaaaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaaatttcgggaacagctgaaatttgtttaatttatgcccagtggtcagggtccttaagcaaagtgtaaaatgtttttaacagaaccacttggcctgtccaaacgttaataaaaccctggttcctccttcaaataagagcttgccctgggttgttttttttggacacttaatttcttctatgctttggggaaaaaataccacccaatgttgtggaactaggcaaagattaattccagttaattggctggattgggaacaatgcctttccttattaaattggaaccttaaaaccattaatttctcccggcggcg

SEQ ID NO: 18932 - DNA, 803 bp, Homo sapiens
ttagctgcagtggctctctgctgtggcaaactgttaatattaaataaaatggcttaattaagtaacattggctttctctcatgttagcgagtactaccatactttcaccctgataacactaattcttcatccgggtaggtaactttgaaggtgacttggaccttgatcttaaaatagaggtgttggaaaggcacaatgtgaaggaagcaggcagaattacaattacacatcaaaggcccccggagttttcacttcaaattgtatgtttcaattctactagctttagtgttcacacccaaacggcaagggtaggatctactgcatggagggaggagtggcattccaatttcgtttattttctgctgaagctggcacactgaatgaagatttatatcttaagtgacaggattcaaatggaacatgacaaacctgtaaaagctgcaacttggcatgtcaatgcagaactttccaatgaactggatgggacttgggagacaaaccacacacactgccacatctcgttgggcagttgtgagagatcaaagagaaagcccaggggaaaagcaagtccttgctaactaatgtgtgcattgtgggggttagcatagattgccattttgcttacagataaaagtggggatctgtcttaggctcgccttacgatggaaaaattttggggagacaggctgcactgactggaaaaaataattagtttttaagctatcaaatttatagagtaaagcattaattaacaaactagccatttactggaatttaatcttgacctatttccaaaattgggt

SEQ ID NO: 18933 - DNA, 807 bp, Homo sapiens
  misc_feature (1)...(807): n = A,T,C or G
aaatgagaattctttcggcaaaaggagaagctgatttgcagaagtgctgagcatgcctgagagagatgggagtgatcaagaccaagagtgccatttggatgtgcagagttgagcagggagataccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaagaagaagaaaaaganaggaaaatgggtttntgggggtatgaagagtggtggttgaccaggcttcgcagaagcagggttgggggggggggcttaaacccccgccggcccccttttccttggggggggggaatttaagtcctctatcaaaaaccctgggccgtggtgggtccgggggggagagaggttttcctctcccaaaagggggggaattgtgttttcaccaaataggtgtgaataccacaggaagaaatgtgggcaaaagggggcgcaagggggcaaaccgcgaaagggggcgtggtgtgggttttataaaagcgccccccctgaggagaataaaaaataacacggcgggagaagagggggacacccccgggagtttattatcccggtggttccgtcagaaggcctcttgggtttgtgtgatgaacgtaactataagagacacgccctctttttttggggggagggggtttttt

SEQ ID NO: 18934 - DNA, 389 bp, Homo sapiens
  misc_feature (1)...(389): n = A,T,C or G
cttttcggcaaagggaaaactgctttgcagaagtgctgagcatgcctgagagagagggagtgatcaagaccaagagtgccatttggatgtgcagagttgaggtgacatctgcctggagagattcaggaggcagnctgaaatacacacaccagggagataccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaagaagaagaattgttttggcaaa

SEQ ID NO: 18935 - DNA, 725 bp, Homo sapiens
  misc_feature (1)...(725): n = A,T,C or G
ctgtcacccaggctggaatgcaatggcacgatctcagctcactacaacctccgcctcccgggttcaagaaattctctgcttcagcctcccaagtagctgggattacaggcacctgccacaatgcccagctaagttttgtatttttaatagagacagggtttcaccatctttgccaggctggtcttgaactcctgacttcgtgatccacctgcctcggcctcccaaaatgcgggattacaggcatgagccactgcacccggccaagtgctagcatcttagacaacacctctccaaaaataccaaaagattgagaaaaactgggttattttagtgtgggaagtgcaggtataaactatttcttcttaaacctcagaagacttgcaaatatcctagctgggactatgggggtgaagtacaaaattaagataaattattcaagatataaaaatttggcaaaaaattactttgtgtcctttaaagttattctttagcattaaaatttaaagtctaaacgatttttagagattcaaaagatatcaccaaaggctgtcctgtaggaaattaagcaatttagtatctaactttgaaatcttttatttagctttttcctttctttcttttttcactgggtatacaaatcagtctctgtattctccttggaaccagcttttgttatcttgttgatgttcctcattaaaaagataaagnaatctgtaccgcaaagc

SEQ ID NO: 18936 - DNA, 1010 bp, Homo sapiens
  misc_feature (1)...(1010): n = A,T,C or G
acagacgagcacacaatcttggccatcagaggctggtatctggaatcaccgttgtacctagaggatgtgacactcttctcgcttgagcactgaaatccatgatctctgactttaaatgaagcttcaaaaatttcatccaggctactacattacatccagtaaacatgactccttagactcctattggctatgacaggttttcaaacatggttggttactgatgacctggacagttctggaggatcactgttcaacctttatgaggaatggcccttaatcggaattctttctgaatttttttatcatgattaaactggaactttgagttttggggaggaagatccctaattacgctttgaaagcgagtcaccacgcacgcttatacttaaggattggggagttactctgcatctccataaggacaacatatctccacagaaaactctaaattcttgtatatggaaaggtagtgtttgcttcattggctcactgaataatagatataccaacctggagtcagaagatatgtattttctacttatatatttttttctttgcatagatttagggggtacaagtgcagttttgttacatggatacatacataatactagggtttcggcttctagtatactcaccacctaaatagtgaacattatccccaatacttaatttttaaatcctcacttctctcctactctgctcctttctggagtccccagtgtctattatttccttgtttatttccatagataccaatttcttagctccaacttgtaagtaggaacatgtattttatattttgtttctcattattttacttaggataatggcttccagctctatccacgttgctgcaaaagacatagttttgttcctttctatggctttgttccatggtatacataccacattttctttattcactcatccactgatgcacacttacgttgattccataactttgcgtttgtgccaagaagctgtaatgcgtcnngtatccgacagac

SEQ ID NO: 18937 - DNA, 602 bp, Homo sapiens
  misc_feature (1)...(602): n = A,T,C or G
cttttgatattatgagagngacacatggcagagaacacagcctgatntgaagatttgattctacttttanaagaatgcgacgcccaacatcagagcatnctaagggaaccgcagncagagggaaatacgggcgtgggtcttttgntgaatgcctttattgaggtcacacacttctatgcttttggtagnctgggcgaacctctcctttggaaaatctgtcccggttgggtaggggaaaaaagggagacttggttggcaaccacaagaggattttttgggaggaacaccattttattagagcgcgggcgggcggttgctttaagaggggggaattaggatccttgctcctggctcccttggctcggggctccgggtgcggcgagcgggttccggtcctagaggggggtgtcggggtttcccagaacgcgggagaccccagaaaaaacattgtgagccaaagggccgccaagggcgggacccgtacaaggggccggtggggggggttgtccgtgggagcccgccgccttagaggcgtccaacattgacacgtggatgggagggggggaacgcgagggattatagaggcgaggggtgtccggggg

SEQ ID NO: 18938 - DNA, 522 bp, Homo sapiens
tgtggacaggatgaggagattgaagcatgctccattttgctaccttgaataatttatctgcaaacaattcctcttgttcttgggagaatgaatgttcctttgagggatgctgcagtgaaggatgatccaaatatgagatgtttagtgtgcattctggacaggcattacttctcagagtattaggttcttcttttcatgaagatgaggaaacttaaaatcatctaaaatccatgctctctgctcatgctttaattttttaacaatttgtattagtttttcttttctaacaaggaaaagtttgaaagagcaactgaaagaagatccttctaaagctataccttggaggaacacaatttgattaggtttaaggaaagtcagtatttataggcttgttttcatgaaaaataagctttattgaatcccttgaggggaaaagcataattttacagcttaggtttcttccttccccagtgatactagtgtctcaaattttaacctgaaataaaactgtatacaggaagg

SEQ ID NO: 18939 - DNA, 387 bp, Homo sapiens
aaaagaaaagagaagcgaaactaaaggcatgtagcccggtgcctaggaaccagacccgaaaccaaggaaccagacctgcaaccaggcctgagcctgcctgacctaagcctggtagttaaagattgacccctgacctaaccagttatgttatctatagatttcagacattgtatagaaaagacattgtgaaacttcctggtctgttctgtttcactccgaccaccggtgcatgcagcctctgtcatgtaccccctgcttgctcaatcaatcacaaccctctcatgcagacccccttagagttgtgagcccttaaaagggacaggaattgctcactcggggagctcagcgcttgagagacaggagtcttgctgatgttcccggccgaat

SEQ ID NO: 18940 - DNA, 111 bp, Homo sapiens
acttggaaaaatggacaaggattgtgaaatgaaacgcaccacactggacagccctttggggaagctggagctgtctggttgtgagcagggtctgcacgaaataaagcccga

SEQ ID NO: 18941 - DNA, 513 bp, Homo sapiens
tggttactaccttgttctgtataatggagcgctggcatacattgggaattttcgcctgcttgcagagctttccagcccgtttgtgaatcagcgaccaaaggctgtagtcactggaaacatggacttgttttcatctctaactctccacctctccacactcagcctgcagagcccggccaacaatcagtttctggcatttgcaagtcaagagtattcagcgttggatgaattcaacacgaacttgaatctgcgggccttaacaggctttttcccaatttgtctcgttctcgtcgcctggtttggtcacctcactcttctctatcatcctctcggttttctggtatcgtcccgcatttctcatgtctcttccgacacgccccttaatctttcctgcgcatataccgcgctcgtttaatctccgtcctcactccgtctctctccttatccttctctctcgcaagctctgcacttcaacgcctcccacaacgctccgcccaccgaaacaactaaata

SEQ ID NO: 18942 - DNA, 378 bp, Homo sapiens
cctgccgatcttgctttattgaaatataattcacttttggacgggcgtggtggctcacgcctgtaattccagcactttgggagtccaaggcgggcggatcacttgaggtcaggaattcaagaccagtctggccaacatggtgaaaccccgtctctgggaggctgaggcacgagaatctcttgaatacagaagacgaaggtggcagggagtcgaggttgcgtcactgagctccagcctaaagtcatcttgtttcagaacatctcgtttcattctgccacgttccatgtgtggatctggccagtgtaacatctcaacagtttattttactctttccaactttttattttgaaaatttcataccttcataaaagtcttaag

SEQ ID NO: 18943 - DNA, 593 bp, Homo sapiens
cccctcctcctctgtcacgttccccgcctatgtctttccccctatgtctgtcttccgctttcggccgcccacacgagcgcgccctgatacccatatcctcttaccccacacgccgagctgccctcccgcttcccggccgcgccagcctcacctaacccgcaacctatcgtgtcgcaagcgcccagccccagaagccacaagacaacccggaatctccgcccctcacctttcccccctgggtagcaacgccgctaccacagccgaatgttctctgccagtccctgtccatgcccgccgctccacgccaggtaacacagtggccgttgcacctggaccttggcaagcaccgtacccttcatacccctcgagcaaggagtctcagaggcccccctcccagtacgtctttggttcattgtgtcactcaagtcttcagcagcccagatctcaatgcaccgtccgtagggcttcatggcagggtcataacccgtgcacaagtagatgtccccccggtaggtggctgtgccctccagggcagcacgcagacgggtggcttgtgatacgtagtctgcttccttggcataaccaccaaactg

SEQ ID NO: 18944 - DNA, 1298 bp, Homo sapiens
  misc_feature (1)...(1298): n = A,T,C or G
tctcaacacaaaaataaaggctttactatttacttaagacttgtgtggtagcttgtcaaaacaacccagtgcaactaactactaggctttcggatctgccttgagggtcggtctgtggcattttaaatgggagaatcttggttaacagcaaaccacagaacatattaaggtaataagtttacccataaaagcaggaactttctatgtatactttgggacttagacaacaaaaatcctttgttacatctgtctgggtttaagtgtctcatcttgttgggttcgcagtaaaagttaaggagtggtctcctttggaaatgatcattaagtataaggtcttttttataaagagagtagtcagtcactaggtaaacttaaaaccaaattcagaggttggggacttaaattagaatatggatctttgcaaaggcggccacaagtgggaaaactggtaataagagcacttctgtattccttgggactagagttcattgtacattttaacagcagctggtgtaaaagaatactcctgaggcactgaagaagtaatctggatgaatgaataaaatgtggggataatgcaaaaagtgaagactggtcctttcttttctaaactatttgcaataaaggttggttgcaatgattccattcttgtcaaaaaaaattccatttgcacatgtccaagttctgtttaagaaatcccaagagagagagctccattggccatttccttgcccaagggtaactggggtgngaagggcaaagatcgtcttacctatggttagatgatgaattttcattctgtctgcaggtactgcatagtcctccatttgcattcaccttttgttcttgcttggcccagaaaattttacttgctggtgaatgtgcttggcctcgcgaagtttcttctgccactgacgcagttcttgaatctcaggatcacagcgaaccacacaggctctccagaaggattgaatgtagggggctgcttcctcttctgtcagcaggagcgagagtgggattggcggccgtgggtgttgctttagccgctcctccacaaatggaatggagaaaaattctgtgaatggctcccctgccctctaagaattttggctggtcatgatgccatatgtttgattgacaagaaaacaataagcaagaattcaagtcagttgttgctattctgcttgcgaattaacacgactgaattcttaggatcactgaatagtcagacacgaacaacttacttgtataaccactcagtcagaaaatcacaggcaatgaatttggttcttttcctg

SEQ ID NO: 18945 - DNA, 908 bp, Homo sapiens
cgctctttgagctccaccgctgaggccaacgaggccaattctttattgtgcgccctccttcttcatgcagagattcctttgaagtctgagggagatgaaggagctgaggctgagaatgtggctggaggaaaaaaaaaatgaatattattaggccagagtctcataaccatgatttatgccacattaaccattgtgtttgctataatgcagggcctttttattatcgtttttaccttctagtttaatcaaggatcactaatacaacttttaataatatactgggtttgaaaaaatatgtttatttgaactcccttaggtgagattcacaacccagcccctcaaaaatgtaaagaaataattttatttagaaaaagctaaaaatgtaaaaagcatcactttcggcttgtatgtaagtctagatgaggcagaaaaactgaccaattaaattggcattcagagtgagtacagcacagagaggaagttatgaaggaggtggggatttatttacttgtcaagcaattttctctcactttctccttacttcctaccaccttcaaggagggagaaaatgttagcttgcatttatggcaccaagcttaaagttaattttttaaccttgttttgtactaatcacagggagcatgaatgcatgtgagtgcctagagggaaaggtttttatttcaggcagtgttgactggcccttttggagtgccattagacttatgtgtacacgcaggttgtggcaagactcttgagttcctaatggcgccaaggaggaaattgactcaaacaggttctaggcaatgaccccgcaactggccagctgcgtacggtttgatatcaaagacatttttggtctcgctgagattagtttttccatacttgttaccttcgtgcgttggtcgccc

SEQ ID NO: 18946 - DNA, 509 bp, Homo sapiens
ctggatttcaggtgttggcgtctgcttcccattactggccactggagaatgtggatgggatccatgaacttcaggatacaactggagatattgtggaagggaaggtcaacaaaggcatttacctgaaagaggaaaagggagtcacgcttctctattacggcaggtacaacagctcctgcatcagcaagccagagcagtgtggccctgaagatttccagtttttcttgataaatctctcctgacttctctggctggctggagctaagtcgcggtggccctggacttccgtctccagttcccctcagtccccaccagacttctcgactcttcaataatcttcaggtcgaacagagcctgtccgcagcatgagctctggggccagaaggcgtgggttccacttccggttccgacctgtttgtggggatcttgggcaaccactgcttccctttgaaaagcctcatctgtaaagtgagtgaataaaaggaccttcccaaaaaaaaaaaaaaaaa

SEQ ID NO: 18947 - DNA, 308 bp, Homo sapiens
ttttttttttttttttgaaaaagaaaaaaaactttatttcaaacaggttcagtgatatatgtgtgtgctacagcaaaggctggttgtggcaaagtttcatttcaaactgtatgatgtgggctgggcaaggtggctcacgcctgtaatcccagcactttgtgaggccgaggtgggctgatcaccctgaggtcaggagagaccggcctagccaacatgctgaaaccccgtctctactaataatacaaaaattagccaagtgtggtggcgcgcacctgtaatctcagctactcgggaggctgaggcaggag

SEQ ID NO: 18948 - DNA, 375 bp, Homo sapiens
ctgaaatggaagctccactcaaggaggcgccgggaggccccaaagacatctccaggatgtaactgcccaccagggcctttgcacttgctgtgctggtgtgcagtgaccatcccttggactccctcgtgccgcctcttcattatctaggtttcgactccaacaccacctcctcagaaaggccttcctcagtcatccaagctaaagcattttcccaaattccagccccgtctactatatttgcatattgtaacttctcatagcagtcatcagtgtgtaaatttttcccatttatttatttctgtttgttgtctatcacctgcggctagagataataataataataagccaatacttgtatggtgaaaaaaaaaaaaa

SEQ ID NO: 18949 - DNA, 237 bp, Homo sapiens
cagtgagatgcagaagtctacttccttctgtcgcagggcctggagctgggcagtcccatgggggtccacgatgaggcggaggacaattttcatgccatcacgactcaccagagctaagtcccgggaacactgggaaaagtaaagtttgtgatcagcccgcaagctgaggataagggccttaccccacccacagtgggaccctctggccctctaatccctttaaacttaaataacacc

SEQ ID NO: 18950 - DNA, 383 bp, Homo sapiens
tgcttcctcatctaagagtcaattttcttcgctattctgaagcttcaatctgactgtgatatgaaacatatttcctctagagaataccaggaagctcccataagtagccagaaaacagctgtgtctggacagaggtgacagaaaccagtggcttgtgtctctcaaagagagagataggcacattacccagtgggaccccatttatagaatggaagagcttatcttggcttaattaatgtgtgaactcaactacaatgttgattgtggttatagtttcacagaggtatatgtatgtaaacatttattcagttctacactttaaatatgcatggtttactggatatccataaaactgttttcaaataaaaaacgatcggccgaac

SEQ ID NO: 18951 - DNA, 477 bp, Homo sapiens
ctccggccgcatcgaggtttattggtcacggtgctgcaagccgtacaggaagtatggaggcatctgcttctggggaggcctcgggaagcttccagtcatggcagaaggtgaagggggagcaggtgtctcacacggcgagagcgggggcaagagcgcgaggtgggaggtgtgccaccggatctcacgagaactcactcactatcgtgagaacagcaccaaggggatagcgctgagctgttcatataaatccaccctcaagatccagtcgcttcccaccaggccccacttccaacgacggggtgacagttcgacaggagattggtggggagaccccaactcctcaacattgcttctactgtttgctatttgctcactcagccactggccacaggtgctgctgcagtagacacgtctgttcatcgccttcacctacggttcaaagctagaagctctggttgcacggcaagcccctccttt

SEQ ID NO: 18952 - DNA, 304 bp, Homo sapiens
cagcttccctacagtagtgggtaactagtatccaactgaaggctctgaaaagggcacaaagacctcctagaaagagtacttcatctgatcaacactaagaagttaatctgtctgctgctgctgctgcggacaagctttatcaccagaaagtcatttataacgtttgcgtcaatagtaggtacaaaccttggagctataattaagattcatttaattatgctggaaaagtgaggtaaaagtgttattagcttcacataaatcacagcaaaatgtgttgcgcactactcaaaaaaaaaaaaaaaaa

SEQ ID NO: 18953 - DNA, 474 bp, Homo sapiens
ctggaatcctctaaaataagtcacatgggaaaaaattctgatcttattctagacgaagaatgaaaagccaggaagctacataacccaaggtagggtggaaagagttgggtagagagttggcaactgttttggaaaccgaaatagtgttaaagatgtcagaaaaatgtgaagtgacattccactaagactgttcaaagatattttgaaagacactagctacataagctaagtaccttgcgttgacttaagtttgactttgttctcttagttctatagctgagacaagtcccagaaggattaagtaggttttgggaaattaattaatgactaagtcatacttgtatatcttcattcaagtgctctatctgccagaaaacatagtgatccaaatgactattctggtatattaatgcgtgtttaataggttacatctataaaatgatttatttcaatccaaaaaaaaaaaaaaaaaaa

SEQ ID NO: 18954 - DNA, 527 bp, Homo sapiens
acctagggttgggtaatcggactcactataggctgccagtcacagggtctcgctttgttgcccaggatggtttcaaactactggagtacaagtgatcctcccaccttggcctcccaaagtgctgggattacaggagtgagccactgcacctggcctcccacacctatttcaaagagttatcaagcaaagctcactgaacttacttccaatgaattagcttttctgctttaagaaaatgcttccaacgccctgtttcattgtgcttcaagttactgaaggtctgcggcaaccttgtgtcaagtgcctctattggctccatttttcaaacagcatgtgctcactgcctgtctctgtgtcaccttttggtaatgcttgcagttcattattttatctattataatgaactgtgagcagttacctttgatgttactattctgcttttgggcaccacaaaccgctgcccacgcaagaccgcgaacttaataaagaagtatgttctgactgctccaaaaaaaaaaaaaaaaaaa

SEQ ID NO: 18955 - DNA, 386 bp, Homo sapiens
caaggcatttaatggttgaaaagttgatattttccaagataatttaaaaattattgatggagtgtcactctgtctcccaggctggagtgcagttgtgcgatctcggctcacggcaacctctgcctcccaagttcaagcaattctcctgccacagcctcctgagtagctgggattacaggcatgagacccattttgtttatattataacccatcagatgttgttatccccattgtaaaagtgagacaactgaggcaaaaagatacaaagtaattttcctacaaatgcacagctaaaattagcaaagctgggctttgagagctggcacactggcttgaaaccataaaataattgcctcttctatttctcattaataaacacaattaat

SEQ ID NO: 18956 - DNA, 165 bp, Homo sapiens
ttttttttttttttttttagaaaaaaaagactgatttattaagacagtgtagacaaacaagtaaaaagacttatataagcatacatcatccatatccaaatcttaatcttgggttccaatgcagggacacatccatggactggttatttacaatgtatagtcagt

SEQ ID NO: 18957 - DNA, 144 bp, Homo sapiens
ggcttctagaagcagagctgaggctgggagattaatgctgtcctcaaagtgaagagtcaccactacttgtcaagtcatgtcatctctgcagccacgtgcattttgtaaactgggaagaatgaacgcctggcctcgttggcctca

SEQ ID NO: 18958 - DNA, 439 bp, Homo sapiens
catgaaatgttaaggagatgatacagcgcttcctatatctttttccttagaaacgactctatggacttaagttcaccaaaagaaggggattgaggacatgcaccatgacatcacaacttattctattttttaagctgttaagagatccagcttgcatataacctacctgatcttgtccagcacagcagactgatgaatgagtacaatcttacttatggaaactggagagatcgtgtgtcacattcagctctgaatgatttacttcgcagaggcttaagagtttccactgtgggattttgctcacagtgagctcagacgactcagaggtgtggtgacaacaggaagttccctagggactgactgcttgcaggcccaaccctttcaggatctttgactcctactcttttcaataaaaggtcactcattgtctactttaaaa

SEQ ID NO: 18959 - DNA, 816 bp, Homo sapiens
ctgccctatactgattgattattatggatctaaaaaagtcaaactcatagaagcatagtgtggttgccaggagccaaggtgggggtggggcaatgaggagatgttggtgaaagggtacaaagtttcagttagacagggtaaataagagtgtactcttatacagcatggtgactacatttaataacaatatattgtatactttaaagttgctaagagattagatcttacatgttcttacaacaaccaaagtatgtgaggtcttggatatatcaattagcttgatttaactatttcacaatgtatattatatcaaaacatcacgttatataccatatatgtacaatttttatttgtcatttatatgttaataaaaaataataataagtaatctgagtctttaagaaaaaaagaaaattatctttacaggataagttttcagtttatcaacaaaaagaaagatttaagcagaacttttacttatctctggaatatctttttatcaagataaggagatgaaaaataaattcttcatggaaaccaatttcaaaaggctataccactcttttacaggaaatactgtttcacaccattacatgtaataagaattgattgtgaccagctcagtttggtaatacaggtgaatatagttgcaataattacttctgacactggcacaagcattaaaatgtttaacaaatatttcacaattgtgaaaataattctaatagtgatttttacgatttttttttggttttggtaactggagaaaatgcccaggattctattacctaaaaggaatggcagggacaaatattt

SEQ ID NO: 18960 - DNA, 1709 bp, Homo sapiens
  misc_feature (1)...(1709): n = A,T,C or G
aaacaagtcaacatttttgatttcaaacatcaaaaaaggtgtccagaaatctcaagaatttgagacatcctaaggaactttaagtgctgtgagccacaagtaacatcaagaaaagacagggatgaagaaccgcacttacaagctaagtaagattaaacccagcatggagatatatgaattaatatgaacactgagaaagaaattggtcagctaaaaaatatatggctttcctgaatagacaaaagaacaaagattttccctttgagattcggcaggaagcttgcaccgagtgaaggatttataaagattataggagataacacaaagctattttatctctttaaaaaaaaatcaaaggtgtaagctcatcctacacatgtcatttggaccagaccaaggctgctgtcatggaggacccacaccacagcttgggaaccattcatctaccagagggtcacatgacttcaaatgactcttctaggggccacctgccatgatagggtaccagctcttcctctgaatttccaatccatttcttgagaactactgtttctaataaggatttgctcaaaatggatttgcaaagagaaaaaaaatttaatgtcacactgccatgataagtcaaccaaccatctcatgtatcaaaggagagaggcagagaaagaaaaggaggaggatttttttnaggaggaggaggacgaaaggaaaaccaagaggaggggaagccacttcttactttggattaatgtgaaactaaatagtttactacattttaagtgggaaaatgttagttgaaaagatatttgtcaaccacaaacatttgaaagggaagcattccaaagattttcactgtttatgttcaaattacaacatgtgcagaaagttgtgcaactgaaaatcctttcaaacaacagctacaaaagagattggtcagttaggacaggaatagaaagtggaaacttagaagactggctactccttgtgtatgattgctggggtgagtctgtgctgagaactttttacaaagggtgtcctttgctgatatgagaggggggtgtcaaacttttgagtgatcactgtgggtcctcagcttagacatcttctctggcccaagatggcaccccttgctctctttccatgggacacagggaccttgccatccttccatcttataagccttctgtcatgatttttacttcatcctagatagccttaatttgggccaggtctccaggttcctccactttcttctgtcccatccatacccctcaccaatcctctgtaaattcctttccaggattttactgagaacaacagagaaacaggctgggaataacaaacatggggagttatgtagttagcatacactttgacatcacctagtcattttcctgagtatatagataactctgttattactggttataaggtccatgagaagcctttatccttttctggaaaccaagaaagcacctgccctccctcagtcctaaggggagaatctttatgggtgtaacaataaaatggataatgggaaattctgatgtcctcaagcatacattcagatgtccccaataagcatcatttgtatatcaagggaactccagagagatgatccacaattcagtgtgtccctttggccagtagagaggtcaccttagtctggaaataatgatgataataatgttaaataaacccagatgcggcag

SEQ ID NO: 18961 - DNA, 227 bp, Homo sapiens
tgagcgggcaaggtgcgatccagcgccggaaggatatgcccagggcgtaccgaggcgcaagaggccgcacgagatgcgacagtgtcaaagcaacgcgggggataatgcggcagcgtctgcctcgccaagcacgaagagttttccgatacaaccttgttgggcaataggcacggatttctccctcacaccccccattttcgacaatataggggtagcccacgcccgcc

SEQ ID NO: 18962 - DNA, 885 bp, Homo sapiens
tggccgcatcgttatttatttagcaaaagtatcattacagagattcattttctatgcaaattgaaatgctataagccattgaactgcatgaaaagccaatatggttaattaacaaatgtattttagagctacaaaataactgttccacattaaattacataagatgaaaggatacataaaatcaatcaatcatcagcatttcatattttgacttgtgccatctgggaactttgcaaaataagtccacaatgaaacatcatcagggagtatgacagaaaaacgagcaattatattcggtctctgaagaatttaacaaactagagaaattatcttatttactgcattaggatgacttttaaattatggcttagtttgatcccatttaaaaatatatacaaaattatacacaaaagcaccttaacataacaaatagtgaaatcaattagataaaaatatgggtattaatgtttttctgagactgataaaatttcatattcattgaaagttatggcaactgaacacatttggaaaaaaatcaggtctctctatattagtcagaaatgtcatcgttaaactttaacaaagaccaaacattttgtagatactaggcagtaagaaggcagcccccatcagcaggtagcgcaccaaaaatgtttggtttcataatatagtttgggagaactacctctacaaagtctattcgtgctgatgctcctgatgctgccatttctggtgcccgaaaagctgctccctccacatcctctgttgtaggtgtcactgtatagtctcaggcgattgggcaaggggcacactctggatcttcagatgtttggtagagttttcaagtgattttctcttaactccaagatccgcaatttgacaagt

SEQ ID NO: 18963 - DNA, 786 bp, Homo sapiens
tctacacgatacatggctagtcaaagacttcatcatactgtgggctatcctgaaccagccactccggagagacctacttgtcaaggcacaatggatacgaactgaatctcaacgaccagcatcacccatcaaaagatatgcaagaatggaaggacatcatatcatcataatgcagctataaatttatggcgcttttttctctcacaggatatatacccagtaatgactgatcgacttacaacagtgatataattctggaattttcttctgttttgcaattttgacttggagtgctgatctcccacatgtcattattgtaactagccctaaatgaaagaaacaacataatgtataaagtcattctcacatctgggcaaatatgtattatccacgcacctatacatctagattcaacttgataaccgaaaaacaaaccgtctcccccttattcatcattcaataaagactcggatgggaaaatgcccacacaccgtaattcattctctcatcttacactctattcatccaaggctacccgcatgctctcgcatgttgcagcatcttctcccgcgttcccatccccatatctatttaataatgcgcctcgacactcaattaaaagcacaacctccatcacccatccacatttgtcctccccattgccatacaatacagcactcacatcttcagtcaccttcatttcatcatgacctcgcacgtgcgctttctaatacgtctttctacccgtagtatcgctcactccgttaaaaaatatcctcaccgata

SEQ ID NO: 18964 - DNA, 680 bp, Homo sapiens
atacatggctatgaaagacattcatcatactgtgggctagcctgaaccagccactctggagagaccacttgtcaaggcacaatggatacgaactgaatctcaacaaccagcatcaaccatcaaaagatatgcaaagaagcctcagctgtttagcctcatctctgctccgtgatgattctcatctgccagaaggaatggaaggacatcatatcatcataatgcagctataaatttatggcgcttttttctctcacaggatatatacccagtaatgactgatcgacttacaacagtgatataattctggaattttcctctgttttgcaattttgacttggagtgctgatctcccacatgtcattatttcaactagccctaaatgaaagaaacaacataattaataaagtcattctcaaatatgggcaattatgtattatcaaacacctaaacatctagattcaacttggcaaaagaaaagcaaattttcttcccctttcacatcgtttatttagattttgacggattatttttaaagaaggtaatttaactgtgttaatatatactctaaatgtcaatctaaacgtatttttcctctgtatgtaatacagtgtattgattatgaattcatatcgtatttctgattcatttgtcatcattaaaataaagccagatgctgcaag

SEQ ID NO: 18965 - DNA, 684 bp, Homo sapiens
actctatcaagaagaatatctaatccgtaccttgaacatacgccttcccagatttatggagagaattcttcttgtgcaggaagagcactgaggaatattattatcgctcaagcaatcctcctgcctcagcctcccaaagcgctgggattataggcatcagccaccatggttggcctagataaattgttattatattttgcctttcaagagaaaaactaaaagaaatagaaacagattttttttgtgtttgcctgagtttatttcacaggtggaaatcaaagatggtcttaatgtatttttgcaggatggggagacattgactaaattatattttaaaatattagcaaagcctgaaataaagtttattccaattttgcaattgtatatcagtgttaaagaatatataatgctgtccaacaaccctcaagtgtttgatgtcatagcattccctattcctagtcatctttttaatgtgtccaagacactcagcttatcattttggagacaacgagaatagattggtttagaatatgccaagctgctgttgcattcctagtcatttaaacactttgcttttgaggttgttatttttatgtaattttaacagcatagtttacatttggtcatcgtgtataaattaggaaatgctaataagtacaataaaaataaatcgagatgcggcag

SEQ ID NO: 18966 - DNA, 813 bp, Homo sapiens
  misc_feature (1)...(813): n = A,T,C or G
gcatgctgctacgactctcttatcctccaccgctacagcatagagtcagcagatgcatgcctgatccttgccaacaagtcctgcgctgacccggatgcaggaggatgcctcaaatatcatgagagtaatctccataaagaactaccctccgaagataagaatcatcgctcaaatgctgcagtatcacaacatggcccatctgctaaacattccgagctggacttgggaagattgataatacgcactctgactcgaaaagttgaagttggtcttgatagcccagagctgcctggctcagggcctcttcaccatgcttgccaacctcttctccatgaggtcattcataaagctgctgccacatatggattcttttatatgggtcttggcatggactgaacaaagagaaaggcagcacagaaagattacataacatatacacagagtccggtgcccagcgaggatggagcccgagaagcggcaatggtcaggacttaatgcgaaaatccagtagaagctgacactcaccctggcccttcttggctggcaggatatagtcactgatgtgaaataagagccatcttattgaacaagcctctggccaagcatcagtctgagctctttcagagataattggcctttaattaattgcatgcattcctgagtccacctgggtatccacagactgggtctactctgcctccccactcttccaactttttgactttggttttttgagtgccatccactgttagtgattgttacatgaaaatcgcaaagtcctattaagccaaaggaataatncgtatcgcaaag

SEQ ID NO: 18967 - DNA, 465 bp, Homo sapiens
aatgatgttcccgacattcagcgacatccacttggcccctttttctgatgaacagctctacgtggaacacttctccagagccaatttttggtaccagcaatgtttctatggggtcaatctgtccagtctccagggtgctacagtggatgaatacttcaggcagccaatagtagacacatttgatgttaggattttgatggctggaacagtcaaatacacagtaaactttatggatgcagaagaggaagatctacacagatggcagtctgggctcatccatggcctggcgttctggtttgatgtggcatttgttggatctctgtatgtataccccccaccaacattttctcagtctgctctaccccatgctatctactatttgtaatcacaattttaaagtgtttaataagtgattttaatgacactaattcttgtttctccaattttcaaggaaataaacaccga

SEQ ID NO: 18968 - DNA, 407 bp, Homo sapiens
agaaaaggtgtgtgctgtgtctccaagtctaatgatttcaccagtggattctgcttcatctccatcccaagaggggcccaacatctcagaagacaaggagcacctggaaaagttccctccttcactcagggcccagcctgaccagagggcccttcccctgaggacctggagagctgctgggtgcagaaaaaggaaaagactctcccttttgctgcttagcatgtcttgctgcttatgttttgttttcactgatatatgaatggtagaaatagctgtatataaagtgtcaacgattaaatgtataggagaacagcaaatactggtgactctagggtgtgggagtgaagggggtgggatgctaactttgcattaaatatccttcaattgtcaaaaaaaaaaaaaaaaaa

SEQ ID NO: 18969 - DNA, 486 bp, Homo sapiens
aaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagaggttagtaatatatccctcatttaaaaaaaaaaaaaa

SEQ ID NO: 18970 - DNA, 218 bp, Homo sapiens
tcgtgatttattgggtagcccccctctaaacaccagcagccccacgcatgcatcctcaccagaaataaataaggcggcattcaatgaaccagtctgtcttcttcctaaggagctctggtgcggcgggagtcagtggaggcgaagatgcagagtgccagctggaaggtcagaatcagctccaccaccatggcctggccctgcgttgtgttgttgttgag

SEQ ID NO: 18971 - DNA, 817 bp, Homo sapiens
cttgcgatcacggttttattaatgctttgagcaaggacactgctttataattaagtgactccaaaatgtgaccatggtttagaggacaacaaaatgaaaattataatttggcatgtttgtttaaacatggagtcacaaactcaaaatgacatcatagttgtgcaaatttctactcctgctgaaactgcctgacttccaatgaattcagtgagcagcactgcaccccagagggtgtgtctactagaatttcatcctgcctccagaggaaaccaataggcagtttgctgtgatgtcctgccacagaagggccatctaccatgaacagggcttcataattttcaatcatcttttgcacaacagcgatgatggccgtgctctcctcagcccgggctgaactctgaactgagaattctttgtctgatgacttctgcttgtgcagcaggttgtgtccaaatatggtggctaagtttagagatgtcattttattcccagtgacctcttgcccatctatgctgatgttgtcatcggcatgcctggccacgatggagaggaactgtagcaggcggtggaaggtgtcccaattgcagggaggtagaaaggatatggggagctgcaaggtgcccagctgttcctccggctccaacagaagagtgttgataaaaagctgtgtacagcctcctggtgaaaaagggggtctggcatgtccctcaagaactcttatagcaaggctgccacattatgaacactgtgctccttctgcaaagagaatcaatcccacaggtcaaatcctcacgtatttgcttaatctctttttgag

SEQ ID NO: 18972 - DNA, 766 bp, Homo sapiens
tgctgagtcgactctcttaataaccaccgctcagagttgcttgtgattaaataaccccaactgacgtggaaatcaaataaagcaacaaagaactgctttttcaactaacaaaatatacagctggatgtttgtcacaattctaatgtccctgcaaagatgagatgcatgaatcacacagcaatctcatcaaaaaggaatttctggaaggcataggagaagagaatcctggaaaaagcaagaagcaggaagataagaggcaaagaagaagagagccccacccactggggcaagctggggccccagatgatgaaactgtggcccagaaagtttaagggatgtgtcaaatgtcacacagctcacagatccagggacatggcttaaatccagatatcttgattctaacttcagttgaggaagagaaagagtgctgccccacgctgcctgatttacaacgtgaagtgaaatctttgaaaagaaaaataagacaatgtcactcaagctcttatctgaggatttcctgggtttgaagacagagctcaaactcatacaaggggtcatctgagtctgcagataggcttgctttatgctgctccgtcagatctcttctaaagattagtgcgcaattctggacattacattttaatggtaacatggattcaactaaagggtaagcaaaggacaccgacaggaatagggagggtgccatttatagagaaaagactgagaggtccatattgttgttttacctgagagatataataaacaa

SEQ ID NO: 18973 - DNA, 859 bp, Homo sapiens
  misc_feature (1)...(859): n = A,T,C or G
ataccagcaactgaaaagcagaagaaaaacacttggatcgtaggctaactcctaaaagattgatccctggtgctgatacagaaaccatccaagaagccttggaaaagtgtcagattcccgatgatgctcaagatgcttttggccgaagaccataagtgctgagaacttccttgcttcctctcaactcactctgggatcatctttcataactctaagcttttctccatcatatgtttccaacctacactgcaactcaagcatgccaagtagtcatcaatctataaagaaatacttaaatgcattgttgaggaggactgctagtcaaaggagcctctcaggaagcttatgcaataggaaagaattaccctgtcttactctntaaaagactttcctgcaagagaggcacaccagactcaaaattttatgcactgtgcaaaaacatgcccaggcctttgggagaacctggcttttaaacaagaattgaaacctggtgccatggtttatgccctgatgtccagcacttcgggagaccaagggtgggaggatcccttgaggtcaggagttcaaaaccagcctgggaaacatagtgagactctgtctctacaaaaaattaaaaaaacaaaacaaaacaaaaaaaacaaccagatgggtgtggtgacacatgcccatagtctcagctacttgggaggctgaggcaagaggatcgcttatgcccaggagttcaaggctgcactgatccatgagccatgactgcactccaacttgggtgacagagtgagaccctgtatttattgtctttaaaaataaaaggtgatgcggcagctccttgtacgcgtcttgaacctccagggatgatgaa

SEQ ID NO: 18974 - DNA, 516 bp, Homo sapiens
aggaggttcaaattgtaatttgtcaactgcaaaatatataacagattttcagcaatgggcatgattttgtccataactggaaaataaaaattattcagaaattacaaaccaagggaattccatcgaaaccagaaaagcaacccctattttaaaagtattctgatatgttgaagtatgtagccttagtctgaaattttattattctacaaaacacacaagaacacgcagcacaaccctccaaaaccaccaatggaaaatgtaaaccaaacacatacaatttatttctgaagctgtccgttcagctctggcattcctgtttgtagatctaatggtatgacgaatgattgcatggggctgtgaatataagcataatatatatactttaacaaatttcaatgagaaagttaaaaggtcaaactttcttatcatttattgataaatatgaatatctactagtaaattataggataaacataaaacaaatacaatgaacgctacaataaaaaaaaaaaaaaa

SEQ ID NO: 18975 - DNA, 118 bp, Homo sapiens
tttttttttttttttttccatttaaaagccctttatttaaaaggaacaaagataactgacaagcgaagtacagagacatctcaatgaaatttccaaagaagaaagagaaatcagaggc

SEQ ID NO: 18976 - DNA, 969 bp, Homo sapiens
  misc_feature (1)...(969): n = A,T,C or G
tttactgttcacccgaccggcacaagnaaggtccggacccccatctgggagtttacaccgncatctcatgtcatgaagatactcatgcagtcctatggagaatttcattggatattccatcaaaaacagatgttatttcatcaggggttgtcacagtcacaataattggatgcgaagacatcaaagaatcatcctcttgaacagatgactaggccgagaagacatcaacttctgtgaattctgctcctgcgacttctgtgtgacttttggatatgtgccaaacttttcaagccctatttctatatctgtgcaatgagaatgacgacatcactccacagatccggtctaagaatgacgagaggctgcctattaatcttgccaatatcagatgtcatgtctctcccacattaactcgcacccgcaatttggatacttgatcaccaatgaagggacatgttggtcgcatatcctatagtgctaaccacccttcgttcccctcctaaggattggatgtcatactagactggtggacacgcccacccccactgtccgattagcctcgttcaatacataattcatattactccacccaaacttaaaattaaaccaccctcgccatccattctaatggacgaagctcacgcgccgcacttcctcgctactcctcccatggattanctgtgtagtgaactgacggagcagtacctgcctccggcacaagatggaacccccctcctccctgtaatagtatcttgctgtgcatgcaccacaattttcaatacgaccatcgccagggctcgcaggtgatctgcgtgcatcgcctcaagagtaggacgttccataagtgtagtgaatatgacacgtttcatgtgtttcgctctggcccactcccgcggcacacccgcgactccttatttccagcggctataggcgctacggactcgtcacggccgtgcgaacgagcctcca

SEQ ID NO: 18977 - DNA, 952 bp, Homo sapiens
ccttaggacacagctgggaagtctactttctgcaagcccggaagagaggcttcaccagaaacggaatcagccagcactttgatcttggactttccagcctccataactgcaagaaaaatgcatttctattgtttaagccacccagtctatggtatttccttatggcagcccaagctgactaagacacatgatattccatcaaaaacagatgttatttcatcaggggttgtcacagtcacaataattggatgcgacgacatcaaagaatcatcctcttgaacagatgacaggccgagaagacatcaacttctgtgaattctgcttctgcgacttctgtgtgacttttggatatgtgccaaacttttcaagccctatttctatatctgtgcaatgagaatgatgacatcactccacagatttggtctaagaattaagagaggttgcatatcaatttgccaaatattgatgttcaggtttttctaatattaacttgttattggaatttggatacttcataattaatgaaagaaaatattggcagtttatcctttagttctaatcacctctcgtttccctcctaggtcttgtcagcaatacagactggttgacaggcctagcagtactgtcagatttccttggttcaaagctcagtctttttactttctagatatataagtttaagcaagtttcctcacccattaaatagaagtaattatggcctgtactttttggaactgtgcacaggactcagtgataaaattcatggttagtacttggcatagtacctggcacagaatgagaacctaacccattagctgctatagttattttgactcttaagcagtaagattttgaaatctaactctgctaaatcactactaactttaaaaatttcattggctctacttaattaaaaatatttccaaaaaaaaaaaaaaaaaaaaaaagaaaa

SEQ ID NO: 18978 - DNA, 592 bp, Homo sapiens
aggcgacactactcacttgctcctggagatttttcagaagtgtcacggcacttggcaggtcggactccagcaccccctacagaagggagaggaggcgtaaagaaaagtcattctttcctcaggattataggaaagtggaacgtctagggtgggaaactgccctctctccgtcagacacccagactcggggccttcacactcgggttcacagactcgccttaaagccagccccttgggttaccggacaggaacggtaactctagggaggccgcctccctgaagcaactttcatcaccacccttccctggtaccaacagtttgcctccagccgctgaaggcaaaggacaactccacaatagctacgcgaggaagaaaccacaccaaactcaccagcgccgccatcttcgcaaagcccaccccttccggtgtcgtacttcctgagcgctaagggcgacttgatagatttgatagacaactgccgcttgcaaatctaagccaatacgaataagggctctctcacttccgcccccaacaggataaacgagaggaggagtctgatctggcaaatggaataaaggacttatcgcaaaag

SEQ ID NO: 18979 - DNA, 528 bp, Homo sapiens
  misc_feature (1)...(528): n = A,T,C or G
agngnnnnagnnnnnnnnaggnnnnnntnnggacncttngggnnnccnttnggacngcnggtcgttctttatttcaataaaagnggatagagatctttcatatcagggacagggcttagctgtaaggacgaaagtaatcttccgggaattatgcatacaggcttgacatcatttttattggatggctgatgaactggaaaactccaggatagccaggctttaatttgtaatcttaattttcatataaatcggtacatttcagggggaggcagagggggatgtggggacattgatgcttgccggccttgtggtaataagacagctctgaagcacaggcagcagtactaactcatccagtatctgattctgtcttttcctctatccatctgtcttccatctttgcatccatcattcaacgaaatttacagcctatgcagatgttctgtggtcttaaacatgttgtattcantcatggaggaaggggaagcgaacncgtccttcttcatatggcggcagcaagaancngtt

SEQ ID NO: 18980 - DNA, 702 bp, Homo sapiens
ctagactgcctcttgctgccgccttatgagaaggacgtgttcgcttccccttcctccatgattgtaagtttcctgagacctcgccagccatgctgaactgaatacaacatgtttaagaccacagaacatctgcatagataaatcccagttgacagaactgtttaagagaagaatgtgctcccaactgggattacggtcacagtatttatctatatcaactttcatgttacttcactggcaaattgggagctttggaggataagaggataacttatgatcgggagaatctattttctgctctgaaggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccgaaagattactttcgtccttacagctaagccctgtccctgatatgaaagatctctatccacttttattgaaataaagaactaacatcacaatcccaagaaaaaaaaaaaaa

SEQ ID NO: 18981 - DNA, 938 bp, Homo sapiens
aactgcttcttgctgccgccatatgaagaaggacgtgttcgcttccccttcctccatgattgtaagtttcctgagacctcgccagccatgctgaactagtgaacaggaaacctacagaataggagaaaatttttgcaatctactcatctgacaaaaggctaatatccagaatctacaaagaactcaaacaaatttacaagcacaaaacgaacaaccccatcaacaagtgggcgaaggacatgaacagacacttctcaaaagaagacatttatgcagccaacagacacatgaaaaaatgctcatcatcactgcccagctaaatcttgacttctattgaagaagtgaaggatggattttgtaagccaaccagcagccaaaggagactaagaggagtcattcaggaatatgagggttatgaagacagtggtgtcccagaaaccaaggagaagaggatgttgcatgaagaaggagatgatggtttcactttggttacatttatccaaatgccccgtccaactcttcagtgtccctagtaaaatctggtatagagatggacagtgttttttaggtgaggcctgctgagtgtggagagttgtgaaaaatttttcccttaaattgagaatgttttaaataatgcagcctatgttttctttaagtaacaaggccatcccactgactcacactgatcttgttctcagcaaaaaactccctgctcttcctcatattaattgccataaaaacaagtcccttctatcatgcattaggctcattgagttatgaaaatatgtaggtatttcgtttctttttatgtaaatttatgctggttttagtccatcatttgaagtccagaagtcttctggaacttaactgtgtctgtattagttgtcttttccatcttgtggtttatggtaaaattaataaaagggcgatgccgtcca

SEQ ID NO: 18982 - DNA, 499 bp, Homo sapiens
  misc_feature (1)...(499): n = A,T,C or G
atggcatctctttctgttgctcaggctggagtgcagtaacgtgatcttggctgactgcagccttgacctcctgggctcaagcaatcctcctgcctatacctcccaaatagatgataccacaggtgaagaaggacgtgtttgcttccctttctgccatgaatgtttcctgaggcctctccagccctgtggaaattcctggagaaacaagctgctgtgctgtgaactgcttatggtggacactgtgtgtcaggaatgtaggctgtctccagacaataaggaccacttctgaccaacagccaacaaaacactgaatttttttttagcaatatgaatgaatgtggaagtggattctccttctgtcaagcccatagatgagaatgcagcctgcctgacaaatttactacagcctgaagtgatgctaaagcaagaactaagctaatccatacccaactcttgacctgaagtaacttgggagacaataaatatgtgatctgncagg

SEQ ID NO: 18983 - DNA, 876 bp, Homo sapiens
gaatagcgtgcagctgacatctcttaatctaccaccgctacagtccttgaaatattccttcctgacaaaagaccgtttgtgttttgtgatggaatatgttaatgggggcgagaggagactggaatgtgaattgatggactgagtgagaaatattcacccacaatgtgagcagacaccatccaatcaactaagagcccaaataggacccaaaaaagcaaagaaaaggcactctcctggaatggggacactcctcttctcctgtccttgaacatcagaactctaggctctctgacatttggactccaggctttataccagcaactccctagtttcccaccaaaacccaggttcctggcccttagcctcagactaagaatactccatcagcttcccagggaacttggacggagatacgttgcgggggccccccggtctccagcttccagatggcctgaaatagaaattttcaacctccataatcacatgagccaatttcccagtgaattctctctcatatatgtatatgtatccgattgtgtctgtctctctggagatccttgatttcaccacatcatccatgtgactccactggaagaagataccttaaagcttgcacttggtttctccaggatcctgctctttgtcgttttccctttggttaccttaatccgtacgttttactatcacgacctctgctcgtgaccgaacattaacatcggcgtagcttggcttcgggcgagagctctggactcgatccctctaaggacggtaacgcatgaccttgagcccggactcgagtgtgccggccgccccggtgcggcgcgggtcctcccttaatcctatgccgagttagggggcggccaggtaaaggtaaca

SEQ ID NO: 18984 - DNA, 1052 bp, Homo sapiens
  misc_feature (1)...(1052): n = A,T,C or G
ctgccatgtaaaagacatgcctttcaccttccaccatgattgtgaggcctccccaggaacctggaactcctataatcttcctgcattttcagtgacctcactgactggaaactgggcacctcgttccttctcacaagtgtcataatacaccatgaggtggttgggtcccatttccagaacaaccagagtgacgtctgaacaatgctctctaaacaagatcttcatgtctgctcccaaagagggttgctacattcttagcttccctcaatttaattcttttatgataaaaagaagggtgaacagaaaatgttcagagcaatcatcctctgaaaattcatataaatgacagcagaaatacaagaaggagattggatttcaatcctcttggaaacaattgatttggaagtggtctgtggtctaaagattttgacaaaattttaggagcaagtaaagatgatataaatatataaagagacagaacagaagggagatagccacatttcggaaaacatggagaaattatacaagtgattcttcccaggaaattcttcagaaatgtccaaagaaaaaattatggacttacaaatctgactgtgcgatgactgcaaaatcctcctttatcttncctctccctgacatgcatgcaaacacacacacacacacacacacacacacacaccttgagatttgcatcatttgtctttaggctaaaataagggaaaacatttcaaaatgatttaccgatttttttaaatgatgggcacagtaaccataattaagtcttccgtatttggcattggaatgaaggtaatgggatcaaacccaactatttacttctccttactcatccaaagatgcagtcaaccatcaacaaacacttccctagtatactgcccacaaagtcagctcgtaaattcagggaaaatagtttataagggtttcaaggctgtttaaaaacaccaacaccataagagagatggactaggtggaaaaaatacacaaagaaagtgcaacgagcagaaacaactaaaataaacaaggatccgcctagc

SEQ ID NO: 18985 - DNA, 859 bp, Homo sapiens
catagctgaaacgactctcttaatcttccaccgctacacgagattagaggacacattattcgtgggtcgggaggaattcaatgaatcatgaagaaaagataatttataaagaatatgtattaagcatctaccacgtgccatgggaagtgctggtgtaaccaggaagatgaagaaaaaaatgcacatggtaaccaaccccaggggtttacagtccgatgagggagaccgacaaaacaccaagcaaatgtagaagtggtggtcagtgacttcaagtaaaagtaaaggagatggatgtgatgaaagacagtaacagaagttatatttcagacaggttgttcagggagggcctctgaggaagtgatatttcagtggaagcctggagggtgagaagatgatgggtaggtggagagttgggagaagaacaatcaaagccaaaggaacagcgtgggcacgcctgaggctgaagagcacccgcatggagaaacccaaaaggctgatgtgcccactggatagtgaaggagggagaagaaggtgtgagatgaaattggagaatggggaaaggcagtaacctaaatgactgcccacagtttgtacttgaaaacttcgcattgatttcaatcctgaacgtcttgtgatctggagttcccattggatttttggttataatgagtcagtgcatcaagagtaccttgaggccgttactggggtgggccttaaatgagcacacagagatgctatgcacatagtgagtatgtatgtatagagacgggatctcattctgttgtccactgcactccagcctgggtgacagagcaagactttctcaaaaaaaaataaaataaaactcgtatgcggcaag

SEQ ID NO: 18986 - DNA, 486 bp, Homo sapiens
acttgcatatattgtgagaattaaatgggatactacatatcaagacttaccatactgctacgttgtgacggtgcctgcttccccttcaccttctgctgtgattgctatacaagaagcatggcaccagcatctgcttctggtgaggacttatggaagtttccactcacggcagaagggagaggggagcaggcatcacatgatgagagagaaagaaagagaggagaaggtgccaggttctttttttaacaatcagatctggacccaggaactcagagcaataagtcactcattaccccttccaccaggccctgccttcaaccctagggatcaaatttcaacatgagatttggagaggccagacatccaaactctactagcctatcagtagccccttactcttccaagaataaggacattcctgcattaaaatgtataatataatgctgagtgataagctcttaaaataaaagtaaaaataaataggga

SEQ ID NO: 18987 - DNA, 524 bp, Homo sapiens
cgatggatctttgtctgaaggacttctcctggagaacactgtaggggatggaaccacaggagcatcaagggaagaattctttgatggttgctacaataattccagctgtgtatacctcctgggatcataatagaaatgaacctctgaagcatcttactgaagaaggcccctacgttgactgtccagctgactgtctctacccgactgctgtcccacacaatatgggccaggcgatggtattgcctttgcaaactaaatgaagttcctcaaagtgaagctggtggcgacttcagagttaacttttcaaatggccgggcttatatagaataacctttgtaaaagtaaactatgatcatataataagatacatgtgcatttggaacgccactgcttttggaacctgtctcagtttttatcatcatacaaggttaattgtctaatgtcaattagattttatcacagtgcatttgggtcctaatctggaacaataaaagtctattaaacagcaaaaaaaaaaaaaaaaa

SEQ ID NO: 18988 - DNA, 832 bp, Homo sapiens
  misc_feature (1)...(832): n = A,T,C or G
caaaccttctggagtctgaaccagcaacgtagcacacaatatactacaaaactccttctcatgtcctctcactccagcacttccattctccccaccaatggccctatttgtttactgccatgttgctgttgcgtttcacaaggttgctgatttcttctccaaagatttgtttcccgggggcctcccagtgttgtataacctacagtgtatgacttggaggagtcaatgagatttcctctccattctaatcacatataagtctcgcttgttgcccanagctggaatgcagtgcagtggtgtgatctcggctcactgaaacctccggcaacctccgcctaccgagttcaagcaatttctcgtgtctcagcctcctgagtagctngggactacagggtgcacactactactcctgggtaatttttcttgttgcccagactgggnntcgaaactcctgacctaaaataatcaccagccttggcctccttgaatccggggaacttacgggcgtgaccccccttgcctcggcctgttttctcttttcatttctttaaacactgtaaaaggtaactttgaactggaaagccctcccattttaaaaaaaaataaagagattgggggagttattcttctcaccctacaatcttgaggggtgaaaaattgacaaaatttttgggtttgggtttcatgtaccaccactaaattgtggatcctcaagttctgggctccttgggcgctattatgggcctcgcctccctccggtaagtaatggttgcaataatagatgcgcccacttttttgtgctgttggcgcctaaagaaaagacaagaaagcg

SEQ ID NO: 18989 - DNA, 426 bp, Homo sapiens
  misc_feature (1)...(426): n = A,T,C or G
gtatcagcttgggaatctcatggaccagatctgtggcgatcaacccttgcaaagaagcacagcgataggacaacttccctaccaccgaacagtttacataaatcaaatatgtctcctacctgtgatggacaaggtcttggagggagcgcaggtggtgggggtaacaatcctgacttggtagctgaaaagaaaaacacatactattaaggatcaccccccaaaaataaacaacaaaaaactcttatgcttgttaacttggaatggcaatggcatttgcatttaacatctttaagtggttacagtccttctgaaggcttaagaaaaaagagtacacgtgatttggtaatccctttgggattgggatgctagcccaagctgaaggatttatgtaagctggagtgattaagacnacatagtagaatggga

SEQ ID NO: 18990 - DNA, 1042 bp, Homo sapiens
atccgtgtgtctgctcttcagcatcccctagggagagtccacgttatttctaagaagacaggagagaaggagggagaaaaaaacgtgcagatcaaaaggcctcagaaaaaaacaaagtgggatgaaatgctgggctttattctgtacaacctaagcattttctatctttgatgagtcaaggtactggcagttctgtccaccattacttttgcatcatcaatgcaaatatcaacacaacaaaaaggaaaataatgtcttagtattattatgaaaataattttgaccctgtggaccctctgaaagtgtttctgcagacagagttactgcaagtttcctggggacccttggttgggctctgtgtgccacattttgaggactgctgccctagagggagaaccccactatgaagccggtcaggtggggagacagcacttccattctctttaaatgatagaaatgtctaatttctgagactctctgtcttgtggagcactgtcgtcttcatggacacaggcaggatggcaaccatgtgatgctgctttccttcaccttccacctttgagtggaagctccatgaagtcctcaccagatgctgatgctggcgccgttcttgttttatagcctgcagagccatgagccaaagaaatctattttatttataaattacccagcctcaggtatttcctttacagcaacacaaatggactaagacatggtcatgacaaagtctcccatagaaaactgatctggccttctccaaaactgagggcagctgggaggcataaacagaaaaggacattggacaacactgggtttagcctgagagactctcctcactagagaagcagattttcagttgtccaatcaagctgctaaagaaagaggggctgatttgtcagactattttgtctataactagggtagccatatatgccaagttccccaaggcagtcttgattagcttctattttttggcacaattctgaacagtgtcacctcttttattctaaaatgtttctaaatagaagcggagtgcccgaac

SEQ ID NO: 18991 - DNA, 675 bp, Homo sapiens
cacacctattcgccgaggcatcacctggatcctacagagtcagccttggccatcagtgatggtgaaagcaacagatgtcagatgtcagcccctggcttcctgccttaccgtagagggatactcgacagactggacaggcctcactctgtcacccaggccggagtacagtgatgcaatcatggctcactgcagcttccacatcccaggcttaagtgatcccccaacctcagcctccttgagtatctgggactgcagctgtaccctactttctctgctgggctaaagagcgtcgggtgcaaatcacagccacgatgaccacttaccagcactgtggatgacaccaccggggaccacaatgatcacaaggcgggttgctgttcttctgaggagtgacactgccataaaaggggtgcatttgtccaattggcggctctgggaaaagacaggaaaatggagttcaggtttaggaagatgtggcagaagttttaccaagctctcttgggatatacaaagttcctaatgttctgggcttttctgaacttaggggtagtgatgggagttcgagggaagcaatgaaaaaatgagaggaaacacctatttacacaaaaaaaataaacccgtatgcgcccaccccccctgttttttgtgtcaatttttagtcggaacatgaagcag

SEQ ID NO: 18992 - DNA, 423 bp, Homo sapiens
ctaggtatcagctgaacgaaatcaaactatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcattggtgagaagaaaagaacaggagaagaactatgaaaacagcagatgtgaggagcaagaaagatggtgattggctgcgctaaactgaaaagttagtgaaacttcaaagttgggggattccaactgatatttttaaatcagcaatgtctaaggtgaccattaaaaattgtttttgttcctaggataactcatcttctcttctgctctatgaaatcttagataaaatgtgtattcctcataaaaaaaaaaaaa

SEQ ID NO: 18993 - DNA, 464 bp, Homo sapiens
catggtatcagacgaacgaaatcaaacaatatttatcacaacatattggaacaaagaacatctagtaatgtaatcaataaaagagaaaatctcctggagaaaaagaagaatcaacgtaaaataagaataaaaggaattcaaaataaagatatcttgaagagaaataagaatcattaagcctggtgtcagctgatgccaagtcttcaaggatggaaagacattgccctacagaactagggagaggaacgttgacattttgtttttgaaagggtgagaagaaaagaacaggagaagaactatgaaaacagcagatgtgaggagcaagaaagatggtgattggctgcgctaaactgaaaagttagtgaaacttcaaagttgggggattccaactgatatttttaaatcagcaatgtctaaggtgaccattaaaaattgtttttgttcctaggataaaaaaaaaaaaa

SEQ ID NO: 18994 - DNA, 1004 bp, Homo sapiens
  misc_feature (1)...(1004): n = A,T,C or G
gactgttagttaaacaatcacaaacacaaacgaactttcacgagagacagttaccctatgttgcctaagctgccttcgaactcctgggctcagcatcccccatgaagtggcgctgaaagatcacgatagcacagttccatgatgtgaaataccacaagtctgcaatttttcggtcttgagagtgtcgctgggctgagaggatggaaatctttcagtaattataccagtttgtattcgtctcacatttgggaccaaatacaaatccgatccactctttctccctgtgaatattcataaaaaacaaagtgccaattctggtctaatcatgtatggaaccaaatatgttgatgagtcctaagtatatactgtatgtatgtatacatatgaatatatatatttgtacacactaattttgcttgtgtcctcctctgtgcaatttgtttgtttagtataggggttgctgttataatgtgttaataagctgctgaaagcttggcacctattacttgaaatgacagctatgttagaagcctattaacactccatagcagcagctctgcagctactagaaatgaatttcaaagaaggtaaatgaacaaaagcgattcatatctctaaggaaagcanataccatgcctagaaccatatatactttggaaatgtacagtgtataaaaatgaaaaacctcttccagttaaagaaacagcggaaggggaatatttgggggaaaggaagactgcctaaaagatttccaaacaaccttgaagatgtaaatgaaaggataccaacactaccttctctctttggttctattggatttaaacccgatccttgtcaacttataagaacagaatatagtacaggtagaggaaattacttttcttgaccaaagttaaatctctggatttagctaaacttcttttttttcattntgaattaagaagacaccttttgttttgtctcggaaccaggctcttataggcaacttgtttgttttgaacata

SEQ ID NO: 18995 - DNA, 704 bp, Homo sapiens
acaaagaagccattttgcttttagttaaacaccaaatgccttaaatgaagtcttcaagtttaatgttaaaagataccaaatcatagaatttcattaggaagactacaagttaaatgtatctctggagggatagacaagaagctgaaaagattacctcaacagaggagaattagttctacaggcctgggttgaggactattctcaagaagacagtcggaatagctcaggctctctgtgctcctggctgaacccctaaggtggcacattctctctagttgtaaacattctagtgtatattcttcccgacattcttctctgcacacgaagatataaatctaagaaaaacagcagcttaggggtaacaagaaataaatgctaagtggccccaggaggaagtcaatttaacatctgcatattttatttaacatataattattttaattagggaacctgggaaggactcagagtgcctatggtgtatttgatatacatcagcctatttccttgttttctattgaacttcaaccactggatggaacttctttacaccactgtttaattgcttcattattccagtgagcaggcaaggctgaagaggaggaattctggaagctggaataaagaatttatatttgtactgctgtgtgcttagcctctggttctggaagacctttccaccacacctcttctgaaaaaaaaaaaaa

SEQ ID NO: 18996 - DNA, 872 bp, Homo sapiens
cataccatgcttttgtcgaatggaatggaagagaatcttcgaacggacccgaatggaatcatctaatggaatggaatggaataatccatggactcgaatgtaatcatcatcgaatggaatcgaatggaatcatcgaatggactcaaatggaataatcattgaacggaatcgaatggaatcatcatcggatggaaacgaatggaatcatcatcgaatggaaatgaaaggagtcatcatctaatggaattgcatggaatcatcatcaaatggaatcgaatggaatcaacatcaaatggagtcaaatggaatcatgatgtagaaatgagagtctaataagaaagacagaaatatatagaatcatattttaaaatgttttatatttgtattggtcttctacgcttgtttaacatcccccgccacccaccccaagcctaaatatgtcactattgttattatcatttgcttcttgtctggtttctttgccagagagatgaaaacaaatcatttttttgctcaaggtaatgagaaagaaaggaagaaaaataggaaaacagaaagaatactggatactttgaaaggacatgatgaatttaagtgattgggacagcttgaaccgggtgtattcagcaataaaaccccttgctgttatgccactaaaatatttaccattgtcacttgctttcataattgctatgggtctttgtgagttttaaattgattttgccacttgtgcctgtttgtgttctctggctcatttagatttaaacatttatcagtgaggtaaataataaattttgcttgatttgaaaaattgggctgttgtgctttggctatcagctcattaaaggaataaaatcagtatgccgccaagg

SEQ ID NO: 18997 - DNA, 179 bp, Homo sapiens
atattttaactgctgtgccatctcttctaaatctggagtggattttttgttgtttgtttttatgtttttgttcaattggctatttctgagatgaatgacaaatttccttgattccattgtatatcaatttatactataatatctataataaaatgttgacaatgataaaaaaaaaaaaa

SEQ ID NO: 18998 - DNA, 380 bp, Homo sapiens
aattgcaaaacaccagggttctgtatgtcagaagctacagaacagacgtgggagttttctcagggagcccagagggagccatccaatgcccttcatgaagtcagcatagtcagccttgtactgattctgcaaaagaggaaaaattaaattatgagaagaaactggaacttcccaagaatcctaagtgtgtgtttaacattctgtaacttccatttcatttgtaaattttctgtaacttttccacttcaatatttgcttgaatattggtatttaaccaatagcatgttgaacttcaaccatttcttccctaaacttttatcctttttatatttccttgcatgataaattaaaaataagcagaaatgtcaaaaaaaaaaaaa

SEQ ID NO: 18999 - DNA, 1305 bp, Homo sapiens
agagataagaactcacattgagaagagttaagaaacttgctcaaattcataaaatcaagaggagaggtggatgtaattaaagccaagcggtgtgacaaatcaaggaaacttttcatgtcgtcactgctacctcatccgtggccacaaaatctcagtcaagatctagggttgatgcaaactggagtcattcccagtatccacaacacttctcttgtgtcttctgggaagctaagatttcatgcggggagtttcattgctgcctgaatctatcgcatattacttgagagcctcatttattccatgctacaagatccatgcaagattccaggatcaccaagatcactccaggaaatgaagagatcaagagagctgccatggacaagtctctgcctctctgcttcagcttctagttccctataatataggacaattccttgtacaaaacgggtgctccataaatatttgttgaatgaacttcttttctagatggtgacgtgatggcaaccttaaaacctcatgccattcttcctcatcattctctgggttaaagaaaggcctaaacttttccagcaattgacagagccttggtgtgtcatattgcctcattgtgcctcagttgtcccatcactcccacttgggagaggatatgaatgaatggatcttagttttaaagagctgaaggtggaattcagttgcctgattgctagcatagatagtacctctatgtatgtgccatttcttttttttttttttttgattgtttagttcatttatttgtgtaaccaattttgattaaaagctgaacactgtgctggaagctgaggcttcactggtgtagggatgccatttctgccccctaagaatcacaagggctagagcattgcaggaggtccttacagcaacagttaccatgaactaagcctttgcttagtgcaggcactgtgttaagagggaagttggtaatgatttgcccagggagggatttggtacggatatgaatatacttctggcttaagcaaagagcggtttagaagcacataaatggcgcattgtgtgaggcataggacgcatgtgggtggccttttgtgttagactaagaatcctgagcagttcccgcttcagtataaaattctagtggtgtgagggcataaggtgaaaaagagttctaaaaaggtaaaaatttatacatgctagaaataaaatgagaattgttttcattttcatgattcttcagagaatttatttattagaaatattttaactacttaaataaaagattttttaaagtgaaaaaaaaaaaaaaaa

SEQ ID NO: 19000 - DNA, 600 bp, Homo sapiens
cattgagaggaagtcagagatttgactgctagcagacaatggggagctcagtcaataagctttcaaggaaatgaattctgcctacaaacaatgaacttggaagagaatcccaaatcccaaataagaagcccagccctggacaacactttgatttcagtctaaagaaaccctgagaagagaatacagtgacattgtacctagacttccggcctacacaactgtaagataataaatacatgttgttttaagctgtacagtctgtggtaatttgtggcacagtaagagaaaactaatacaagctgggcgtggtggctcatacctgtaatcccagcactctaggagacccagaaaggcggaccacttgagcccaagttttgagaccagcctgggcaacatgtgaaacgctgtctctacaaaaaatattaaaaaaaaatcacccaagcatgatggtgtgcacctatagtaccagctaattaggagactgagctgggaggattgcttgagcccaggaggtcaaagctacagagagctgtgatcatgccactgcactgcagcctgagcaactgagcaagaccctgtctccaaaaaaaaaaaaaaaaa

SEQ ID NO: 19001 - DNA, 634 bp, Homo sapiens
ttagaattttgtaactagccagagggtttttgaaggcgtctctcataagatggcatttgagcagagacctgaggaagtgaaagatggagggctgaagcttccagttagaggaacaagcaaagaccccgagcaggatcaggaaagtgtggtagagacataatcaaagattcagacaaagatataactacagaatgcacatgacggttttgttaatacaccaaaaggaaaaaaattaaataacggactctcccaataaattgtgaccatctatagtttggaataacatgaagattgttaaaaactatgtttacaagaatggcaataacagagaaacacttgctatataattttcacaataacaaggtgaagaaatactatatatatatataataaaattcaaatttttaagagaaattaaaatgtatagaaaacattggaaaaggatacacttaataatctttttttcagcatggtagaattgtgggtgatttttgttccctttatattttttaatactttgtactttttaatgacaaatgtatatactaccatttaatgataaaaatatatttttaaaatactggataagaattattcaaataaatgccttatttaaaagttaaaaaaaaaaaaa

SEQ ID NO: 19002 - DNA, 787 bp, Homo sapiens
ttttttttttttttttttggatggtatttccaactatatatcctatagaaaattgctatcttcatagggcacttcaacacattgtggcctccatagtcaaatgaatatggaacagcagtagagggagagacccatttctttatgagctgcatcattcttaatctaattcaatcttcattggatctttgacgaaactttcttcacatagtgagactcattaattctcgtttattatttaaactatcatttaaaggaggcacactttacttgtgatatgagcgaaacttagctatgctagggactaatatttatccatcatatttattacctgaatatccgttcaaaacaattagaccggatgctttatagacctttatttcagcgctggacttggatattacccggtgtctgtttaaacattcctcaatttttgcaaaagataagctgccgattgttttaaaaattttagattggcgttttgccaaagttaataattggccaaaaaaatctccttttaccatcccgcgtgaaattgaaacttccaatagttatttttggaaacactccaaaacgggttgactaaggaccttattatgttgcgtgagaacgatattccccttggcgggggctttagcgaatggtaacaaatgggtgtgcgcaaattttttaaaaggtcaggggcgtctttttcctggtattcctctgtagcacgcccaaagaacaccttggagaacccttttcccctttaattatatcctagagcacaattaggtagggcttgcgcatt

SEQ ID NO: 19003 - DNA, 180 bp, Homo sapiens
ctgattttaactgctgtgccatctcttctaaatctggagtggattttttgttgtttgtttttatgtttttgttcaattggctatttctgagatgaatgacaaatttccttgattccattgtatatcaatttatactataatatctataatagaatgttgacaatgataaaaaaaaaaaaa

SEQ ID NO: 19004 - DNA, 1117 bp, Homo sapiens
aaaaatgaaagacttagcggtgttttttatattctactcttcctttcgtccaacgaaagttgttctttgaagactcttgcataatgactctaaggggcttcagagacattctcctgcgaggtaactgtgcctgtgatgtggggagagtgtaagactgggaagcagaagaccggaatgtgatacagcctttcccacgacttggctgaggaactgctgttgtgaaccttttgccctggtgggattattgtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggaggatgctgatatgctaactggtgatgagcaagtatggaaggaagttcaagaatccctgaaaaaattgaagaactgaaggcacactggaagtgggagcaggttctggccatgtgccaggcaatcataagcagcaactctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattaaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgagaaaaaaaaaaaaa

SEQ ID NO: 19005 - DNA, 526 bp, Homo sapiens
ccctagttgaagcagacaggaaagtatcttcttttaaaaaactgagctctatctgtcctgattcctggtgctgcttcaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggatgccaaaaaaaaaaaaaaaa

SEQ ID NO: 19006 - DNA, 1186 bp, Homo sapiens
tttttttttttttcaacctaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagccagtctcagattcttcattgcttggggaaacatgccttgatgtagctgcagtttgccaactttcatcacttgaacccctctgacgggatggcttcctgggaaaaaaatcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccacttccagtgtgccttcagttcttcaatttttttcagggattcttgaacttccttccatacttgctcatcaccagttagcatatcagcatccttgtcctgggtttggcaacggaaacagtcacattcaaagcagtactggtccctcagctgcttccggcgctcctcactggtcatcagcatatccaggtagcagatggtgagctcctctcccacctcgatgtctcggactgctcgcagtaagaggtggggcccattgaacacaatcgaacagttggggtcacagctgtgattgagcaaagagatactgggatataggccaacaccaacttcctgcatctccgcattacagatggtgaaagagttgcagatcacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacagagaacaacttttcgctgtgacta

SEQ ID NO: 19007 - DNA, 504 bp, Homo sapiens
ttccggaggctgggaagttcaagtcatgaaatccaagatgaaggtgccagcaggttgtctggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggaaaaaaaaaaaaaaaaa

SEQ ID NO: 19008 - DNA, 771 bp, Homo sapiens
  misc_feature (1)...(771): n = A,T,C or G
ctagaggaacactgacgagaagaccttatgaaccaggaatattttgtactcgatgtggcagacgtgacaaatgcacagattttctatgcagtaatgcagatcgtgaccaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatatacccctgaggaatctgaagcagggaatgaagaggaggaaaaagaggaagagaagaaagagaaagaggaaatggaaatggaaataatggaaatggaggaggaaaaagaagagagagaggaggaggaggaggaaacacaaaaagaaaagatggaggaagaggaaaaataagagtagaaagaggaggaaaaagatgtatcaccaatataaaccaaaagtgtaatacaaaaaaaagacagaaaaaaaaaaaagtaaaacactgagttttaacaagaaagaaaatatgcaaaccaccattggaatgttttttattcccttctctcctatacttattcaatcaatttanatttgtaaaacaaagaaacaaaaaacatgtaaggtgggctctttgacactaagaacagataaagacttgacagggaaaacactgaaaaacatttgaccagtcttattatcttaagatttcaccatgttattctaataaagt

SEQ ID NO: 19009 - DNA, 211 bp, Homo sapiens
cctggaagaactgtccccactcctagattttgaacagtgtgttgatgttattgcttcgaattgcatcccgacaagcagtgatcacggtggctctttggttttccaactgcataagaagaaacatcaggaaccaaaagattgttagacatgaaattataaaattagacgtcagttttaaaacaacataaaaccaggaggaaaaaaaaaaaaa

SEQ ID NO: 19010 - DNA, 803 bp, Homo sapiens
cagaggaaacccaatccacattggaacaaggcttcttaagacatggatgtaatttggtggatcccaccgggctgggattacaggtgtgagccactgcgcccggccaaacatggatcatttcttcgtgttacaaacattccaattatactttagttatttttatgtgtacaataaattacaaagatagtccctgttggtgtcagaatgaagtctacttcttactgaaacatcagacacaatggttagcaatttacaagagtatcttatttcatcattaaaaacactgttaaagagaaaatatattgttaattttattaataaaagaaaccaactattttagcaattaaataataaccagaatgcaacttttaacatcacaatgccattcatatatagagaaattggcctttcaaatccatccaggatgagaaaaacctgaaacttttatttttcctctatctttaaacaactattgaaaatagtcaagatagacaaaagaatgattttcagacctacagcagggctgcgcaaaacaatgatccctggaaaaagggaaccatacaaggtgactgcgtgattgccctaatcttgacccttaggtgggcccaagttcttgactttgttgcaaaaacattttgagagtccaaagaagaataggggaaaacctttttgaaaacaaaatatactctgaaaggggtccaaacaagctgctgaaaatgaaaccgccactctggcatggggaatttctttagggaacttatttattttcataaaaggggagatgggcttgtgttacattgtgg

SEQ ID NO: 19011 - DNA, 801 bp, Homo sapiens
cctgactcttcattcctgccttgtgtgacccagggatggaggactgccctcccaactcattatcctctttgcccaggagctccatcctgttgccatctgctaaaatcctcagcccacctgcatagtgaacatcattcattgttttccagaaatgtgcaagaaccacagtctcccccaagactgaaggtaacatcaggaagcatactatgtaagacagatacaaaggggagctgctgtatggtaaatttgaagtcaactgagactccctgtggttttccccaaaacctgataataagtcaagagttaagaaggtatggagaggaaattaagctggagtgcactttggtcccagctccactacaacactattttgtgaccacaggaaatgaagcttgcaatattgccagaccacaaagccagacatctctgctacattttctagcaaaagaggtttcatggagagcttacttcctcaagttcactttggtcttaatgaacggttaagtctcatgggtggaacacagattatctacctgtgctttaactacaaagtagccctgatgaggcactgatggagatctaaaagcatcaggaccatctgggagaatcatggcctcaccaaatgaactaagtaaggaaccagtgaccaatccctggagagacactggaaatcctcttaaccagttgacccaatcaaccatcactctggttcatctagtcttactgaggcccactgatcagtagacctcctcgacattcaatgttcttctcccatcagctaaattatatatttattaggtg

SEQ ID NO: 19012 - DNA, 549 bp, Homo sapiens
accggaggagccctgggggccagggagaccacggtcgcccttctcaccctgttcacccggaggaccgatgagcccgatcaggcctggatgaccctgtgggaaaatgaagacaggaaggggcatttgagggagccacgtctcatgctcggccacggtgggccagttagcacgcagcacagccatggcacaggaagctttacatcatggtcagcctcccctggaaggggaacaggctcaacagaggggccaggtgacgaaacggcaggtccgaggtggcccttcgctggccacagtcacgtctaaaaacagacagggagccacagacactgagacagaccaaagggaataaagggggttttcctgagtgggaagggttatctctgtctttctcttcggatacgctctccaatttcctatgggaaatcccgaccgcctgcttctatacggagactaaaaccaagtttggggactgacacggaaagaaagatgcagagtattatagatattacaatcattgggttgattttctaaaaaaagaagaatccctga

SEQ ID NO: 19013 - DNA, 342 bp, Homo sapiens
ttcttcccccaaattacaaggaatggaggctaggaaactacatttctgagactccttcatcatcaggatgccagataatattttaagtttttattgctgctgcagtcaaaatgtggactttgattgacattttccaggaagagaattgtgagaagaataattggatattctgtaacattgttctaagaactgttagctctgttgcattttcttggtttgacattttgcaaaatcctactgtcttcatttgcaaggtagaatggaaagtttatggagacttgggcaactttcctatgaaatctgccaattaaataaacaattgagattggaaaaaaaaaaaaa

SEQ ID NO: 19014 - DNA, 838 bp, Homo sapiens
taaaaggagagcaggatcaattaaaaaaaaaaaaaaaaagctagcggcactgatctcttaattacaccgctacagctactgtggcctagaagtaacatgcaccacttcttgaactgggcattgaggtattactgtccaagaatcccttcaactaagatatcacatagaaattgaaccactcttgggaacagatagtgaggacgagaaaagaaaaaaaaagaagaaggaaattgaagcactgacatatgagggaatagttttgtaatgatttaataattactacaagcaccacttgaggttatgctggaactattggcgtaagaatcttattaccagggattccccggccagatggccaaataggaacagctccagtctgcagctcccagtgagaccaaggcagaagtagtgcctggaactccagcaagacagaactgttcactccaatggaaagacggctgaagccagggagccaagaggtcttctcagtggatcccaccaccatggagcccggcaagctaaaatccactggcttgaaattcttggctgccagcagagcagtctgaagtcaacctgggatactcgagcttcgtagagggaggggtgcctgctattactgaggcttgagtaggcagtttgcccctcacaatgaaacaaagcctccagtaagttcacactaagtggagcccactgaaacaacaaaatcctctggttccccactggctttgtaaattactcctctttgagcagggtatccttaaaagaaagggagcgcgccgtgtcaggggccttatagtgaaacttactttttctaaacagagaccttgggaaagggcgg

SEQ ID NO: 19015 - DNA, 804 bp, Homo sapiens
  misc_feature (1)...(804): n = A,T,C or G
cggctccgaacaccttcttagagacattgagattcctgacttggggttaccaatgccttgtggcctcagctgatagaatggacaaagtagaatgctcactctagaaatccatgggtggagtcgccagacctcatctggagttggtatctgggagagccaggagcgttattacgagctggtgtagaccagacaacctgaagactggttggagtggcagatgaaagcctgggaggcagcacgccatctggagctgtcgaaaaacacagatgaattagagcagagaaaactgtggagaacatatgctggatggaatcgaaatgctccatatactggaaaaactgttcctcaggatcaacaacaatgttaaacatggtccatttaatttaacattttcattcctgaactcctgtacttncttattgttcatttcaacacaattacattagtatttcagtcttaaaagccggcccccaaacagcaagacaaatgaatatgcagcacattcccacctgtacttctgtttatctaattgaaaacatggagggaatttaatgaagcaaatataaaagtacctttttcatttaactctttggtcacagaccaaacaattgaacacttgagcagtccaaatcccatatttttccccccgatatcttcatttgctggcttaaatacaccactacatgtggacccaaggggctttcttttcctttactttttttttggaagaagggaaattacctaaaattgtattttttggaaggaaaaaaaacatgatgggggattcaagggttccagccttat

SEQ ID NO: 19016 - DNA, 926 bp, Homo sapiens
  misc_feature (1)...(926): n = A,T,C or G
cctggcccgcatccggatttattcttttgtttttttttgtatttttgctttttgctgtctatcgtttgtaatgggctgatggaaagaaggaaaaaagttttttgcccttgttttacccgggggcaattggaaaaaagcttatttttaagccttacgcctctgcgcgggaaaaaacaccgcgtattcaacacggttatgacagggggaaataatgcctcataaaaaaggttttttaaacaccaaaaaacacactccggctttttttgttgggttccgcctctttaaaaatgactctggcgtcaagaaaaaaacagtgtgcgtttctaaaaaaaggggtttttttaaattataaccttcaaacccctcttgaccaaaagaccgagaatttttcggggtttttgccctctgggcttggtccttccccccaatttttggattgggggggccttttctgttttatgccccctttccccttaaaagaaaagggttataaaaacgttcttgatgtttccgggggtaagaatatttctcttgaaaaatttcttttggtggtggtaggcggttattcccacggcttcaccctttgagtgtggcagataaaggcgtcctttctctgcagaaacgccttgttggcccccctttctgaaaaacgagggagaatagttttccccgctttctagaattttgtttggccgcttggggtctcattttttgtgagncccgccacccaaagatacctggcgcctgtgctaccttattatctccaaaacctataagaaggtgtttatttcttctttttgtgccccagggtgcccggttttgagaggggtgtgttaaagggtcttctcccacaaacctctagttaaaacgccaccggtgtggtttctcgggtgcnaagatgtgtctcttatctggaggttagaaag

SEQ ID NO: 19017 - DNA, 272 bp, Homo sapiens
cgtagttcacttatgtcgaaaatacagaaaaatgtaaggaagaaaactgaaataatccacaatcccacaaagacaatcagtgtcaatatttttgtgtataagtggttttacatatataatatatgaattatacacatatatgtaataaaattggaattaaaatttatacaaaaacaaaaaaaagatgtcctgctctgcggacctttcccttcactgacgtttaatgaaggatcctcgatgactcactctctctgcctggctgctctcgtgtg

SEQ ID NO: 19018 - DNA, 222 bp, Homo sapiens
tttccaggattcactttgtgcattatggtaatatgttgaaaatacagaaaaatgtaaggaagaaaactgaaataatccacaatcccacaaagacaatcagtgtcaatatttttgtgtataatttacaagttctttttgtggttttacatatataatatatgaattatacacatatatgtaataaaattggaattaaaatttatacagttaaaaaaaaaaaaa

SEQ ID NO: 19019 - DNA, 327 bp, Homo sapiens
cctctttgaaaaacggataaaggtgaaggggtccggtacaaagccaaattgatcgggattgatgaagtttccgcagctcggggagacaagttatgtcaagattccatgatgaaactcaagagttcccttatgtgcattatggaatattttgaaaatacagaaaaatgtaaggaagaaaactgaaataatccacaatcccacaaagacaatcagtgtcaatatttttgtgtataatttacaagttctttttgtggttttacatatataatatatgaattatacacatatatgtaataaaattggaattaaaatttaaaaaaaaaaaaa

SEQ ID NO: 19020 - DNA, 1046 bp, Homo sapiens
  misc_feature (1)...(1046): n = A,T,C or G
tatgtcatggttaaacctccccatgtattatataagcttaggtatataacttctattacataaagaagtagtaaaggcacaatgtttacttacacaattacatgtagtgaattagcacttttgtaactcagagacatgaatgtcaacaattttagagcagagctcatttgcacggtcataaggttttcatggctgctgtgactcngtatacaagcatttcaaagcaggccccccagccagtggcatcggaaccagtggcatcaggggaagtataaacaaagaaaattacagattattgtgcccacaccccagaaattttgattcaagtttgagatagggctgacaaatctttatttttccaaagctccctgagtgatctatatgtataaccaggctctgaaccactgatgcagagcaccatcatttcttgattggaatggatgcctgaggatagtaaaacaacaaagttaaaacatgctgactttttttagaccctgaaattaccgatttggtgatgggtgttaaggttgacaataaaaaccatttctccaatggggtcatggttcgagagaaccatgcgctttccccaagtcatggatggccttgttctccagcaggtccatctgcttgtctcttggtctccccacattgttcagcattgctctaaccacggtcaccacaggccaagagtctggtaaggagccaaagaactttctaaccagccattcacctgggcgagattcttgcctatcacataacagaactccaggcatcaaattttaattcttcaaccttggcttctacttctcccttaacttgtagatataaaaaattgcttgatttatcagctcctttaaatgtttgcaccctccagcttttgccagctctgcagacttcagcacataatctcggtcaacacgaacaaatccctccgcccggtacccaggcaacagaatccaacatcatgaccttgaaaggcagaggcgtagtcatccaacttttcaaagtccaccactttggataattaagagagtcgttgcagctag

SEQ ID NO: 19021 - DNA, 1172 bp, Homo sapiens
cacaccttgtgcttccatagaattgtcggcctctgcaacaggaaagagcagctctggggaagtcgctggtgctgacaacctttgctcacacccctactgggtccccgtctgcatcctccaacaccctcatcctgcttcctttacatagagttcattctcaaggaatcttttggcctgatagtgaggcctcctgcaaggagaaggaaagtcagtgtctgaatctgtttgggcggctataacaaacaccacagaccagaaaggaacctgcagaactccaggaaccaaaattgctgctgtaaaattggaggttgactaggaaaatgccttttcctatcaagtcacgtgtgctggggcatgagccactgcacccagccttttaaaaaactttttggccaggttgttttataggctcatgcctataatccctgttctttaggaggctgatgcaggtagatcctttgagcccaggagtttgagaccagcctgtgcaacatagtgaaaccccgtctctacaaaaatatacaaaaattagtcaagcatggtggcatgcacctgtgatcccagctactgaggaggctgaagtgggaggagctcttgaacccgggaggttgaaagtgcagccatgctgagatccgcccactgcactccagcctgggcaccagagcaagacttttttcttgaaaaccaaaaccaaaaaacaactttccaaatccagctctttggccatggcaaggcccagactgaaagattattatttattataatttcatggctgttttgctcaggggtgattttcaatttgaacatcaaatttggcatgaacaccaaccaaaagcagccaatactatctatggtgtttgggtgcgctggctgatggcagccccaggactttcagcgggaatttccttttgtgctaatgccttgctgtcccccgcaggtgaaacgatgctggtgaagaagccaagtgtcaggtgtgcctggcatgtcctgagaatctgattcctgggggtggtgcctccctggctgcgagggcccagggcaggcctgctgctgttctctccctcctggtgcaggagaacgcgcaccccgaccaagttggaatctgaagatggatcatccataatataaaaaatgacactccaaatcggtatcaaataaatcaagatcggcag

SEQ ID NO: 19022 - DNA, 1159 bp, Homo sapiens
tctcttaatttccaccgctacagatcccaattgaatgagcgccattttgcgatctttcctgaaaatggtataagaaatacagaaagtatttagaatgaattttgcttccaaactccttcctccaccagaagacttcactgaactacctttaaaatttgcataccatattaaataattttaatgtatttcttgaaagcaaagacttactgaaagaatttaaaagccttcactgaacatccagcttctatgaaaaggttcttcagatcatccactgtaacagaagggctgtgaaaacatcagagggagtcaactacctgggccgcattctcaagtgaagcagattaactcttgcaatcatcaaatctctagagtacatttcaaacagaattattaagccatatgacaaagacttgatttggaagttccctgaaagatgttcaaaaactgacatgtatcgtcaagcaatggaattttgtctaatccttgcagaagacatgtgcaggtatacaaagggcaagaaaaatctttctatattcttttttcttttaatgcagctgtgcctggaatctatatttattcttattagtcataccactggctttagtaatcaactgtagtacttccaaagtttcctagctctgacttgtctgctacagtctggagttccatattttcaactgtttgcagggtaattctgaatgtgtgtatgtggctgtcaggctctaaggtggcccccaattactcttgcctgctcatattcatgcccttgtttattcccctcccatagaaagcacaggtatcctctgtaaacactttggatactgtagaaatgacaatgtgtgacttttgaagctgagagacattgtggtttctactatgtcctctcctgaatcattagctttggaaggacaccgtgaagacactatggagaagtcctcatgacaaggaactggggccttcggtcaacaaacaggcacatgactaagccattttggaaatggatcctctatctccagttaaaaccttcagatgaccacatccttgccttgcatcgtgattacaaccttatgacagactcagccaaagccacccagctaagccacttctagattcctgactcacagtaacaatatgagataataaacagagatcggccgat

SEQ ID NO: 19023 - DNA, 726 bp, Homo sapiens
ggggggggggggccccccttttaaaaaaaaaaaaaaaagggggctccggccccccaaggggggaaaatccccccaaacggggaattttttttttttcaaaccccgggggggggaaacccccttttttttaaaaaaaccccccccctttttggggggggggggccccttgcaaaaaaattttggaaaggggaaattttgccccccccctcggaaaagggggcaaatgagggggggggagaggccttcaaaagtctttaaaaaaaaggggggccccccagaaggcccttaaaaggggcgttttttagaaaaaaaaaaatgcggcggggccccctccccccaccgtggcaaaaaaaaaagacttttttcagggggtgaaagaacgggggccccccccccccacagaaaaaagaaaaaaaaatccttttattggggggggggaaaaacccccccccaacaaacccaattttaggggggaaagcgttgtcgcggccccccaaaaaaaaaagaaaagaggcgccggggcgccccccgagaaaaaaaaaggccgggggcccggggcgccccccaacaaaaaaaaagagtgggtgtgcccacttacaccgcggcgggggggccaaacaaaacaaaaaaccctctttctccctctttggggcgccgaggagaacaaaaaccaccccgggggagcgcccacaaaagtgatggggttcgacagacagcaaaaacggg

SEQ ID NO: 19024 - DNA, 845 bp, Homo sapiens
  misc_feature (1)...(845): n = A,T,C or G
agtggtatgagtattatgtatcttttagcaattaccttgaagaaataccataatactatatgtggaagacatcccattggggtgttattaaatgctatcacagagctccagaagatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatcttccagttatagtcaattactacccatgttgtacaacagataccttctattttagttgctaataaagggctacacaactgcaaagacnagaaaatacaggacaatagaattgccgattttgatcacaaataaataatacaacgataaaatgctgtattacacgctc

SEQ ID NO: 19025 - DNA, 892 bp, Homo sapiens
  misc_feature (1)...(892): n = A,T,C or G
tagacatcggattttttccacgtgtctctcccattgctggcaccgcaaggctgtcccttcaaaagctggtagctcaagcattcctcttacctccgctttccaagctgctgggaccacagatgtatcctccactcctcgctggccaccatcctgctgcccaacagaagaagctcttctgtctccgatttcctgaacggtctaagggagccagtgggctaggcccatgctttggttcaaagcgtttggaagaacatcattcttggctcctttntccggcaaacgaagataatgcgacnnacagagtgcccagacggtcattctttgggaccgggaaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacgtcagttaatgttccatccatgctgcttaaagagcattcctgtcctagtaaaatgggcaagtccctctaccccccacccccacctggtatgcttacattaatagctaaagtcaatcctgtaatgaaataaagcaagtggtagctgtctggtagcctccactactgcaaatctccgaaaaaagagacggaagaaccaaaaccacacagatgagagaatttaaaataaggaggaaaaaaaataatttaacagaacgaaatagaataaacaccacgcaaaaaaaactaaagggcctcaggggcccaaaggggggagcttggggcgccttttcctttttggggggggaatctaagatcccccctccattaaccctttgccttcggcgactgggttgggggaagggggtaagatctaatcagaggggg

SEQ ID NO: 19026 - DNA, 553 bp, Homo sapiens
agtgttcgtaatgttctttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaattagagacaaagctgatgaaaaaagctttctctgagagaagacttttggtaatttttttttaaaggacttcctttttggctaagaaagaggaaaacagaatggaataatatagtatccagatggcagacagaattaagataactataaattgtgaaaataatagtaatttggaagccagatttttgttttcaataaacttaagattgaaagtccctgtgaaaaaaaaaaaaa

SEQ ID NO: 19027 - DNA, 322 bp, Homo sapiens
taaataatcattataatcttatgattgatgttattaaaatataatacaaaatgttgggcgctacgtcatttattaaaaagtaatttgaaacttggccttttggagcttttggaactccctgaactcttcttttgcaagcctgaattgcagatatgatggctggggctcagcagctacattgaatcatgaggtaaccttgaacttaaaagccatcttggagaaaggtagaagaaaaagttgtggtcctgggtcttttaaaggagcccattgttagcaatttgttcatcacagctccctcgatctcaccaaaaaagtctccagt

SEQ ID NO: 19028 - DNA, 792 bp, Homo sapiens
cccaacttggctgctttgtaagaagtggacttctgcctcctcagcctaacctgaagaatagaaccagcttctttcgtggcaattttcccccaggagggatttccctgcagtggacctcctccccattggtaccttcagccatcagaacacctcgctttagatctgtgggtcccaaatttcatcaaatccaatgaccatttctatgtccttagtaattggtggcaacctggtggagagggaagaccacaggctgtgagttggacctgggtttgaagattggctttgcatgcctagcaggatgtaagcttggcccactgacttcacttctgagccttgttctccatgtctgtcaagtgcaggggaaggatcactcattctgggggcagccctctggcatgtaatgagcagtcctatggagaggcccatgtgacagtagccatgcgagtgacgctggaagtgaaacctgcagctccagtcgagcctttagaagactgcagccctgactgacagcttgacagcaaactcatgagagactctcaacttgaataactcagctaaactgttgctgggttcctggtcctcaaaaactttggaattctgtgaagcacatgacctccagtctttggataaatggaaacgcagcttatgccggaaagatggaaggccggctcccctaatatcagaagtggaagaggagagacatcactagagatcccatggatattgaaaagataaaaagccagtagcgtccactttccctttcttcttgccttatcttcatattcgactgat

SEQ ID NO: 19029 - DNA, 544 bp, Homo sapiens
agtcgctggtgttgatgctgaaaagttacaggatctcttccaggaggaggatggcagtacagcagcttaccctacaaagacaacatgaatgacaacagtgcagcctaagtgccatctgtggcctcagaggagacagctccacccagtcacactctgatggagctttctgccttctggttaagttagctgagttgagttttggtctactgcagctgaagagtcctttttctaatacatcaatggtcaaagtgttctagagacctagctcttcccatggcgccccagactaggatgaaatctctttcttcttttctcgtttgcattcccactcaagtattcttcagtatacggacatgatcatacttatggtgaatattttccaaaacaaaactcaagacataactggacagttacggtaatgccgggttagactgttaaagtcaggagagttcctcgactcccgtatgtggggttgcagttgctcactgggtgcaagtctgcctctttccatcataaatgatctgaaggctgaaaaaaaaaaaaa

SEQ ID NO: 19030 - DNA, 952 bp, Homo sapiens
aaaaaaaaatcagagactgtttatactcactcggatgtttggggttaatctctgccccacctcttgtcataacatagtctaaagagttctagacagcctgaacatcctgcagaacatcacattggtcaactccatcaatgacatcatgctaattagacaaggtgaacaagaaatggctagtgcatttgaggcctcagtaagaaatgtgtacttctgaaagggagtgacaaattgtataagtactcatgggcctacagtacctataaaattattacgagtccagtggatggttgctaggatatccccaccaaagtacccaaagtacacaaaaaagaaggtcaccacagagtatgtctcttcatccttggagaaagccatattccacacctgggaatactgagcaaactataacctgggtgacataaaaggcttccagctctgaggtggacaagaacaagaaagtttttggcagaagaactgggctgtaatgcctacagttcttgcactgtggtattgaaagtagcaatgctaggaaaaacaccatgtggagtttgaggcaagtccaccagcattctggagggagaccatgccacttttagtggacaattgtattccttttaaaaaaacaacactattgggttctaatagagatggagatatggatcatgtgataacatatgactgagatttgggactggaattgaccatctaatgctggtttctggtaacttggtgactgtaaagtcaccaagtcataaatcatagagttccacagtcatgtgtcttaaaatagaagcggtgcatgcaggattaagtatggacagagatagaggaaacaaacaggttgtttgagcaggtagcctggatcatgttatttaccacttttgcaagagtactttttttctcagttcccatctctggatattaaagaaataaagacggatgcgcaagc

SEQ ID NO: 19031 - DNA, 580 bp, Homo sapiens
ctcggccgatcttgatttattcatcctcaggcaaacttgatctggagcatacaataaatattgtgatacctacgtgaattaaaacaatcacttacttattagcgcttggcaccagaaatacagtcaggattaatgtcttgggattcctgcctctccttctaatcttatctattttacaagtaagctctttgccttctgagttcattgtaggaattgcagttttacatcaattacatttccattagcattgtagatatcccttttcatataacattatcaggctgcagatacacaaaatgtcaatattttccctcacttcattatgctaatcacactctgagctccagtgccgggtccgtccaggagtcagatgtttgcgctgatgcaacatttacaagcagctgatcttcccaggcagccgcctccctcatttgcagatgcagacgagggctaatgggccagagtaaagcatgtgtctgctgtggtgaccttctaaccatgccggcaccccgagatctgtcacgcagctgcaggggccacgccgctccccgcagtctccttcaccggctccttctccaca

SEQ ID NO: 19032 - DNA, 1004 bp, Homo sapiens
agatatatcaacttaacagtctatttgatcattactcttcatcagtgataaatgttaatactaatattgaggagaaggaagaggaagtgactgaagcaataagggaaacaaagtcatcaaaaaatgaattacattctctatcaaaaatgctggaagatttgagaagagtttatgaccaactaacctggaagcaaaaaagtcatgaaaatcagtatctggaagcagttaatgatttttatgctgcaaaaaaaacatgggatattgagctttctgatgttgcaaaagatttttcagctatttctttggcatgtacaaaactgacggaagacaataaaaaacttgagattgatattaacaaaataacagaaaaaaccaatgaaagcatacggaaaaaatcaaaatacgaatctgaaataaaatatttgacaataatgaaggtaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttaagcggaaagagcttataaaaaatagagcaatatgtgccatgtcactggcagaactacaggaacctctgcttcaactagaagatgaagctgaaagaatcagaagtctcaacaaagaacattctgttatgcttaataacataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaataaatgaggatgcggccaagg

SEQ ID NO: 19033 - DNA, 623 bp, Homo sapiens
ccctgcctgaggctcacagtacaagtcagtcaaattgttcagggcagcagtggtgtctggagacctggtttgagttcctaggttcatacctagcgtccttctgagcctcaagtttcttcatctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaaggttcagctaacaaga

SEQ ID NO: 19034 - DNA, 400 bp, Homo sapiens
tccatttttattgagaaattactatgtgctaattaccataatcaacaagataaaggctgttcttatgtcttacattaacaagtaaaaagatatatgtaaaagacaatttcagaaatacatgtgatgataaccaagggtagcgtgattaacctggatacctggttacctcaaaaagagaaggggtaataaaagtaggccatgtatgcaaagactgtagagataggtgcataaagtgatttgtcttagagctcttgattcttcccccaaaagttaaagacattgtgtggttctctccactcttgtctttttgtgaggagagctattatttctgctccaagctcttgatctccgtggggagtggaaaagagcatctgttctggaacagagctgaaagtaaatc

SEQ ID NO: 19035 - DNA, 1059 bp, Homo sapiens
gcattgatctttttatgtactgattcacgaggacttaagcctatgatgcagttgttttcccagtcttgggagctggcagatgccattacccaggtcaggagatagaaccttgccagctataccctgaagctgttcaagtctttctcccaattacagtcttcataagagttgttagaaggactgaatgagatgaagtagaggaaagtcttctaggacaggggtcctcaacccttgggccacagactggtggcaggagggctgcacagcagatgggatgcctggttgcaagaaaacaagctcagggctcccacagattctacgtgatgcagttttcacagatttgtggccagatgctagagacaaaggctgagaagttgtccaggacgtcatattcttgctttgctggaggcagatctgaaggatgtcatctctcctgtggcttcttctagtgtggggtcccgaagcctggcttccccagccgatgtgctgctttagtcagcgtctgccctggtccttcggttcgcaggctcacacgcttttttgggttgtgtccctttggactgcagaggctacgtgtcctgtgaccaaccacgaaggcggccactcccgctcccctcaggagtgtcttaaaatacctccattttagctaccctattgaatgacaggttagctgggtgctgggttttcaggtgatggacattttccctcagtcctctgaaggtgttgctggcttcaggcattgatgccgccactctgattgttgtatgcagtgagcaaactagaattttctcttggctttctagattttcttctttatattctgaaactttattatatcaaggtttgaattttattttttttggagacagggtcctactctgtcatccaagctggagtgcaatggtgcagtcctgctcactgcagcctccaagtccagggctgaagcgatccttctgcctcagcctcctaagtagctgggatcacaggtgtgcgccactctgcctaacaaggcttgttttttgtttgtttgtttgttaaaataaatacagatcggccgag

SEQ ID NO: 19036 - DNA, 806 bp, Homo sapiens
  misc_feature (1)...(806): n = A,T,C or G
aagcagacctcaggcggtaatgctgactggcccgaagctcacctcctgctgtgttgcccggttcctaacaggccatggacctgcaccagtctgtggcccgaaggctggggacccctgattcctacacgaagaaacctcaaacccaggattcaagccaaaaacaatgattctcaagttcctatgaaatcctggatggatgttgaactgggcaacgtactagctgactcccgtggcagacgcgagcctcaacaaagctccagggctggcacttcaagggagcggaggtgtgcgtttgagtctgagtcacatgcagtaggccatctgctcttatcaacaagatgagaatctttgccaagaagacttctgctatagctaccaacatagctgtgccacctgattccatggattggcatctccatcacctaatgaagcagagataacacggaggacctcagtcaatactatctacaaacctcagttgatatcatttgcaaacctccctgattcagtattaacattcacaatatttaattaggcaccattgaatttcatttaccaaatgtcaagcagatgacanaattctcccaatttgataaaatttgataaattttaatgttgacattaagtcacttttattttagaaacagcaaacatcttgattttgaaacggaaagtcatatcaccaagtctgttggttgtatagataaaaaatggttaaaaaaaacaaaaaaaaatacccccaaaaaaagactaatttnnnnttttnnccgatgcgcccgtacaacctgcctttatgagggaattat

SEQ ID NO: 19037 - DNA, 357 bp, Homo sapiens
aagctgtgcccctgattcctggattggcatctccatcacctaatgaagcagagataacacggaggacctcattcaatactatctacaaacctcagttgatatcatttgcaaacctccctgattcagtattaacattcacaatatttaattaggcaccattgaatttcatttaccaaatgtcaagcagatgacaaaattctcccaatttgataaaatttgataaattttaatgttgacattaagtcacttttattttagaaaacagcaagacatcttagattttgaaaacggaaaagtcaatatcaccaaagtctgtttgttggtataagataaaaaattgagttaaaaaaaaaaaaa

SEQ ID NO: 19038 - DNA, 903 bp, Homo sapiens
  misc_feature (1)...(903): n = A,T,C or G
tgctgtgttgcccggttcctaacaggccatggacctgcaccagtctgtggcccgaaggctggggacccctggggttacatcgtgtccatcatacaatgtaaaactagttcctgataagaaattaaagattagttgagtagcaatcaagcaatgctcccagtccttcacagtgtgaggtccttgctttgaaagagtctttgcctctgattcttctttgctgagatggctcctagggggaggatagaaccgacctaccagcctgtagtcacctcaagaggacccaccattattcctacacgaagaaacctcaaacccaggattcaagccaaaaacaatgattctcaagttcctatgaaatcctggatggatgttgaactgggcaacgtactagctgactcccgtggcagatgcgagcctcaacaaagctccagggctggcacttcaagggagcggaggagcctgcctcctatctatggcctacagctcctttgccctgtgatttttggttggcctttgccaactggaagcactggcaggaaatcagaggatgagaagagggacagcaaatgatggtggcgattgtctccctggctttcgtccctcactgcccctacacccttccagagtcctggcagtggctgcatctcctgctttagctcccatcaggtggcccttcttccacagctccaagcttagagatcagagaacatatcctgattccaggaaagtctgccaggggagaaaaaaaaaagtgcatacgccaacttcttgaaacatttggcacctgccgcaatcaccaataaatctaaactgnacagcttgacatttcctcaaacaagaccccacctctcaaagaacatttgtcataacatgngaaacnaaaaagcagataaaccgtccaaa

SEQ ID NO: 19039 - DNA, 729 bp, Homo sapiens
ggttagttttacctgttctagaaattcaccttgatggcgccacacaggatgccctcttttcatcactcggcatgatgtttttgagccaaatttctcccatttgggttaatcgcaggatcagcacgtccacagtgcaatggaaaagcaacgccctgggaaaacaaccttcataacgtcctctgcgatgccaggtttgatcggccagtggcagtatctttggaaactttcatatttaccaggcatgaagaatctttctcatttcaattggacctttatcaccagcccaagggagaggaaagtcctaacgcatatcaagttctgagctggccaggacttagtcagtatctactgaaaccttgaatatcttggctgtgttaactgttttgacccaacatggagcgaaaatgttggttgtaccttgagattctgacatctggttgaagtccaggttcactggcccaggacaggtcattcagctgtttgaaaaaaaacagaagagagccccggccatccactgaggtaatctccatgcagcatgaaccactggttccaatgaacccaccatcaccatacttctcaggaatcgctggtcactagactgagagttctgtgaaagctgagatcatatcttactaatctctgtgttcacggttcacagctcagggtctagcactgagggagttctcaggagagtgttcatcaattattaataaaaatcgatgctggccg

SEQ ID NO: 19040 - DNA, 567 bp, Homo sapiens
atttcactgactagaattaccagtactatgtcaaataagagtgactaggttggacatattttttcacaatcctggtagaataaaagcattcattttttcatggttaagtatatgactgatgaatgccagatgcctctagtgagccaccttgaatcactattctgaatacatcttgagtaaaaagagaaaattgctcatgttggcatgtctatctgaatcatgttattggaccatgagagcaagcagctggatctcattctgtccaggctattgctaaggcaggctggctgccttcatcttccccagtattctaggataacctcaaagaaatcacaacagcttgttttctacaattaaaacatttgggttttgatagtgtgcatggtctacaaagaagtgagaagtgtagctgtttgtatggaatcttatggtgaacattgctggctccaacatataacttgattggtgcgacatcaaggtaaatgaatcctcaaagagctagcaaatggatcaaataaaagtagatgcgccccaaatccatctacaatggggtgagggggcaccgcg

SEQ ID NO: 19041 - DNA, 348 bp, Homo sapiens
aggcccctccacctggaaagtaggatggctggctactatggggaattgaagaaaagtggattaatgacaagagtccttgtgttaatatacaaccaagacagggttctttgtacatggattccatgcagtgaatgaagacatagggtggttacccaacacaaatggacagagcatttgactttctaaagactttgtttgtagacattttgacattgggagaagaaagatggcacactaaccgagattataggtcttatgcctggaattttttgcaggttgatttgtatgcgtgtgacctctagaaatgtaaattattaataaaattgtgatcactcaaaaaaaaaaaaa

SEQ ID NO: 19042 - DNA, 825 bp, Homo sapiens
  misc_feature (1)...(825): n = A,T,C or G
ccctagggctaaccagtacctggcgtaaacgctcctctaagaagggtatcgatgttctctgaagcctcctccagaagagttccccaagtccaggaaccagaacatcagacagtagctgcctaaggaaaaaagaacaattattagcattatatttgcaagtgattccaacagtcaggctctgaagcaagtgaacctttaacatttaggcaatggctaaataactacctaccatattcttgctgactacatacgaattatacgctggacaatttcctctttgtcgcaccatatgagtagtatactgaacacaaatgtattttattcataaatgtgatagaaataggaattataaatacgtggaaagagttaaaaattatgatacattaaaaatcacctatctgctccgtgnaggtgaattgctactaccgttggagctcttaatatatgaaccttatgtggagctatttatttctttctttctctggttgagactccagttaaaatgaataaactatctgtgaaactagttaaaagcaactctttttgtcaaaatgccaaaattatgcgcctgggtggggctcacccggtgggatctttgtgggcgggtgccgtttaggggggggttaattcataatcctcggctcactaactcacttgggtccggcagtacgcttgcagctatcaggaaggggttatctatatgcccgaataccgggcttccacggattcaggggtattccgcggggagaagttgtaacccacctgacagcctaagtgcgggatccgtcaaaaggcgggtgttatgggcgtctccccatagggacg

SEQ ID NO: 19043 - DNA, 160 bp, Homo sapiens
ctagatggaacaatcttctaaaataagatacgctctaagatgttttacagctaaaagctccatcaagactttttcacaacttgttaatggaacaaaaagcaaccaggtaactgcattccaggtgctgtaataaatgcttaccactgcaaaaaaaaaaaaa

SEQ ID NO: 19044 - DNA, 942 bp, Homo sapiens
cccccccctcctccccgcacttcgatcacacaaccggagaaaaaacttttggtgcaacgtgccttcctgtacttacattcacaaatcccccagccattaaaaataagaatatttctcatgttcataccatgggtgtttgtgcgagaagaggatactttgccttggggaatgaaaagggcaaggccctgacgcataggtccgaccattactcaaacttctaaagagactatttgaagcccagctgagtcacacgagaagcctgccttgatatatcatctctataaactgcgctgagtatagggatactacgaccggcacacgatttattcgatccacctggcgcttaaagacccagtcgttccgtcaataaacatcgggcgcatcttttgtttgaaaaaatccctatacgtagtcctacccgccgccaaatataactaagcacgctacataatcgctcgcccatccctatttcgtataaaaacaatatccataacttcgacctcccgcactagcctggattctaaagcctagcgcccgccgatacctcatcgtataacccccaccgcatatataccctatttccccccatattttgccacataccccctttgtctccgtaccactaccctttctattggtgatccccaaaacctatcatttcgtgcttgttcacctccgccgtcttactaccccgtatataaaaaaatcggataccattttcctccgatagcgccaccccccccctattggggtagaggatatgtgtaaagtgcgaatagaaggacagattcagcgccacaccctcccatgtagagaaaaagcgaacgccgtggttccgccgctccgttacgtcatcgaatagaaacataaaaagatactacgccgatcaccgtccacacagtactctatcccagagtgccccactatattatttcgactccg

SEQ ID NO: 19045 - DNA, 461 bp, Homo sapiens
taggttctgcaaatttctgcaagaatggaaccaaaggagaagccggttcagttgctttttcaggctttgaaagaaagagaattattaactcagtaaaattcccacttgatttgacatacaaaatcaaaattcaatgcaatctgaagtgttttctaatatattcaatactcactggactgtcatctatgaagatgataagcaaatgattcacagtatcctagtggaaaataataaacataagtcaaaataattccactactgtattctccccagaattctcataacttgtatcatattatgtaagtttctagaaaaatgaaaaaataaatggagcagtagcaaaaaatctgcacatatgtattacagcaggagtttttttacatctacaaaacaggttcttaacctttgtgaaaatgggcaaataaaagctattctgattttggcatttaaaaaaaaaaaaa

SEQ ID NO: 19046 - DNA, 145 bp, Homo sapiens
gttagacattccacttcttccatctattacatctctgagtctaaatgaaaatgaagagaagaccggaccttttgttgtacactggctaaacaataaagaactgcattttaaaaaaaaaaaaaaaaaatggccctcgttggcctca

SEQ ID NO: 19047 - DNA, 119 bp, Homo sapiens
cctagatttatctatgaatatcataagaactctgggagaacttttgaattcataaccaagccaacatctccagacatgtaaaaatagggaaaagtgattcaaattgaaaaaaaaaaaaa

SEQ ID NO: 19048 - DNA, 151 bp, Homo sapiens
cctaggctcgagtggcttgttgatgctgcctgaagttggggttctggctgtaccagttatttaccctttgattaaaaaaatactttaattctgattgaaaatcaccagaaatgaaataaaaagacaaaacagaattccaaaaaaaaaaaaa

SEQ ID NO: 19049 - DNA, 891 bp, Homo sapiens
caggttgtgtgcgtggtgaataatttcaaagggagacaagcagaaaatgagcatatacacatggataatctggcacagatgccaatgatcagcattcctcgagtagaaagtcctttggaaaaggtaacatctgtacagaaccacatcactgccttcgcagaagtcacatgatatcgaagcagatggtttttcactgcattggacatcatccctttttaccatccattcataacacccaaagtttgtttgattgcaagtgaagtttataaagttgtttaataatttttataattttaaaatcaatgtcaacctatctgtttcccccactagactgtgagctcctcgagggcaggattgtctttttttttctgtgtccccagcacttacaacaaagcctagcacaaagtaggtgttcaacaaaaatgtgatgaccaaatgaacaaaattcttaaataaaacattcactttagtttctcacagaatcattgcaattatgttaaaagaaatctctacataaatcgtatttgtgtatgaaaaccttctattttgggctagttatttttttaatcttcatatatctattcagcagtatgccatatttaatttgaagtggactttgaaagtcatgggggtttttattttgttattcagcatgacattatttccattctaacatttcagtgtgtgaaattactctatttttagaaagtatgttctatagtaaaataatgtttccacgttatattatgttatatttcacttaaaatactattcatactatacattctaagactggtgcttctgcttttgaaggggaaaatgccaatttttactgtaataagtaatgtatcataattaaaaattatttatttggaaaaaaaaaaaaaaaaa

SEQ ID NO: 19050 - DNA, 764 bp, Homo sapiens
  misc_feature (1)...(764): n = A,T,C or G
ccctttataggtagaacctggctaacagatttcctcagcaggcctgggaagaagctcgacagtgtttgtggaaaaaagagaaaaaataaatggttttggttgattctgtatttgagtacccttgttaatattttaaattgtccaaacaaacattctaattgttccttaagaactcattttcccatgtttatactcttgccacactgtttttttggcatgtactgtacactatttataatgactagtagatacttgaatgttctacttgctaattccgcaagttgagcttatttcatttatgcagcatatcttgtagtttgctattccccctctcatgataatacatacccttgcacccgcgactacttgccgaaaggtcacatcccattacgcccgctctgttatcctcctataataatgtaattgacccttcttacaaatcgcctactttccatcgccaaccgaaacactcactcttgaaagaataaatccctacttctagcttctcgaagtctcgtatttctcatacctctccaatccttaattagggtccctctcattctattcctctgtccgtttcaagcctttctactnccatttctatccccttacctttcatttatttctctttttcatcttaatcccaatttcatatcctttcttttgtttattaattctctgacttatttaattccccagccgccctttaaatagctatacatatgnactagtgtcccatagcccgatcgcctctccccccgccc

SEQ ID NO: 19051 - DNA, 864 bp, Homo sapiens
ccttcgcatttcagcccgtgttctcgatacttccacgacccccaaacaggatcaatatttgtggtggcaagactctctaaggagtgagtatcgatcaacaaaaccttggagaagcaaaagaaacccatgaagacttcctagagaattcacaccttcaaggtcaaactgccttaatatttggtgcaagaatattagactatgtcatcaatttgtgcaaaggtaaatttgacttccttgaacggctctcagacgatttgctcctgactatcatttcctatctggatcttgaagatattgccaggctttgtcaaacatcacacagatttgcaaagctgtgcatgtctgataaactgtgggaacagatagtccagtcgacctgcgacaccatcactcctgacgtgagggccctggcggaggacacaggctggagacagctgttcttcaccaacaagctccagctccagcggcagctccgcaagaggaaacaaaaatatggaaacctgagagaaaagcaaccttaggcacacattttcctaccagcagggagctcaggcatggctgtgtttctcttcagtgtccaaatctcttctgtctccttttcttaagaactaagaggttttgttgatgcgtggagccatttgaaactcgtaggggatttgcacacaaatgcagcagagtctggctccccagtgccttgctagagtcaccgtcattctgaggtcaaatcatggcccgaggacaagggctgtaagacagggagccccataggccatcatcatccttatcccacacccattataaaagaggtttctattgtatataaacaaacaataaatgattattagcaggttaaaaaaaaaaaaa

SEQ ID NO: 19052 - DNA, 408 bp, Homo sapiens
cagactgcttccacagtctcgtgtgctgctgtgctttcggcctcgtgaaattctgcaaagggaaaacacactggtgattagtaccctctgcttctcttatgaacccaggaggaaacattttcatccacttaaacaacatctaaatattgaacctctattcctgaacatagcgtgccaagtccacaatgatctgtgatgccatgttctcggagataacttcatgctgccctgcgtaatcattcatttcgttcaggttggaaatgaaagctttacatgacgtatacctatggaacagaacacacgccactctgtttcacacaaggccacattcattcatattctgctttacaccaagaaaatattaattaaaatcaggttaattggcatccacctccaaaaaaaaaaaaa

SEQ ID NO: 19053 - DNA, 300 bp, Homo sapiens
ctaggaatcctcttcatctttctaccaatatgttttgtggactctgacgagccaaatctgacatcagttctggaacatctagaagatactaagaagaaccattcagtgaagagagaagccaagctattttctcttttcctcatgaacattatatttagaaattaaatgttaagagataatatgatataatgttaagagataatatgatataaaagcatgattaatgactataatcttagaggaattaaagtctgggtattttaagtccttcaaatcttaaaaaaaaaaaagaaaaaaaag

SEQ ID NO: 19054 - DNA, 378 bp, Homo sapiens
tctgcacccgagggactcctgggcggtacctccttacaccacccccacatgccagctgtcctgaccaagggacccttagctcatggagcacacctgacacgtttcagatcctatcccctgggtggccccctcagccctttctcttgaataccctcgataaggacctgatgggaacattccttgcttcagagacccctaggagcaggtcagccgacctggacttgcagcccagcttcaaatgaccctggagcagttaatatgcttctccaaccttcagtccctacctgtaagaaatggagacacaataacgcctgtcttactattaataaatatgcaagataaaaaaaaaacccaaaacctggcctcgttggcctcaaa

SEQ ID NO: 19055 - DNA, 374 bp, Homo sapiens
cttgtgacgcccccagaactgtcaccgagggactcctgggcggaacctccttacaccacccccacatgccagctgtcctgaccaagggacccctagctcatggagcacacctgacacgatcctatcccctgggtggcccccttcagccctttctcttgaagaccctcgataaggacctgatgggaacattccttgcttcagagacccctaggagcaggtcagccgacctggacttgcagcccagcttcaaatgaccctggagcagttaatatgcttctccaaccttcagtccctacctgtaagaaatggagacacaataacgtctgtcttactattaataaatatgcaaaatatgggaaaaaaaaaaaaaaaaa

SEQ ID NO: 19056 - DNA, 820 bp, Homo sapiens
cctagatcgcactaatacctcattatttggaagatattaacttgtaaactaaaatgaaggacagaggcaatgtttctgctcaatgcccagaaactctctccctctacagaagtctgcatctctcccagtccattcctacatgtcagaaagatctgcaggtccatttacacagcctccttattcggaacagggggatttaaatagaggtgcttcagtgggaccacctgggatgatgttgcagagctgcccaggtgccagggtcctgtaacctctcaaattcttccagggatgcaaatcaggctggatggacacagaacatgaagtccttctccagagcacagcacttgtgagtggctgctaggctgggtggtctttgcttcctgtggtttctcacctggcatatgtcaaaggaaggtcccttattctctgatcctcatcctcacaatcttccagagcacaccctggagacctccatccctatttaaaggaggaggccacttcccaggatgcacagtggtgaagtggtgaagggctggtctggtctagtcaccgccttcctgagaatctaggatactagcatgtgagtgctgaaaaaacactctaagatgcttggtctcttgcctcatgcaccccccaccccagcccagttccactgggctcaacacacagggtttgttctattcccgaaggtttgacctgtaaggatgctgggtttacccttcccctcagctaaatgagctctctagagcatacgaaacagtgatctcctgtttagagatctagtgaataaatgccaaagaagtggaaaaaaaaaaaaaaa

SEQ ID NO: 19057 - DNA, 779 bp, Homo sapiens
agattggtttgcatggctctttgaacagttactcttgtcctcattgtagagatggcgatactaaggcagaatatgtttctcttgctcatcggaccaaagtttggaatcacgtctcatcttcgtgtattttgaaaatctaacaaatctagaagatggtgtgaatgtgcatatatttagacaatttaaaattttgtcaaggacatgaaagaaagacatgttttctaacaaaacagaaaaaaacaaaaataagaacagaatgcttttaacattgcttaaaggactacaggactatggtggcaaagctagcctgacttctttttgtggagactggattccaagattgaaagtagaagctacatgttttctccaagcagggctttcagacttcacttctgcaacattttattgatgaaagcaagtcacaagaccaaactgattcaaggggtggagaaatagaccctacttcttgatggagggaggagtagagttacattgcaaagggatctggacaaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttagaaggataaaaaatatgtaacaacatgaatgcactttttagggtcagacaagagacttggaaagagcctgcaaaatggaggac

SEQ ID NO: 19058 - DNA, 791 bp, Homo sapiens
ctaggttaagtaaagggcactgaacaagtgaagctgtgctgaaaacaacagtggccaaggcagagatattcttatacctcagcccgtgggtgcagatggaagtctggccaaaaaaccataaagcatcaagtctgactattggtttgccatggctctttgaaacagttactcttgtcctcattgtagagatggcgatactaaggcagaatatgtttctcttgctcatcggaccaaagtttggaatcacgtctcatcttcgtgtattttgaaaatctaacaaatctagaagatggtgtgaatgtgcatatatttagacaatttaaaattttgtctaggacatgaaagaaagacatgttttctaacaaaacagaaaaaaacaaaaataagaacagaatgcttttaacattgcttaaagaactacagaactatggtggcaaagtgagtatgtcatacaaggtaggctatgtaaatctatgtgtgataattgtgtactattcattgataggggatgtactttctacttaacacatgttctcctcctagataccttacctataggtacagaagtatctattatattggtttaggctgattcttagggatatttctcttaatggaagctgaagcagagagaatctctattggcagatgcaagtgacttttttaaacacaatggagtactgaaggatggatttcttaagctatgggaatattgctgaaatcaaagctgctataatgccagtattctttcataagtctgaataaaaaaaaaaagcacatatgggaaaaag

SEQ ID NO: 19059 - DNA, 1066 bp, Homo sapiens
cagattggtttgccatggctctttgaacagttacacttgtcctcattgtagagatggcgatactaaggcagaatatgtttctcttgctcatcggaccaaagtttggaatcacgtctcatcttcgtgtattttgaaaatctaacgaatctagaagatggtgtgaacgtgcatatatttagacaatttaaaattttgtcaaggacatgaaagaaagacatgttttctaacaaaacagaaaaaacaaaaataagaacagaatgcttttaacattgcttaaagaactacagaactatggtggcaaagtgagtatgtcatacaaggctagcctggacttctttttgtggagactggattccaagattgaaagtagaagctacatgttttctccaagcagggctttcagacttcacttctgcaacattttattgatgaaagcaagtcacaagaccagactgattcaaggggtggagaaatagaccctacttcttgatggagggaggagtagagttacattgcaaagggatctggacaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttggaaggtataaaaaatatgtaacaacatgaatgcacttttagggtcagacaagagacttggaaagagcctgcaaaatggaggagccctgaggcctaagtctcatgagtgtcaatgcttacctgtatctagacactggcatcccccttttgataaggccaagattgattgttttccttttctacctaccctatatctaatccatgtacaaacactgttgacacacaaaagaaccctaaattcaacaatctgtgaagaatttttgcactaacatgttagttcaaaaactcaacattgcttgctaagactattgcaataaactcctctatgatcccctaaaaaaaaaaaaaaaaa

SEQ ID NO: 19060 - DNA, 267 bp, Homo sapiens
ctaggaagccagcccactgctaactgatgagagaccagcttgaaagagggaggacctgccaattgccatcagcacaactccagatatatgggagtcaggtgatcataaaccatccattttctgctgagtcacagtagactgcaactccatgaatgagacaaggaggtgtcggtaaaaacaaaacaaaacaaaacaaagcaaaaactgcctggtgtaaccacagaatcttaagaaataataaatgattttaatccaaaaaaaaaaaaa

SEQ ID NO: 19061 - DNA, 228 bp, Homo sapiens
atccgttataaataacatgagatacgaggggagagagaggagccttggcgcgaactatggttctttttttataatttctatctctttgttgatattttctgtttggtgagccattgtactcatactttctttcagttatttagatatagttccttttacctctttgaatatatgaaaatagctgatttaaagcttatgtctaataaatctctggcctcgttggcctca

SEQ ID NO: 19062 - DNA, 543 bp, Homo sapiens
tagggctgttgataaagacatacccaagaactgggaagaaaaagaggtttaattggacttacagttccacatgactggggaggcctcagaatcatggcaggaggtgaaaggcacttcttacatggtggcggcaagagaaaaatgaagaggaaacaaaagcggaaccccttgataaacccatcagatctcttgggacttattcccacaacacgtgggaattctgggaaatacaattcaaattgagatttgggtgggaacacagccaaaccatatcaccaaatacatacctatttaataatccagaaaatacaatcttatgtacttaagagaagtgaaaatattatctacagaaagacatatatatctgatttgttcataggaggtttattcatgacagcctcaaatcagaaacaactacatatccatcaatagggaaatatattaaaaacaaaacaaacaaatgctcccaaacctgtggtatattcataaaataaagtattacaaaataaaatgatcaataaaaacttggcctcgttggcctca

SEQ ID NO: 19063 - DNA, 800 bp, Homo sapiens
tttttttttttttttttacaggaaggaaagagaggtttttattgaggttcttgcaatctgtcacaatattaataaaggagaaaataacagtaggatcatattaattatacctgctgagaagtgattctagttaacaaacatagtataaactttatgtaaaagaggaatagagggatatttcctaaacttgatgaagaatatctttagagccctaaagacgtcatcttcccttagtaaaagctacagtcaacacatgtatttgttttctagggcagctgcaacaaagtaccacaaagtaggccacttaaaacaacagaaatttgttctgtctcagtcctagtttggaagctgaaaatccaaaatcaaggtgtcggcagggctggttcctgtagcaggcactggggagaatctgctccttccttccctccgagcttctggtcgctggtgacattcttcagcatccctgggtttatgttaatctctgactctgttcaatgtgatgtttgtcctgccacgatagtctcatcttagctaactacatctataacaaccttcttccaaaataaagccacgttctgagattctcacatactgagtttccaagtgccgtctttattctcctctacatgttcaccataagggattctgtctttatgcactgattcttgccggctggtaattccttaaccgctctggtggggaagggactttatgagaatccacaagtttatattctaagcttcatgagtgcaggtacttcttcgctgctgaacctacagcaactataacgtgtgcctgag

SEQ ID NO: 19064 - DNA, 739 bp, Homo sapiens
attaccattacatttaaacttgtgtctattttacagatttttttagttcttttttcatccttcatcaaaggtcaggaaaatatgacccatagagattaaatactttcccataaatcactctggtaattaatggcagaacaaaaactcatcatataatccatatacaaatcttaatttgttgatgcccattattagggtctgcattagtcagggttctggttagagatgccataacaaaatactaaatactgggtggcttaagaaacagaaatgtatttctcacagttttgaagtttaatttcaggagggtgttggcaggtgtggtttctctgggggcctctctccttggcgtgcagatgcctcttgtcttgtcatgtcttcacatgtccttttcctctgtgtatgcacatcccttggtgtctgttcctcttatcaggacaccagtcatgctggattagggcctcacctgtacaacctcatttaaccaaaaatgcctctttaaagggcatatctccaagtagagtcacattgggagttaggcttcaacataaagttcggggaggacacaactcagtcagtaacagagtccacgcctatgctttatgaggatatattcttgggttgtttttatattgttgaggcaaactgcactgcttcctacatttcttttattcaagcctatcatcagcttcagctgttagtgataactgcagattctcttcatgttccctaatacata

SEQ ID NO: 19065 - DNA, 458 bp, Homo sapiens
cctaatgttcgtctgatttggtctagagaaattcactacattcgtccttgggagaggaaaataaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaaaaaaaaaaaa

SEQ ID NO: 19066 - DNA, 452 bp, Homo sapiens
gtaggtgaagacttcccttgtgctaaagctggagggcctttctgggattcagtgacttcagagaacccttctgtgttgcttaattcaggagatgcctacaggagctggagtcaaagctggtgagcaatccagacttatgaagatgcaggattgccttgttatttcctgtataaggactatggacaaatgagcggccagaggtattgaagacacaaaccctgagatgattcttggcctctgtctcatatccagtacatataagcctctcccatcacactccatcttgttcaacttccttgataaaaacagtggcaaggtttgagagaattgactttcattttaaaagaagttctactgtgtataaaatgctatcaaatagcattccatgctacattaaaatctttcataaaaggatgagtcaatcaacgtggcaaactttaaaaaaaaaaaaa

SEQ ID NO: 19067 - DNA, 826 bp, Homo sapiens
ccagttgcacatatttggaagactcattatttcagcaattttgtgaagctgtacggatggtctccagtacaacattgaaaagaagtggtgagagagctaacatccttgccttgttcctgagtttataaagagtttctagatgcaaacacacacacacacaaaagtgtgcttccagaagatgctgctgggaaggccactgcatccctagggagccaaatcaaagcattttgtcctaatgtgtccggaattggtgggttcttggtctcactgacttcaagaatgaagccgtggaccctcgcggaaagatagaatagaagctacaagatctgcagttatgcttcctcttacccaatttacagataatatatgtttgtggctgtgatacacagaaaaatggcatccaaggaaagtccacctcctaatcctcagaagctgtgaatatgttactttatatggcaaaatggactctgcagatgagattaagtttctgcctgcctgacaatcactctgctgatggcaaccaaatatttgttttcttcctggagtctcagggaaaatgtggcctggggcagaccctatttcttcagatggaagggtgaaacttcaatacttcaccgcaacaggaaacaatctcaagattttgtatttaacacatcctggacaaagaaagtgtaattaagtctggaatgcattcatcagttcccaagttcctggaaaggcagaagtcttggagctaatgcagaaagagaaatgcaggcccagtgacaacccaccagtccactataaggatagagtgcacactttcctagagctccaaggccatgca

SEQ ID NO: 19068 - DNA, 1178 bp, Homo sapiens
gactttgaagcctgacctctctttactgccacacaagttctgtgctgacatgggaataacattaggatcaaaacacccccactcatctagccagggctgtggacccgatgattactctatcctgggcctgaaattttctctcagggggaggaattcagatatgcaaagaggtggttgtgacaccctcatgaccaggactgatcatccatggacaggaaaggagaccatgcattatgaaccagaggaaaatgtgaccttcgctaggataagtgtgaaaatggctgggcctgtggtgaagacttcccttgtgctaaaggtggagggcctttctgggattcagtgacttcagagaacccttctgtgttgcttaattcaggagatgcatacaggagctggagtcaaagctggtgagcgatccaggcttatgaagatgctggacagacttgttatttcctgtatgaggactatggacaaatcagtggccagaggtattggagacacaaaccctacctgagatgattcttggcctctgtcccatatccaatagagataagcctctcccatcacattccatcttgttcaacttgcttgataaaaacagtggcgcagtttgagagaatggactcccattttaaaagaagttctattgtgtataaaatgctatgcaaatagcattgcatgctacattaaaatctttcataaaaggatgagtcagttgatgtggcagacttcactgttgtcttgttttaagatattggcacagcctgtcttaccttcagcagccacttcagcagccatcaatatcaagcaggacccttcagcagcaaaacgttttggcttgataaagttttctgatgatgggttaccatttcttagtgaaaaagtatttttttaagtaatgcatgcacatttgctttagacataatgccattgagactcaatagagtacagtataggtgtaagcataaattttacatggacccgggacaccaaaaattcatgtgattcacttaattgtatatttgctttattgcagatcggaagcgacctttaatttctcaatgatgcctatatgataaagtggtattaaagtgggggtacaccaaccaatcaatgatgggattggacactgatttttggtaataagaaggggaactactttcataattgagatctgg

SEQ ID NO: 19069 - DNA, 128 bp, Homo sapiens
aagtttcaggatttcgttggaaacgggaatatcttcatataaaatctcgacagaagcattctcagttagacttctcagccttggggactgtgagccaaataaacttgtgttcatcaaaaaaaaaaaaa

SEQ ID NO: 19070 - DNA, 1023 bp, Homo sapiens
ttatcctgatcttctggtagaatgcttgcacattctatgcctacaactaagagacaggggccactatacatttgcctagacctacagcgatgccttttctcaaaacagaaaagccaaacaaataaatctcattcacctgagcatatattaccttttcaccacataacatgatctcatagattccctgagtgaaagcagcaaagaggcaggtggcgggaaaacaacctgaaccttccaaagatggctaaaaaaaattgatgctttcggtctggattccctgaggagactagcctggcgaacatcatcccttggtctgtggggaatttgaggaatccctagtaatagcttcataacagatttgagattagtgaggaacaagccagagctgtgcagatgagtacaaaggtcctgatccagttcttgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcttgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttggaacattttatgtattagttttgaaataataatggaaagtggctatgcagtttgaatatcctttgtttcagagccagatcatttcttggaaagtgtaggcttacctcaaataaatggctaacattatacatatttttaaagaaaatatttatattgtatttatataatgtataaatggtttttataccaataaacggctggcctcgttg

SEQ ID NO: 19071 - DNA, 769 bp, Homo sapiens
gctgaatatcattcactacagatgtccatcttctcaaaaggatcttgtagacaagaccattgtctgtactggcccacagccatcagtctccctagcctgagacattccttccatagcatcttcaaacacttttagagcaagattgtctggaggcaatgtgaagattattctggattggaaaatgagaataatgaataaggaagactgtggaactatttctgtaattcgaagaagctacaatagaaccttgaagcaagatggtggcagtaaagctgaagaaaataaacagagatgagaaatggagagatatttaagaggtaaaatgtatgaaatttgatgattaatagaaaatgcaggtgtgagaggatggtttcaaaacctcccatatttgtgggttttgaattttggcactgtggtaccatttattgataaatagtgcagatggaacaatttgggaagtaatcactgataaacttgagcaagttaatgataggtgaacatgttatattttaacaaagtggatggagcacaatcaccctgctttgatagacccaggcactgaccaacatgtttcacatatttctccttttatggataaagtaactgggtacagcatagcgctataaagtaaagatagctttctgtttataaagaaaatttttctactctacttcttcaccttccttattcatttctcgaaattcatacatacctattggacccttatgggtacctgttatccctggggttgaatatgggatgatcagga

SEQ ID NO: 19072 - DNA, 574 bp, Homo sapiens
tatgtttgaaaccagaacctaagaaatcctccacaatgaaaattcaacatctggaataaaaatcagaatagaaatgtcttttcaaattgactgcaaaaatcatcagctggctatagtttagacgtaatccgtccaagtgaagaggcaacaattcaaatcttccaggcccattattttgaatatatggaggttacaatggaaatatttgcatcaaataactttattaaaatggattagcaatttttagttatagtgcacatctcccttaaaagaaaaactgttcacagaaaacatgtcactttgtactcattatctgtttttagcaaacattcaggactcaatgttgtcctcaatgttagaatttcttaaattgaaaagtatcacaataataatccttggaacctgttctacaatattacaaagtgtcaatatgggatgtgactataaaatgataataatgaaccacattttcttgcactcagatgaacactagtattatataattagttgggaaggcaagcaattttgctttcacattaaaagaaatgcaaaggccaaaaaaaaaaaaaaaaaa

SEQ ID NO: 19073 - DNA, 233 bp, Homo sapiens
catgtgggtcctgccttataagagagaggcaaaagaggcaatagagacacagaaaagaaagccatgtgaagatggagcagagagatatatggcctgacagctgccagaagctgaaagaaggcaaggaatggactctcccctacagcctccagaggcaatgcagccctgccaacactggcctatataactgagaaagaataaatttctgttcttttcagctaaaaaaaaaaaaa

SEQ ID NO: 19074 - DNA, 288 bp, Homo sapiens
  misc_feature (1)...(288): n = A,T,C or G
cttccgagtgaggccctggataccatcccagtgtccttatagaacagagcacaaaaggcattagcanacactataaaacaaagccatgtcgaagaggagcaaagagaatatggccacaagccaaggaatgctgacagctgccataagctgaaagaagcaaggaatggactctcccctacagcctccagaggcaatgcaaccctgccaacactttgattttagacttctggtcctatgagaactcgagaaagaataaatttctgttcttttcagctaaaaaaaaaaaaa

SEQ ID NO: 19075 - DNA, 300 bp, Homo sapiens
tacttacctgagtatgtaacctgactccaacatgagaagatgtatcaacactatcaaggcatcattggcatcagaacagtcagctgattgatacaaggtctctaatgaatgtggcacttgcccttccaccgattcactacagagcatgggttctgagggatagaaacctgtgccctctgccatatgcgcattatcttgaattgactcagcttcaaaattttgactaggccctaactgaaaaaggaaaacaaaacaatgaattaattaaagacttatttttacactataaaaaaaaaaaaa

SEQ ID NO: 19076 - DNA, 530 bp, Homo sapiens
  misc_feature (1)...(530): n = A,T,C or G
cataaagaaaacctatggaaagatcctgntgctggaagaaagcatgaagtaattcaaatgactaaaagacttcatgctgagaagagcactcgacactgccaccgaagttctgtttctggtgttgttttgtcaattatgctgatgccacgggaccatggaacagtgccactatttccaagagcaacagcaaatcgaaaaatcttcatgcaatggttgttctagaaaagtctattacattggtttatgctttaaatatagttaccaccagagtagtaattttccaatctatcctttaaaagttcaagtgtattattgcattttttaagttgtaaaagaatgatgtacacatatccttaaacatagtatataaaagcaactactcaatggggatttatgtgatgagattacttacgtaaagaaaattatttgtcttttgattaatagtgcaatttaaaactggaagtcgttttctttaaaaatgcattctctataccattgaaataaaaaaaccaaatgtaaaaaaaaaaaaa

SEQ ID NO: 19077 - DNA, 657 bp, Homo sapiens
tgaaagaaaacctatggaaagatcctgtgctggaagaaagcatgaagtaattcaaatgactaaaaggtcttaaacatctttgccatcatttataatgcagacttcatgctgagaagagcactcgacactgccaccgaagttctgtttctggtgttgttttgtcaattatgctgatgccacgggaccatggaacagtgccactatttccaagagcaacagcaaatcgaaaaatcttcatgcaatggttgttctagaaaagtctattacattggtttatgctttaaatatagttaccaccagagtagtaattttccaatctatcctttaaaagttcaagtgtattattgcattttttaagttgtaaaagaatgatgtacacatatccttaaacatagtatataaaagcaactactcaatggggatttatgtgatgagattacttacgtaaagaaaattatttgtcttttgattaatagtgcaatttaaaactggaagtcgttttctttaaaaatgcattctctataccattgaaataaaaaaaccaaatgtaaaaccatgtgaaaagtcctacctttttgaattaatagggacttataaaatttttattgaacaataagaatattaaaacctaacatattttttacaaaaaaaaaaaaa

SEQ ID NO: 19078 - DNA, 269 bp, Homo sapiens
attataactgcgagatgaaacaggatgctctatgacacacttgatcgaatatgacagacactgaccctccagcacctctacctgttgcccgccgatcacagccggaatgcagctgaaagattccctggggcctggttccaactgccccctctgcatttgcgggtggtctgcctgtgatattttggtcatgggctggtctggtcggtttcccatttgtctggccagtctctgtccttcattaagagcaaaactaaagaaaaaaaaaaaaa

SEQ ID NO: 19079 - DNA, 477 bp, Homo sapiens
aaaacaggcccagaaaagggcaatgccatgctggtctccatctacagtcttgcttaagcctggtggttttattcctgtagtaccaatattcaccacacatctcagcttatgcttctggtcagctgttgattccagttatcagaaggatggaccttctctgccctcaaaacgatctgagtgttggaaagaagagcaggccaagagtctagttctttttcctttatctattgcctggcaaattcctgcttatccttcaaggcaactcaaatgtcacctcatctctgaacctctgtaaaaagtgaagtagaagttcctcttcaaagagactttcctccgcatctaattaagaacaaatgtaacttctcttagaagcaaaatttattcaaagacctgtgctaacattctaaaatatctgctagccgtaataaagaaatcaatatactttgtgttcttaactcccaaaaaaaaaaaaaaaaa

SEQ ID NO: 19080 - DNA, 355 bp, Homo sapiens
agaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgtgggtggtctgcctgtgatattttggtcatgggctggtctggtcggtttcccatttgtctggccagtctctatgtgtcttaatcccttgtccttcattaaaagcaaaactaaagaaaaaaaaaaaaaaacaaggaaaaagaaaaaaaaaagaaaaaaaaaaaaa

SEQ ID NO: 19081 - DNA, 251 bp, Homo sapiens
catgttcatacttcttcaagatcttggataattagtggtgtggaaagtaaggaagtcacagggttggtgaatcacacacgaggaatgtgttcattcttttattgtccgttgttttaacctgactgaatacaagatcaacaagagcactgtcatatgttagaacatggattttgcactgtagacaacatttaacaccagtctatggggtactgcattgctttttataaagttcaaaaacaaaaaaaaaaaaa

SEQ ID NO: 19082 - DNA, 309 bp, Homo sapiens
  misc_feature (1)...(309): n = A,T,C or G
cttgccaaggttcatnacttnctncagnaacttggnataattagtggtgtggnaaagtaaggaagtacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaaaaaaaaaaaaa

SEQ ID NO: 19083 - DNA, 594 bp, Homo sapiens
cattagcagaacctatgtgaaacaaatcagtgaccctgctgcacacctgtgctcccaacgacaaatcccaaggctgctggaattatctgaggcccaaatgacaagaccccggcagtcatgctgacaagccctccaaaccatgcttcaatcaaggactgtcatcactcacctcgtgtcgctcctggaactcggacatgtccagcctgatgaagccctgtgtggaaacaaggaggcctctcctgttctgatcaccacatcatccacccacccatccatccattccacgtttcctgagggcatcctgtgtgtgctggacaccggagttacaacagggaacaagtcttggtctctgtccttaagaagcaccccatcgaatggtgcagacatggacaaagtcagtcacgatcagtgtggactgtggtgcgagggaggagagaaacactcagatggctccagaatgcctctcaactctgcaagtctgtgtgatgcccgtgtccctttgatttacttttcttcaaaatgaatatattttaaaatgtatttacatttcttcatttcattaaaaaagatatccataacataaaaaaaaaaaaa

SEQ ID NO: 19084 - DNA, 828 bp, Homo sapiens
  misc_feature (1)...(828): n = A,T,C or G
atgctactgtttatcatgaggacgaatatacgttccactcaccagttaaccacttgtctgcagctgccagtattgcatccttctggttactatagaaatcaataaccctagaaaaagaaaacaatgaaatggatgtgctcagtacattgattgcagaagcaaaacagtctccagagtccaggctataagaatttgttttctatcttgattaaaatgttgaatgcttgatagaagaatggagcatatttgtttcacttgtctggtgaaaaacttttaactgctgtgttttttccttcattgtagaataattacaaaataaaaattcataaagagaagtccatttctatgtaaaatatggaacctagaagtagcaggatctatctttgtgtttagttgtctaaatactggttctcatcactcaggataanagacantactattgaaataatgaatcaccggtctgcgaatgccaataccccattcctcctttattctaaanggcctaggaaggaccttatttacacaggtaaaggaaaacataactagtaccaatatacggactattccgggaaatctgtagagaccctcatcattaacttggagccaaataccgggagatggagggttgggcgctcagccttatcaatagtgttcatcccgtgataagacgtaagtatgggggacacagatatcttcaatggggaaggtggtgatcgtgacaggtaggcacgggatgacgacactacggtgagaatcggtgcccggagttttttcaggtaccttagtgaccgtgggagtggctgttgagggggtgcagtcgcggccgcg

SEQ ID NO: 19085 - DNA, 685 bp, Homo sapiens
tcaagcaattgctgaaacacctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgtttttttcctagctgaccttttatattgctaaatctgaaataaaataactttccttccacattacatgttaaccattgcagactgcaagcctgtttgtgtccttttaccctaaaatatatgaaggcttccttttcaagatttttataaaagaagttcctacagaaagaatatttgtgggaaacctccctttcactaacttcagaatataataaaatattataaataaaatatagaatataaatatgaaaaaaaaaaaaa

SEQ ID NO: 19086 - DNA, 800 bp, Homo sapiens
ctggtcgatcctttgtgcctaaatatatgcctatattggccacgcctctcgactaataaactaatctatgacagcccctactacagcaaaggatcccagaaatggccagccctatcttccccatctgtgaccctacagatactcgagacatgggcctcatcattaaaggcagagccgggtctccatcccaaccaaatctcacctcctgcctgtattatctcaaggtactggaccatccagacggagaggggcaatgtcctcgggctgttcctcaacctgatgtgaacggatcacccttcttccatgcttccctgacctagaactatcggttcctgtaagcgggccctggccacacaaacatggacttgccgttaatgctatagaatgggaaccaccctggatgtatcctgccacgatctagccatgattccgccatcatcctcaaaaaggcccgagtcgctcctcgctgcacttaccgccccgccctttgtgcccgcttgcctcacccgacggtcaattaatgattcgcagacacccgcccacgctccccatgcaccacccattcacccccctcgacatctacctccatccccgcactctacacccctcaccacctacaatatcgcaatccccataaatacacccgtaacacacacccacttttatatctcaacccctaccacactttcccgtttacctaacacttccaacgtaatccctcattcatctccacaatatcaaattttttcaacacaccttaccgaaatacttattccccatcccagtccaccgcactcccg

SEQ ID NO: 19087 - DNA, 543 bp, Homo sapiens
aactggattccatcattctcagcaaactatcgcaaggacaaaaaaccaaacactgcatgttctcactcataggtgggaatcgaacaatgagaacacatggacacaggaaggggaacatcacacaccgggaactgttgtggggtggggggaggggggagggacagcattaggagatatacctaatgttaaatgacgagttaatgggtgcagcacaccaacatggcacatgtatacatatgtaactaacctgcacattgtgcacatgtaccctaaaacttaaagtataataataataaaattaaaaaaaaatcattgcctttaattggtatagttagaacatttacatttaaagcaaatatttatggcactgcattaatattaatatcaatcatgattttattattttgtatttattgcacttactcgttttttcttcctcttcattttttcattctctgatttaaattttgcatacaatttaatattatttcttctcttaagaaataaactctgctttctaaagaagaaaaaaaaaaaaaaaaa

SEQ ID NO: 19088 - DNA, 435 bp, Homo sapiens
aaagaagttggaagaggaaacattaggaatttccttttaaactccaatcaaaacagcccatttgaatatttttttaaaaaaattccaaaaattcttcctgtgaggatgcattggctaaagcaggttaaagttgctgaagaggactaagcgagcctctaggggaagatgatatcatctgatctgtacacatgtcacattcagaacattctgcatggctgctgctgagctcccatctgtcagatctcaacagagagaacaaagactagagatgtgagtaattcaagaaacatccatttactagctgaaaaaacaaataaaattaggaggagccactttcttcttgttacatgttactgatacgtgttctacctggccgtaccacacattacataaaatgtattcaactactttactgtcaaaaaaaaaaaaaaaaaa

SEQ ID NO: 19089 - DNA, 430 bp, Homo sapiens
aaagaagttggaagaggaaacattaggaatttcctttcaaactccaatcaaaacagcccatttgaatatttttttaaaaaaattccaaaaattcttcctgtgaggatgcattggctaaagcaggtcaaagttgctgaagaggactaagcgagcctcttggggaagatgatatcatctgatctgtacacatgtcacattcagaacattctgcatggctgctgctgagctcccatctgtcagatctcaacagagagaacaaagactagagatgtgagtaattcaagaaacatccatttactagctgaaaaaacaaataaaattaggaggagccactttcttcttgttacatgttactgatacgtgttctacctggccataccacacattacataaaatgtattcaactactttactgtcaaaaaaaaaaaaa

SEQ ID NO: 19090 - DNA, 575 bp, Homo sapiens
atttgcattacaagaaagactgacggattttaaaccacacctaaaagaaaagaagtggtggcgaataaattgtagactctcccaactcatcatgtagatatattatacaagcaaattactagcagtcttggagaatattcaatgaatgcctttacatgtttgtaagcaaatataaattgtatcagaatgttgagagattgtaattagtggaaataactagctgaaataaaattttaaataacgtgtttctaagaagttaaacaataggcctaagacttttttcacacattattaacatctaggtagaagtgctgttaattagtagaataatgttcaaagaaacaataataggatgatacaagaaaatccttgctaatgaacactggctttgatttatgtttttgctcagagttttccaagaaatatgcacatttataagaaattgtggatcacatcattatattttcttgaattatttgtgtcctctgttatctctctgacaattccatgaagcttgaaatttactttaaagaaaaataatattacattttgtattaactcaaaaaaaaaaaaaa

SEQ ID NO: 19091 - DNA, 380 bp, Homo sapiens
agctctccatgctgctgcagtcacctccatctgcccacacctcttccttccacataaaacagtgcactgtggatgtgcagaagcagaaaggcagtcacagcaaacttgactgcagaggcacaaaagcatccagcataccttgggcgaggatgttccattgcataaccctgataggttttttggggaaaacaaacaaaaaacagccaaacatccaagtgtggtctcctgatcagcaatatcagcatcacctgggattgtgatccccaaattgtgagctaacgtgtcccagggaaccacagcaaactcacagggacaccatggtatattttatattttaaatgtgaaataaacagtgacgtttgaaaaaaaaaaaaaaaaaa

SEQ ID NO: 19092 - DNA, 727 bp, Homo sapiens
caacgggcaaagaacaacgtcttatgtctaccacagaaaagatgatctccacagaccatcaatatttatatatacgtttataatacaattaacctaactggaggtgaccatggatttatcgttggggaactagtaaacaccttcaaaattttacgtgtatatgactcaaaataatttattttggggatgtataggccagtgaaggaatatacttacatcacttgaagagactgttcctgtttcaacagcaacaccgctaccacgcagtttctattacgaaataaataactcattatttagtttcgttttgattttatcctaattgtatcaacttacacaaaggatctaagcaaccttttcccctaattctatgtaataatgcccgcagtataattgcattcctcatcactcctaacacgcaagcaaggggatgacataaaaaaaaaaaagaaacggaccccacagcactgatttatggaaccttccagacctcttcctttaagtgaggtattactcgtgaagatatgtccctagatacaattctctaaatagttattttgataaacaaggtacaaagttatgttacagatggataaatgatttccagagatcgaatatatattacatcccctatctatgaccaaaagaatacatcaaggtaattcacattatggattggtctgataacatcaaatagttatttatcacaccaatcaaaggtaattcg

SEQ ID NO: 19093 - DNA, 730 bp, Homo sapiens
caaaggttggctgctgctggagaaaggataaattctctgttgtttcaaggctcctacacaaatacaaagcgcgatgctgttgctactggaagagaagtgaaaaaaaactgcttatgttcaagaccacctggacaagacttcttaactatgaaaggcagttttgttgctgtgtaggaaaagacaaaaatactgagaataggctctctccacattctctgagactcagagttaaagagactaatagaagtctcaatccccgagacaacctgatagaagcagaagcataccaattcccaggagttaatgctgtttactttagtctccgttgttcttttgcatacaatacctaaatctaattttaaaaatcacaagagacatgaataagcatgaaaaaaagaactcatcatcaagggagaaagcagtcaacagaaccagactcagaaatgaaacatattttgaaactatttgactaggacttttaaataattataatgaatatgttcattaatctatggaaaataagaacggtgtggaacagatgaagaattttagcagtaagatagaaactataaaggatatcctgtgaaatgacagattaaaaaaaacctgatatgaaagttgaaaaattttttcacatgcttaatttgcagactaaaggcattaccaaaaagttaactgggaattagaatatattttgattaaagttttccaaaatataaaaaaaaaaaaa

SEQ ID NO: 19094 - DNA, 678 bp, Homo sapiens
atgctagttccaggaaacaaatattatccctgtttcatattcatggattttctctctctaactatgtaattataaattgagacaagtgctcaaaggaaaaagaacttctctctctagagtgcataatgaaggagcttgacctagacaaggtcaagaaaggtgtctctggaaggggatgtttgctctgagagctgtgggatgtgtaggagttatagcaggggcagtttgatagggaagaaggaagccaagttgtatggaatagaagagtagtgcagtcaaagtttctacatgggcccaagcgctgagcactcagaggatgttgcctagaaagctggtttaaaagtataaatgccattcaggacataggcatgggcaaggacttcatgtcgaaaacaccaaaagcaatggcaacaaaagccaaaattgacaaatgggatctaattaaactaaagagcttctgcacagcaaaagaaactaccatcagagtgaacaggcaacctacaaaatgggataaaattttcgcaacctactcatctgacaaagggctaatatccagaatctacaatgaactcaaacaaatttacaagaaaaaaacaaacaacccaatcaaaaagtgggcaaaggatatgaacagacacttctcaaaagaagacatttatgcagccaaaaaaaaaaaaa

SEQ ID NO: 19095 - DNA, 653 bp, Homo sapiens
ctaggtgaactcccgaggagcagagatcacatgtaattctgctcttacttatcaggatgaagaaagctgtgcaacaagtttggctgagttattttagaagagatacatattttctaaatgagatttggataacagcctacgtctaatcctctggtgactgaagatgcaaagaattgtcagagcagtttggctcatcaagctataaagtacaaaattattatgacactcagttggcacatgtgaaaccaaccgaactaaacccttaatcctgtgtagtccctcaaacaggatctgtttctaagaggcaagcagcagttttgtggattatatatatgttacatgattggagtgagttaaaagtaaaataatatgaaggccagtatcagcaacccattgctttgtttttatttagtttttggtaatttcatggcttgaatattactttccacttctgtctactcatacataggaagctattttaatgttgctaagattaaatattgatgcttatgtagtgagcaatgatggcttttaagacctgaatttatgttaattttgatacatccaattatcatgcatgtaatagtaagtaccattgttcttttgctcaaactatttataattaaagaaaatatgagacaaaaaaaaaaaaa

SEQ ID NO: 19096 - DNA, 327 bp, Homo sapiens
gctcctccagctacagcagccaaagcgtattcaatccggacaagtttatcagacgggctgaatgtagtcagcgaaaagccgtaccgcgctccgccatctttacccgaagagccaaagcacaagttcagggaggtgtccactgtctctcaaatcaaccaccagactttagaggggcacaagattgttaacgcgcaaaggtggttgaggaattggaaaggttgactggggctgcaccttggaatttattttgtcttggataatatgtaacattaacagagagcagaagctgattaaagtatcttggtgccaaaaaaaaaaaaaaaaaaa

SEQ ID NO: 19097 - DNA, 533 bp, Homo sapiens
cctggggatgcgatcaaccttggtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgctgaaaggctttttcgattggcttctaactatatttcaaaagctgggatatgtcacaaagtttctacttttgccatgcgatctcttgcaagtttagctctacgtgtaacaaattctaggacctcgccctagtatctatactgataatatattttgattaattatatacattaattcattctgtgctatttaactgattaatagtgagcatttcatgaagtgcttttataccactattatatatcagagaaagattgagaatgaataagccaaaa

SEQ ID NO: 19098 - DNA, 580 bp, Homo sapiens
cctaggttgaaaaagtcgcactgaggtgtcctgccagcaaaaccagcagcagtgccagccccctcccaagtgccccccaaaatgcccacccaagtgtcctccaaagtgccgacctcagtgcccagccccatgcccacctccagtctcttcctgctgtggtcccagctctgggggctgctgcggctccagctctgggggctgctgcagctctgggggtggcggctgctgcctgagccaccacaggccccgtctcttccaccggcaccggcaccagagccccgattgttgtgagtgtgaaccttctgggggctctggctgctgccacagctctggggactgctgctgaccagacctcgaacatcacagagcaacccttatggagaaacttgcaaccaggacctgtcccagagtgatgcttctcctgcccctttttctcctttccttgggctgacacaccttgtgaggtgttttgtctgttgtcatggcccaagagcccatcctggatcctgatcttaccttcccactttacctcatacaacaataaagctcttttgcctcttcgtgaaaaaaaaaaaaaaaa

SEQ ID NO: 19099 - DNA, 511 bp, Homo sapiens
cctaggagagctggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggcctgggcgacggcctttcttttcatcataggtaatgcgggagcctctaagtggtgttgccagcatctcagatagcatccgacactgactcttctgcagaaacaaaatagcgtatttcagtggctttatttgtaactcggcaaatgaaggtgaggttgagtttaccttcgaaatccttcctagccttctttcccaagaatataagtccattaaatccaaaaaaaaaaaaaaaaaa

SEQ ID NO: 19100 - DNA, 311 bp, Homo sapiens
ctgcccatggacattctctgcacacagctattatggtcagtacctgaaagctcagtccctctcctgttctacacaaacaccaatgtctccccagtgcctcacacaccaacttgagactcctgagtaacacacgcatctgcattttcaatcaacgccttgagggactgaatcatctgcaaagggaacatccagacatgagattacacctgacaactagatcccctcctgcattcatgcacaaggctcttctcctaaaacaggctgatgtgatgatattaaacgcttttttatctgaaaaaaaaaaaaaaaaa

SEQ ID NO: 19101 - DNA, 349 bp, Homo sapiens
tcaggttggaatgcaatggtgcgatctcagctcaacgcgacctctgcctccctggttcaagcgattctcctgcctcagcctcccgagtagctgggaccacagaccagagtgaagacaaatgtgtattacttggtagcttatgaacagcaaggaaaaactgactggcaaccgccatggaaaggtgtgaaaccgtaaccacgaggactctcacatttacatgttactgactagcgaatgtctaggcctaaaacatctgccctcttatagctgttttattattatgtaaacatggctacaagatttctgacataaaatagtagatgactcagtgtcttcaaaaaaaaaaaaa

SEQ ID NO: 19102 - DNA, 274 bp, Homo sapiens
tccgtccttccttgccaatgagacgccctacaaagttattatgggccaggatcttcaggggaacctcgtcagcccttgggaagacaaaggaagaagtggaagacaagagttccttcaattgtgggcttcatgaagactcaatcaccatgccaccccagacttggcatttccaagtaaaacatctcaaaacttatcaaactgcatactttaaaaatatgtatgatttattatacatcaattgaacatcaataaagccatggcctcgttggcctca

SEQ ID NO: 19103 - DNA, 146 bp, Homo sapiens
ttgcagtctgagatgatctcaatcagtttggtgggaccaccaggtgacctctgatgcatataagaagtagaagaggattctccttcattgcaggaagacttccagctcttttctgatgtaaaataataataaaaaataaaaaggga

SEQ ID NO: 19104 - DNA, 884 bp, Homo sapiens
aacaatggtttactgatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaaaggtgatgtgacttttcttcttacatgctgaatcactggtggaaacgttaggataagcaagaattgccagaaaatagagtagacagatctttctctttgtctggcttgaatattgcttccatgtattttggaaaagaaaatgatttcatttataaatgaacatactaaaatagtcatgtatagcctctagcatttgagattatttttatttattagaaagagaaaatgttttttcttttcattggcaaatatcttccctatatctaaacatgggaaatctaaatgaggtaggggtcagactccttatgggggggtgtctggtggtgctttttccttgggggagaggagtggcctcaccccaattatggggagtaagggggagggatgtgtgagaacgtttggaagatggcctaaaaaaaagatatgggcttgttggccaacggtgggaggtgggggggcgtcgcttaaggggggggattcaggaactgggtgatggatcgttggcgagggagttggtaggggagaggtgtttctttttaaggcctggtggggatcgacaagactgggatagccacgagaacgtgggggaaaggcgcaatggccggacggtggagggcgtgtggggtttgtattagcgggcgcgtgggggtgaacacgggttgggtgattgcgaagcgcgaggtggg

SEQ ID NO: 19105 - DNA, 170 bp, Homo sapiens
cagcccccacagcagtgggcacagtcagcagcaatccgggtgtcagcccctctctgcaaggattgggggccagatgctccctccctggaagccacatcaacgacagaccactgctctactgagaattcaataaagactttttacagaaaaaaaaaagaaaaaaaaaaaaa

SEQ ID NO: 19106 - DNA, 631 bp, Homo sapiens
tatttctctcttcaatgaactcgcaacctcagaatgcatttgtgagttctcttgcagtgtaaattatgagattattcctaaccttgtcaggttctggtgacatactgcctaccataatataattgaagcaattcataatttttttttttttacctgaactagtttcaagttctgtggctttgcagctgccattgttcctgcttcacacagaacattcggtacaggggatactttatgggacagaacagatagttgaaagctgattttacttgctaattctcccttgttattctggcattaaggttgcattagaaggatgcaaagatgtttgatgaacgtgatctgtgctggggtcggcgctctgcaaatgctttaaaggtgtggcacatgacattgagccagtgcatccaggtggagcctgggacagacatataaccctaagtttggtaaacacctgtcacaggaagcctcatcaaggaattcttggggagtggaacagtggagcaccctgcaatcctcacaggcagcagccatagtaagcaatgttcagcatttgctgtgccttaaaaaccacaccgcttaccctactttagcaggtcactggaaaaaatgacccatatccaccaacgag

SEQ ID NO: 19107 - DNA, 787 bp, Homo sapiens
aaaattatctaacattctcccccccgattgggacaaaaaaaaactctaggggtcctcggttgtgtctccaggatcatcgttgcctgccccatcaccatcaaaggagcctctcagctgcagtggtggatccagcccatccagtggtccacctgggaggtctcagccaagctatctcaacacactcctctgcttggaattggtactatgtattatctttgttttaggatgtagggtaggaactgagtctattaatgtttttctcaacactgtattcccaggcctaataaggctagtaggtgcagtaataacctgttgttagagcaaaaaagatggcataagttgtctcccttgttgtttgagcctctttgaaacttttcattggtagtgaacacaaaaaggattaaagctctgcctaccaacatctctgccacaagagactggcccccactgtgagaatgctctgcctgatctctgaagattcacaggcttccaggcacgatcatatctcttctaagtcctgcacttacctgaggtcaaaagcctttaaattggtacaggtggccgagttgggatacaacaaaatgcattcagacaatccgatcctgtgatctggcaaaatgcaaaacattatagccacttactaaaaactgggtaacattgtgcagaaactcaggggacagatacaaatgattgtttgtccatattgatttgattcctgtaagctaatgaagaaatcaccttgtgacatcaaagacctagtactcaataaaagagaaaacattcaaaa

SEQ ID NO: 19108 - DNA, 300 bp, Homo sapiens
ggccttcgtcctagagccagatgatttgcatcgaccaccaaactgggcaacgaaaccagcatcgttttccgggggcgtggggtgagagacataaaacaaaggtgaactttggcatgtacctgatgcatgcatcattggatttatcctccccatgtttcctgtctgtaagatctcacgtgctccctgtgttgaaagagaatgtggaaggtcatgatttacctgcatcgggggggggcagcatgttacctcctaaaaaaaatttttagcatacattaaagctgctctttaaaaaaaaaaaaa

SEQ ID NO: 19109 - DNA, 538 bp, Homo sapiens
acacataacttgggtcctcagcccaacggcccaaaaggaagtgaaacctgccaacagccaccggatgagtttggaagtatatcttgtcccaggtgaaccttgtgttgactgtagcccaactggagtaattttcaatgcagcaatagataaagaatataccagaatggagctaccacatggtcaggaggaagagactcacaaagaaagatgaaggttgcagagaggtgctatggaaatagcacatgctaaaggagtctcctaagcagcccagaggcgatgacataccagtgccagcagaggaggagaaccacgcttcagtataacaaaaacttcaatgaatcatgctcaatgtggaaaagtcgaatagacatggctgaggataaaagagaagaacgaacacataatctcactacccagagagaagcaatgttgacatatttctcttcctcaatgcatatttatatattgttgatatttttactgtctgtgcaattttgctttaattaaacatttagattatgaaaaaaaaaaaaaaaaa

SEQ ID NO: 19110 - DNA, 823 bp, Homo sapiens
aggcaaggagcatctcattcattcacagacaagactgagctgggccaaaggtctctgtactggacctcatcttctgtcttccaatccacatccttttgggcatgagcagaaagactgagtctcactctgtcgtccaggctggagtgtagtggtacaacctccacctcctgggttcaagtgattctcctgcctcagcctcccaagtatgtgggactacaggtgtgcactaccaggcccggctaattttttttttgtatttttagtagagacgaggttttgccatgctggttgggctggtctcgaactcctgacctcaagtgatctgcctgcctcgaccccccgaagtgctgggattataggtgtgagccaccatggctggcctgaacttcagattttttatctgtaaggaggggttaggaggcctaaattaagtcacccataaaaaggccatgtcacatgcagtcagtgcttagcaaggggctattttaatcgtcacactcaccagtcagagacacaaatctcaatcctgccactatccagcagttctggccacagaccctcctcctctaggtccaagacctgcttcttgcaacaccagctgggaatgcaggagacagggtaatgagaacaggcaggcctttctcaacaaggggccggacctttggatagcaggggcattcacctgaatgaagtcacgaagcacgtctgagaaggggccccaggcacggttgtcctgttttcctccaccacccagccgtccccaccgtgttgcaccatccactttcggaggccttctgtgaaataaaaaaggcttgtgcccaaa

SEQ ID NO: 19111 - DNA, 386 bp, Homo sapiens
cctaggtgctaacggctctagcagactggagaaattctggcccagctggaagtagaaagaggggagtgagtctcctgaggaccgtctcagaggccccgggatcacccgaacagtaagaaatgctcttctgtcgtttaacatacagttacaccccccaagcaggatatcttttcttctgaaggcctctagaacgagctcagaacatgagctggcacttaacgtgaacgaccttgaaagccaggcattgtgtgattattctcatgtcttcatgtcacctccttagctccttgaggaggagggctgggccttattcctgtctcttctcatctattctgtgaacaataaatggttctgtgaacaataaatccttggcctcgttggcctca

SEQ ID NO: 19112 - DNA, 696 bp, Homo sapiens
aggtaccaggatggctctctgtaaggattcccaccaggaatgccaaagccagagacttagggaccaaaggacccagaagggagatctgaaaaattcctgcttaggggcgggtcctggaggctctgatttttctgggtattgagggacccaaactcaaccagattccaaatgccagacgattgtgagtagatacagctggtgagagggtgctctggagacgcctgcagaaaagagaggaaactggcccagcctcctagagacacttctgagtacggctcggtcctgagcctgacggcagtccaggctgtagctgcctttgccaggacatgtgataaaggcccgcagatccttgatcaaggtgtcagccactttgtcggagctcctggaaagggcttctctttccttcatggacattctccaggttggtagtggttctggcgggggaattttctgtgcctctggtcactcatgtgtctatcccccctgagtttgtatgccagttcttttagactagcgttgggatcatggacagtgctcttatcttccctaagcctcagtgtgctcatctataaaacgggcataataatataccctactgaattaaataatggtgtgtggaagtgcttcacacttgggctcagcacattgggtaaatggttcaataaacccctcgggcctcgtttgccttaaggaggg

SEQ ID NO: 19113 - DNA, 894 bp, Homo sapiens
tttttttttttttttttggagacagagtttcgctcttgttgcccaggctgaagtgcaatggagtgatcttggctcactctaaactccgcctcccgcgttcatgccattctcctgcctcagcctcccaagtagctgggattacaggcatgcgacaccacaccaggataattttgtatttttagtagaggcagggtttttccatgttggtcaggctggtctcgaactcccaacctcaggtgatccgcccgcctcagcctcccaaagtgctgggattacaggcgtgagccactgcacctggctgctttgttcccaatcttaaagaaaacatttcagtcttccaaggattggttttgagctgaagctgctctccttggcttgcagatggctgtccccttgctgccttgtcacatgattagccctctgtccacttgtagctctcggtgctttgcatgtccagatttcttcttataaggtcaccagtcatattggactagggcccaccctaacggcctcattttgacttaatttcttctttaacggctttgtctcctaatacagtaacattctgcagctctggggattgggacttcatcatgtgaattcgagggaacaaaatacagtccataacaatgaagaaatggatccatgaagggatggaaaggagggatcacatgcagctttgaggggaaacgagcaggccaggtccacattttgtcttgcatttgctctcagagtttgccattgatcctcttggatcatctgtgtggacaatcatgtcccctggaatgaagactgctttgttcctttatgtccctcctcttggcaagctgtgctgggtcagctcacgagacagaattgagttgtcctgagcaggcatgcatgccgtgtccctag

SEQ ID NO: 19114 - DNA, 1006 bp, Homo sapiens
tttttttttttttttcctttgaaagtaagagaatgctgatttattaatgttttatttattcttaatgaatgaaaatatatattcatgaagtataatttatgtgtacaaataaaaataaagagtaagtatgaccagaatccagacatacaaatgaacaagcatgccatatcagaattttttaagtttagtttgtgaatgaaataaccttataaattgattattacagaccaagagaaagagcttgaaatgcagcttgaaaatgtgagcataaaatttcaacatgtttcttacaaatgttatatataacaagacatttcaaacgatgagcaaacatgatatccactacagagagaaacacaccaaaagatgatgaatgaaaagaagcatgaataaaaaagtaaataactctgttataaaaaaaaactgctgacagagaaactataaagatagattggttagtgacaagaaccttacaaacattaaatttgagataacaattttgctaatatagaatataaatgttataaaatggagtagtaatagacataaggaagaaggaaaaggaaaaatattatataagaaacacctccactacatgcattacattcacacccacgcacacacacacacacatacaaacacacaaatcaagaaagggctgttaaagaatgatcattaagtctgggcgcagtggctcatgcttgtaatcccagcactttgggaggctgaggcagtcggatcacctgaggtcgggagttcgagaccagcctggccaacatggtgaaacccagtctctactaaaaatataaaaattagctgggcatggtggcatgcacctgtaatcccagctacttaggaggctgagacaggagaatcgcttgaacctgggaggcagaggttgcagtgaaccaagattgcaccactgcattccagcttggggacagagcaaaacttcatccattcatatggaatctctggggatcccaaatagatagcaaaatccatg

SEQ ID NO: 19115 - DNA, 400 bp, Homo sapiens
tggctagagcgagtaaggaaaaaaaaaaaaagctcaagaagactgtgtttgttaactagggaggaccagcactgaataaatgtcgcatctctgatgagagcttaataaagagaaaacacttaaggaagaaagactcgaacccatcctcggattcccacggtgaagacagccctcattactgcaagccaccaaaccctcccaagggcctctgacatattattttgggcacttaaacctttccttctagaatatgggtcataagccctttctctcccccatcttctctcctctgactgatgacaaagaatcttaattaagtgtcccttggctgctggtttaatttgataaatataaaattgaagcatgctaataaagccatccatcatcaaaaaaaaaaaaa

SEQ ID NO: 19116 - DNA, 935 bp, Homo sapiens
  misc_feature (1)...(935): n = A,T,C or G
cggtatactataagtaaaccagtcaaaattaggtctttcccctacccccctccaggactagccgaggcctcagacgcattcctaccatggcaaaggtcgctttgggatcatcgaggggggggattgccattattttctgaacttggtggaagggcccccacctgcacctgagccaccaaagacggcagttgcccatgccaaagagtatattcagctacttcgcccccggaccatccctcacactctatgatgaggagattgagactccccagtggggggggtttcccatttattttctaaaactaccctaatgtgcaggcaccccacaacaaaccgccctcgtttgacctcaccaggagaggttctcccgccgccccctttatgggagggttatttatgaccctcgctcactgagtcnctgggcctccccccttccgctgtggcaagcggccttaggcctctcaaggctggagtcccggattccgcaaaggggggggagcgctgggaaggacttgggaggaatggcgccagagggcccgcaccctccagtcgggggggcgtgcgatattctcaagaatcccccctgttcgaggttccaaattctcgggttggttaggtgtggaaatccccctggcggtgnagaaccgggggtggtcggtgaagcaccttacgtgggtggtttgagaggntagcgggacccggcgctgccatcatttctactgcgaaggaggggcgtctgaggccagattgcgcgtggtcgcactccgtgcccttcttaacctcgacttgcgccgtcccgaatcccagtaccccgcagcctcacctcgcacgacgtacggcgcgagcgccgcccgggttgtcgtgcccgccgagcactcggacttaagtagttgcgaactcgtccggagcgtcctcacctcgtcgcgatggccccg

SEQ ID NO: 19117 - DNA, 494 bp, Homo sapiens
ggtaggaatgtgatatgacaggtggagattcctgggtctcatccaacacccatgctggagtgcagtggtggtgtgattatggctcactactgccttgacttcccaggatcagatacgggctttcactgtgttacccaggctggtcttgactcctggacttaaaactatccaccagcctcagcctcccaaggtgctgggattacaggtgtgagctaccactagtggcctcttctaagaggaaatttggatatacagagagacaccagagatgtgggggcacagaggaaagacctgctaggatacagtaagaaggcagcctctgcaaacttaggacaaagtcctcaggagaaaccaaacctgctcacaccttgatcctggacttctagcctccagaactgtgaaaaaaatattctgttgtttaagctacccagtctgcggcattttgttttgccagctctaataaactaataaacaaccaaaaaaaaaaaaaaaaa

SEQ ID NO: 19118 - DNA, 249 bp, Homo sapiens
ggatcccagcattcggcatgagggcctcatccaatcagctgaaggcaggggagtgtcgcctaagggcccggaggaggaattcccaggaccgccacagagaagcccggcctgagcgcacagcctggactcgagactgcaacagcggctcttgacagccagcgcgccctgcgaacttcagacgtgacagccccacaatcgcgtgcgtcagctccttaaaataaatacccatttcacagaaaaaaaaaaaaa

SEQ ID NO: 19119 - DNA, 1182 bp, Homo sapiens
atgccacccatggagcacatggacagatcagcatggacttcatcccctctgaagcccataaaaatcctggagtcagccgcaacttggggatacgacctgcctgtgggaaggagctacccactctggctctcgtcttggctgtgagctgcacacttgtacggatgacctgcctgtggaaaggagctgtcctttgtatgtctcctgggaactgttcaactgctcaatgaagctcctctctaccttgctcaccctccagttgtccgtgtactttgttcttcctggatacaggacaaaaactcaggacctgccaaatggcaggactaaaagagctgtaacagaaacagggctgaaacatgctccccaccacatcccgctcaccacatcgtaggcaatggggacagacgagttgtagcctttcatggagcacagacctaggggatccctgagccagggctgtgacaccctctgtggagttctatggttcttggcatctccaagcttccgaatgctactgcatttcccttgtccagatatggatgcctgcagcagaagctgtatgtagcacacctggtccagctgcagccttgcacagagccatcacctgtgttggcatctggagctgcctgccctctgcagcagatagcctgtctggctgtgcgcaatggctgggccccattttcactcatttacacacctctcaccactctgtgcctggctcgcccttggcaggtgtgggatctgggctggtaacaagacctgaacacagcctgctgggccgagtgggtggaacaagcccagtgggcatgagcaatacttaggcagaaggcgccaccagccacagaggtttccagctggtgaagtgacacctcaaggatcctgtgacacagagaaacagcagtcgaatctcactgggaacataaggaatgcttcagtgagtgactcctgccagagttagatttcgagaagcataggagatggttagacggagaaagaaaatttcctagcaaagagtgctagcagtatatgaaaagtaggagaataggaaacaattctagaaacagtaggatgtgttgagaggtggaaaacaaggaccaatattgggagccacctaaaaatgggatgatttccctattaaccaagtatgaaataaattcactttgaaatgacaaaaaaaaaaaaaaa

SEQ ID NO: 19120 - DNA, 163 bp, Homo sapiens
aatgcttctcgcattgaatcactgtgactctccagcctgcctcttttgcttcttaacactgtcggggaatccaaaatactttcccaactcaaggcagctgattagcaaaccaaattccctcttgccatggaataaactgtcttcacattaaaaaaaaagaaaa

SEQ ID NO: 19121 - DNA, 371 bp, Homo sapiens
gctcaggggacctggttgcttcctctcgtggtcattgtgaacgctgctgcaatgaacatggtggtacaaatatctcttagagaccctgcttttcaatgctttgggatacatacccagacatgggattactggataataggcctgccattcccatatcctgcgcccataaaaggaccagctgacagagcaatatgaatggctaagtgttggggatacaagaagagactacagatagctgcggccaacttcagatggtgcgacttcagggaaagatcaccttcttcccccaccatcccctttcctattccccattccactgagagccacatccattgcccaataaaatcctccacatatactacccttcaaag

SEQ ID NO: 19122 - DNA, 307 bp, Homo sapiens
cttcagattacataggaagacgaatcttgtcagctttcaagacatggagtgtgtgccttgtggagaccctcctcctccttacgtgtttggcctgtatagtcttagctactcaggaggctaaagcaagaggattccttgagtccaggagttcaaggccagcatggacaacatagcaagaacttgtttctaaaaaaagaaaaaaaaagtgtgtgtttgaaatttgaggctctgtggctagaattttcacttaagaggaaatatatatctgcatttaaaattctttaatttataaataaaaaaaaaaaaa

SEQ ID NO: 19123 - DNA, 786 bp, Homo sapiens
  misc_feature (1)...(786): n = A,T,C or G
cagggagcttcaaggcaagggtatacaactaagctttctggaatggctggtacaatcaacccttcttgaagtggagtcctggataagatggcctctccagtctcggactctataggcacagaaaaatgaagaaggatgtccttgagaggctaacccccggcagggaaaaagacttactcctggatcctgtggttctcccactgcattatttacatccttacctgctgggaaatcatgaagaacgacagcatgaggagcaccactgtcaacaggcttctgagcgtggcttggatccttagggggagaaaagggctgtgaatgaagtgtgcaggatagatggtggatttattattcactctgagaccaattttttttttctcattagagtcctcttgacacaattacattatgagtacatgatgcaaaccacacagttgagccaaacaagggaattattatcaagttgaagaagaatgtgtccttgctaagggaggacgaaaatctcaattaaaatatcccccagtatgttttctttttgctttttaagctgagagagtaaaacaaaagggactggttatttattttgaaacgtatctattctaccccaaagtagtgggttttgacctctttccctttcagaatagctntttcctaaaactgtgatcaagacagagtcttaaaggttgtgttttattgggatgggaaagaagaaagttctatgattatgctctggcctttggaatgaaaggactattgactttcaccagaggtttattcccaaaagta

SEQ ID NO: 19124 - DNA, 227 bp, Homo sapiens
tttttttttttttttgttgatgctgagcttttaatatgcagattttaagaacaacgattgacagagtaatgtttggactgagatgagtcaagaataagctcaatgatgcctccatctgaatccatttctccatccaatatcttgccattgcgcatcctggtcttcccaaccaccattttcttggtttcaaacttcttcctgggttgtgctcaaagccagcgaggtag

SEQ ID NO: 19125 - DNA, 373 bp, Homo sapiens
tgaaatgcataaccccatctaactgcaacgaaacatccaaaaatcccaaatgaggaaggttctacaaaatgtgtgaccgctgctgctgtcaaggtcatcaagaaaaggaaaaaaagaaaccatcacaatccagaggagcccaagaagatatgacaactaaatattaggtagccacctggatgggatcctggaatagaaaaacggcagtagggaaaaactaatgaagtaaaattaaactctggagtttagttaacagtgatgtacttaaattggttctttcacagtgacaagtatactatagaggttcttaaaattgacattttattgaagagagtacaataaaattataatcaccaaaaaaaaaaaaaaaaaa

SEQ ID NO: 19126 - DNA, 897 bp, Homo sapiens
cttctagggactacaggggaaacgttggaaacagacctggagaatgagaaagtgagtgaaggggctgaaaccaaagaagaagaaacaggagaagtggtggaccttttatcagccacatagatcgaagagtgaaccgacacaatgcgtcatcatatatgagacacacatggcagtgaagcttgtggttatgcatctgatctttatacattaacctgtcatctgtccggtttttttgtttacgtcagactgctgcaaccacgaaaaggtagattctccatactccaccctatcttcctcgctctcccccttccccgtccaacaccgttacttaagttccttattaatgcactttcgtaccattagtctctaaattcttaaccaataatcttgatacagatcattatcacgccccccctagttcacatttctcaatttctcatctccttatctcctctcccctcttatcccacacctcgtagaattttcatctatctactcttagtattgtgctttatttaacctaattcttatttattaacccactagctttttatatacctctctcatccgactaattcatcactacccctcactgctctccccccctctcattcatctccctcacacattttatctcttatttttccccgctccctctttcatctccctaattctcgctccttttctctacacttataatactatccccattcatctcccatcccccttctacttttatcttctttccccccccccaccattcataaacctcatctctacaaactaatatgactaactcaatcatctctcatttcttgtcgtctcttttctcacgaccctcttaacgcatttatcccttgatactttttgctgctgtcatttttccccctccttcct

SEQ ID NO: 19127 - DNA, 749 bp, Homo sapiens
ttttttttttttttttgagatggagtctcgttctgtcatccaggctggagtgcaacggcatgatctcgactcactgcagcctttgtcttacgggttcaagcgattctcctgcctcagctacccgagtagctggaattacaggcaccagccatgacgcccggctaatttttgtgtttttgtagagacggggtttcatcatgttggccaggctggtcttaaactcctgacctcaggtgactggcctgcctcggccccccaaactgctgggattataggcgtgagccactgcgcctggccaaattgatattttcaatggtttgagaagaaagcataagaaagcaaatttgtgttccacctggagaggagtgttttcctccctgtagttttctctccctagcccatgggctgtgttttgtgacaggtgattcatgtcaggaaggtcggggctggcttgtctgggcggccccgacagcatgtctgcctggggtctgtctgctgtgggtgtgggtgccaggtcatctctgattccaggtgcttggcccactgcaggtgctgctctttccctatgaaggagctgtgctaccataacctgtaactggagcggaaccggaatgaggatgctgggttaatgtccggagacatgtggcctatgattgtgatctatggttacataccgggactggtaaccgcgtgggtttaccctcttcctgtataaatagtaatgctgtctccctagactatttctactg

SEQ ID NO: 19128 - DNA, 586 bp, Homo sapiens
  misc_feature (1)...(586): n = A,T,C or G
ctagtggagcagaatgaatggaactcacatgatccgctggggtgcgtcctggtacgcccttgccctgctgtaattgtgaatggacacatgcaacaagcccagccttaggagagtgtgatcatcaagggctcatacctctcaggaatgaagagttggttcacaccaccaggcacnctggaaataccactggcccaggagcaccttacaccatgttgttggcttcaggtcctctgggatttctcagttaaaaaagaaaagcagaccggcgcagtggctcacgcctgtaatcccagcactttgggaggctgaggtgtgcagatcacctgaggtcaggagtttgagaccagcctggccaatatggtgaaaccccatctgtactaaaaatacaaaaactcctgggcgtggtggtgcgcacatgtaatcccagctacttgggaggctgaggcaggagaattgcttgaaccctggaggcagaggatgcagtgagccaagatcgcaccactgcactccagcctgggtgacagagcaagattctgtctcaaaataaataaataaataaataaataaataaataaaaaaaaaaaaa

SEQ ID NO: 19129 - DNA, 529 bp, Homo sapiens
tttttttttttttgagatggtgttggcattctgttttttttattaccaagattcaccggtatcaatgatttgggcatattctgcaagtgagtgatttaaattcatggttaatcatagcatcatgaaattttgttacaatgagaaatattcattgtcttctaatccagggatcaactgacaatggccttaatccagaactagccaaccacctatttttgttcggcgtgtgagctaagaataatttttaaggcagggcgcagtggctcacgcctgtaatcccagcactttgggagaccgaggcgggtggatcaggagggcaggagatctagaccatcttggctaacacggtgaaaccccgtctctgctaaaaatacaaaaaaattagccgggtgtggtggcgggcgcctgtagtcccagttactccggaggctgaggcaggagaatggtgtgaacccgggaggcggagcttgcagtgagccgagatcgcgccattgcgctcctgcctgcgcgacagagcgagactctatct

SEQ ID NO: 19130 - DNA, 620 bp, Homo sapiens
aaagacgggatgctcaggatactagaaagtccaagcatgacagaaatggtctgtttacatcataagaagaagacagatgaaaaaaaagctttcatatgagcaagtcgtctacaattaaagggaaattatttaaaatggtctttcagagattgggttttgatttttaaaaaaccacttatacactaaagaattggtttgaactacaaaattttcttaaggttattacgtccatataactttctgtgaagggagccgaaggcccatgggacgtgaccaactcagcattccactggaggctatatgatcgaacagcaaactgtttatcatgaatgcaggatgtgagcaaactcacaagtgttcccgccgacagaaggtttgctggaggcaatcactcccgggtgccgaggttatctactgcaacatctagagcctgttgtttgaggaatgcagtcttgcaagcctactctggactaagcagctgaccccttcttccactccccttctcactgtctctttcgcctaataaatatggagggctgtgtaaagctcagggcccttgtccacaagaggcaagcttcccctgaccccttcttccaaatataaaaaaaaaaaaaaaaaaa

SEQ ID NO: 19131 - DNA, 966 bp, Homo sapiens
cccccccccccaaaacaatactaatacacccccaaccacccacatcacgggcatcctgaccttgttttcctgcaactaaacagtctcacgatgatgggagacagtgatacgtcatcaggcatgatcttctctcaagaagcctgcaacctggaatcttctcacaaggagtgtgcaacctagattcttctcacaaggagagtgcaagctaaattcttcgcatgtgcagttcacgataggtttcatgctcccatgagaatctaatgctgatgctaatctgactggaggcagagctcagggaaggatgagagtgaaggggagtggctgtctcacgccacttgattactaccctgatctctctatccatagctaccaaccctactttaatatgtgcaactttctgaaaataaaattttaaacaggggactgaaggaaacgagactatttcactcagaaatttggttaaagaaatagttgcaaggtctctctggcctctcccctaccctgctgttatctctgaatcacctgtctctctcgagcacaggattaatctgttctctcaagttcccttactttcctagaaaccagatatgctaaagagaaacagagttgccttctctgaaatttcattaaccagaaaagatgaaaactcatattccagaggaggagattgaaaactaaaccctacacctagagcccagactttgttccaaatcaaactctctgttcaatttaatttccaaagaaattatttattaaccattgtctgagcattaaatctattcattttccccataaaaagcatttactatccctcagacggccccatttctcctaactcttcttcccctatgaagaaggcgttatacacatctgtaccacattgagttactgggtaatcatttttctgtaatttccttatgctatgcacattaaaattaatttgtatacaaaaaaaaaaaaaaaaaa

SEQ ID NO: 19132 - DNA, 667 bp, Homo sapiens
ctggaggctggaaagttcagggtcaagatgctggcatttggtctgataagggccttcttgctatctccttacatgacagaagacagtcgaacaaaggcaagttagccaaaccctgtgtgaagcctcttttataaggaccttaattccactgatgaaggagcagccctctggcctaatcaccttttaaagaccccacctcttaatactatcacattgacagcacccaaattttggagtgacacattcaaaccacagcagacaacaatggcttattagcttggtgcaaaagtaattgaggtttttgccattacttttaataagacagatgtagaagataagtttcaaaccaaagtcagacaggtagctgcaagtacatcaaaatgaaaattcaacaaagaaaggaattgttgcttattttattataatctcatcctcttagcctaaaacagtgcctggcactttgtagttgctcagtaaataattgttagataaatgaatgaagtttccctctataaattccagaaatatttgagaaaattttaaagataatttttgttattataaagcaatgttttactgtaaaagtgaagactatattgatataaatatataagcatagacacaaaatgattaaaattgatcataatcctaaaaaaaaaaaaaaaaa

SEQ ID NO: 19133 - DNA, 223 bp, Homo sapiens
ctctttgggtgtaaaatgcaaagatgggatgaagagacattgcagccctctgattactcacttgggggaagtagatcaaggctatgatgttgcctgacagtgatggttgaaggcagctgagtcctgtcatggaaaatgtaaaggccctcccctttttcatttccctccaggaacttctgcctgtagtaataaagaatcctgtgttcaaaaaaaaaaaaaaaaa

SEQ ID NO: 19134 - DNA, 1394 bp, Homo sapiens
cttagagtaacttcttgtttttatggaactgtactcaagactcgtctgggataaaatgtcatcagtagcctctggcaagtagagattccacatctgggtaacttcacctgtccttactttataatgcatgagcaccagtctgatactctggagttcttccattgccgtgccagcagagagatgactcatggcccaggtgaaattcaggtccaagctctggagagtgtgtggggactggtgaaaagacatggttttattgttatctgtttagttcctgctgcagaagatgagactctcgctctctttgtcatttccccacatgcacagaaacacacatatttctacttttctcatcctctcaacaggctatcataactttggttaaatcaatagtcagtgtttgtatattattattggataaatattacttacagtggaacccattttgtgtatgattagatattctttcttgtagaactttatgtttatccaggagttaatacttatctgattattttcagttgcttaatgtcctatacacctgttattaatttatgctgaactctccaacagaaactgaaatcttgtcttactatgtttaaacacattgggtattctacaagtttcttttcttatttatgtataattctcctagggctttccatcttcctgctctagtctaaactggttgttctctaggccagtggccatgttatcatcctgatattctccttcaccatcagcctgggagttctgttggtttttctcctgtatggaatcctctatttcctgttatgtttaaaaacttggtcgtcacccctaattttcattgggtatatttatgcaataacttttcagaaaaaggaaccaaaaaagcaacatttttttccctgggattttgcttacttgaaaatatctttattccatgggtcagccaactataggctgtaggctaaaatcctcccattttagtgaataaggttttattagaatacagccacatccatttgtttacttattatatattatgccacaatggaagatttgagaaattgcaataaagaacatttagatgataaaatctacaacatttattatctggacctttacgaagcaaatatttgctaacacttgctttattctatgttcacacaaaattgttaattttgctagatatagaattttaaagggctttttttttatcttctagcttccagagtgaatgtttaatagccttacaacattctgattcctaatcctttatataaaaactgttattttgtttgtttttggaagcttctgaaaccttctccttgttcttggtatgaacacttgtttttctaatgcaataaacacatgatgaacccactcaacataaaaaaaaaaaaaaaaaa

SEQ ID NO: 19135 - DNA, 536 bp, Homo sapiens
ctaaagttctgctaaagatgattaaagttcaggcatccttatctagcgggggggcagagaaaccccagtgacttgggcaagcagttccaaaatgactctcttatttaattgtggagggggaaagaggactcacaggtagccagctgaccatgactggatcccactttactcctcttcccctcgcatgatctttttttaccatggccctcccctggcgcctagcgccctctaacacccacaatcaaatgctgtatccgcctgctcatttttcacacgcacccgcaacgccccagcaccactctacagcgagccatcatctccctccccaccatacaaccaccccctcccccgccccttccccccccagcccccccgggcccgctctacgaccgcgctgtggcgccctccctcgctccgccgccctctccgctcgctccgccccccccttcgccccgcccaagccccccctgctccccccgtgctcggttgtctcgacgccaccccgcgagcccagcaccactctccacctcgaccgt

SEQ ID NO: 19136 - DNA, 410 bp, Homo sapiens
ctccgatttatcagcgatgctggttagtattcaagaaagcttcaagcaaaggtccaaaaagactggagaaattttctgttgaacgtgctgcatatttcaggtgttatcataagtctctgctatgggacttatcatgttgttgtactccctacactgaagccccgagaggatgaggactggatctcattgtgtctcagacactgcctgatgcagaaagacactcattcaatgcttggggaatgtggggagagaagggaggggaataagcagaaaaccaggaacagtggacgaacaggaagttctaccgattaattgctctctttaagtttgatgactaaattttcttatagtagtgagattttctcaataaaatggtcattgtgtgttcaacttatttaaaaaaaaaaaaa

SEQ ID NO: 19137 - DNA, 293 bp, Homo sapiens
atatggggtcttgctgtgttgccctgactggtctcaaactgctggactcaagctatcctcccgacccggcttcccaaagtgttgggattacaggcatgagccaccacactcatctatttttttaaaaaatttaaaaggtttatagcctaacgtatttaaataatatcatttaaacgtatgtcatgatttcaatagttgttatttaaaaatcctaaagttactaagctaagaggaacagaaattaaatggcaacaaattttaaataagtaattatgaaaaaaaaaaaaaaaaaa

SEQ ID NO: 19138 - DNA, 753 bp, Homo sapiens
ttttttttttttttttttgagacaaagtcctgctctgttgcccaggctggagtgcagttgcacaatctcggctcactgcaacctcagcttccccggggtcaagcaattctcatgcctcagcctcctgagtagctgggactacagtcatgtgccaccacgcccggctaatttttgtatttttggtagagatgggattttgccatgttggccaggctggtctcaaactcctggcctcaagtgatccacccacctcagcctcccaaagtgctgggattaggagacaacgtaattaaatgggacaaagtctttgttttctaagagctcatagacttgcaaataaactgaatcacagaataagttcaacagaagtgactaggagtagagggtgatcaattctatctctgagcttaagggaaggcttcctggaagaggtaatgtctaaataggatattggaggatgaatagctcacaagtggacaagcagaggaaggctcttccaagaagagatgaaagcacatacaaaagcatagaggtctgaaaccaagcaacatacacaggaggaataagtagttgagcattggtaagtattaaataaaggggcggggacaggtgggggtcatagcaggagatgagaccagagaaacaggcaagggacccactgagaaaagccacactaccactctgccaaaagattagggtgccagaagggtttcaaaaagggacattgttagatctgcttattaaaaggttaat

SEQ ID NO: 19139 - DNA, 1065 bp, Homo sapiens
agagcctggccaaaatggaaaactgcaaggttcaaatcctggagtgcagaagaagcattaggcattgaccctgtggcttcctaatagatccgcaaagtgctttgttcctggaaatcatccgatgagtagttcagtgctattgtatatcttgttagagcagccgaagtgccacaaaatgaactaaaatctccctgcagagttgctgtatcatatgctgagaacattcggaactttcaacaaattcatgttacgatcctgggtagccatggttaaatctgtacaggggttaaatgagaaatatgagcctgctgttaagtgtcttctgagagtgacaaagctctggccataagggatgggagaggagggatttcttctcagccttccagccctttccagctgtatcacagacaggagacataatgcaaaggggctcagacattgacttcctggatctttgcggccccaggcattgaccccctctacctggcttttcctacgctgtaaaatgaggatcctcctatattatgggagtttatttgtgacaactaaatagctgagaagaaggacatctcatttgttttaagtacgcagtttcctgtctatctatctatctatcccatcaatctatcaatcaatctatcaatctatctgtctatccctatctatctatccatctatctatatctgtctatatctatctaacatttatctatcatctattcatctatcagctatcatctgtctatcaatatttcaatcaatctctctatccctatcaattaatctatctacctacctatcaactatccatctatctctatcatctatcatctattcatctatcatttatcatctgtcaatccctcttcctactatctatcaaaagcaacacattttcttcctgactttaaaaatatttaagtgggccgggaggatggctcacgcctgtaatcccagcactttgggaggcctaggcgggcggatcacgaggtcaggagatggagaccatcctggctcccatgctgaaaccccgtctctactaaaaatacaaaaaaaaaaaaaaaa

SEQ ID NO: 19140 - DNA, 660 bp, Homo sapiens
ctcggacacttcagctgtctctttagaaaacttggcaaaaggaaatgctccctgctgaaaattttcttagcctgttgcacaaaagatgaagtttgtttaagaaattgctgctaaagaaagcgtcaacccattaaggtaacatggaagcaaatattctcagaaaccaacagagaaattgagctgattcggacactagaagagccagctaccttctgttttattttagctttgttgtttcatcttcgtcatatcgtatccaagtaaaattggaggaaaatgtcagaagaagcttacaggctcacactcccttctgcgaccttgttgaagaaggcgcctgctccccttttgtcttctgccatgattgtaaggatcctgaggcctccgagccatgcttcctgttaagcctgtggaactgtcctggctatggaggagggttccattcttacctgttgctctacaatgtacagctgatgttttacaataaaaacatggagtcatgctaactcccacatgccctaccattcactctccccaagccagtaacaaagcaggcaacgcagctaatataatatttagactaaccgtgaagaaaaagatctttctcccttctgtactctgaataaataaattagtctgaccaaatgaagaaaaaaaaaaaaa

SEQ ID NO: 19141 - DNA, 747 bp, Homo sapiens
ttttttttttttttttcccagttacagctatcttacatagaatatggggaaaatacaaggaaatctatgcataactctcaaatgcatggcataacaaaattaacattaatggactcttcacaactaagtacagttataagtcataaaagattaaatcaaacatattctgccacttggcaaaactataattatttctcctatttgcacagtgtcatgaattgactgaaaactcaaggaaagacaattaactgtcccccttcatgggggttctaaagcatgtcctgcagattctctacctactgaagggccataatcaatattgagagacttaggacttaattttaaagtacgaaactatgaaagagtatctctttgttatggtgctgaagacatgcagcctctattgcttgaaagtacaatgaacctggagcctgaaagtgattcaacattaaatctgacacctgtgtcaatgctcaagcatgccgggcacagcttgatactgctattacaaagccaaagcaaggcaggagctaacacgggaagagacctaagggtcagaactacatataatcagcacgaattctgtgagtggaaggcaaatgcactgcagttcagatattgctagatgaacaaggatgcctcttttgtctcttctgggtctgaatgatccacagttatataaagatcattttgtaaatatttcagagcagtaaggggatccaactgggccttttcgtcacacctagg

SEQ ID NO: 19142 - DNA, 867 bp, Homo sapiens
  misc_feature (1)...(867): n = A,T,C or G
tttttttttttttttgttttttttttttttttcttcaaagaattaaaatttattttatgaattcattgaagtaggggtacaaagaataaaatgaaatcgacaactacaaaattaaacacaatcaggtaatgtcattttatccagctaccatttggaactgatttttaagagacaatttgtcaaatgcattatattggaatccacaagttttgcatgaactttttgtgtgtgtgtgtgtgtggacaaggaagtatctttcccttcgtgggggttggagagaggcacaagtcaactaactaaaagggtccaccttgaattagcaaaacaaatactaggaattcagaacttctaaactaacagcagagcagttctttccaaaagctaatttgagacattttttttgagagagaggctgtcttttggataggttgattacctcttcctccagattgtctaaagctctgtctgttttaaattgggtatttaggaatgatatatttggatttcattatctcagcaacccatagaaaggattccactgaatttcttttaatgttaaaattgaaccttttatagttgaacaatgtccatgtttttcataagattgtgtgaaggcatcatccatccattatgttcttcaatgtttttaacataagaaaccacatgttaaagtctccattcagttttgagccaagaaaatgtttgtgtatgcaggcaacttgggagaaacacatttttcctttttgccttggctgccaagatgaacacacataaacttggtgtttatctgcagtgattgactcatcacaggtgcctggtaacagcaattttntgtcccttaaagtgttttgtttggcaggcctggaa

SEQ ID NO: 19143 - DNA, 733 bp, Homo sapiens
tcaggtaatgcccttccttcaatgcaggatggagactgagaaagcaagatgttggctaccagaaatggagtttcaaaaattttcttaaaagctctattggacaataaaaacatataatgctatctgccaaattaaaaaaacagaagctctgtgcccgtatatcagtaagtagataaaatcaatgctgaactgtccaaatcagtaaaacattttcaaaagtcatcaatattttggatctgagcatttaaatgttttatatgagacttggaagaaatagcaaaggacttcatacattccaagggaataaccatccaggttaactgctgacttttcttccaagtgaaaacaagtatacttattaataaaaaccttaataaaagctgagcatacaatctattatagtaaagaatttgtataaatatggaacaagcacgctatgtttaggtttggagaagaaattgttaatttgttaatttgttaattgttctgtatatctttgacaagtctatattcttgaatattagattattttacaaaagcttaacatgttacaggggctggtacaaggaatatatatatatatatatattttctagtacttttctagattttcttttctggttactgttttctgaagaccttccttgccttcagtttttaaaagatactgagaaattttaagtagcagtttaaaaatattaaaatggactcttaagggaaaaaaaaaaaaaaa

SEQ ID NO: 19144 - DNA, 721 bp, Homo sapiens
atgttcaatctgatgaagaaaagagaaagaaaagggaaaaaatagaaaaacaaattgctacatccgggcccccaccagaaggtggacttaggtggacagtttcataaagcataacatgagtagaagaatctactgccaataactgtttattatctgctacttagtgggcttcataaatttaattacttctctttgattttttgaagattgaaactttgggatattattgcccttatgggcaatgctcaaaaaccgtttcttcccatgcttgtacaatggatacactttcgtttccgtggtggtcgtcgttcgtcccctttcagacatagcagctcgcgtcccttggtttgtttccgctttaccttcctatttttaacctagtcttatccctcattttttttttcttgttttctaactttaacgtgctccgttctcgtttttcgtttatatctatggttttttggttctttccttttgttttgttttttgcttctcctcttctcccctacttttgtccctttctattcccctccgttcgtgcggtcctatgttttctgtattccgtctctttacacatctctcatctagcacaaccccgctcatctgtgccgagccccaatacaatcacctccccctccccgcgttttctttgtcctcccctatccattctttcttccctccaccgtgctttttctccgtattacaattacacacgaacaag

SEQ ID NO: 19145 - DNA, 785 bp, Homo sapiens
taggtctctggaagatgctgtgggtgccctgctcagacccctgtggctggtgccctgtcctccagctgcagcaagggctggatgataacggcctgcactgtcccatccttgcttgctgtggatggataagagctcctgtacacaaagaggccgagggattatgcctggcgggtcctccaccccaccccaggggccactgaaaccaaaggctgacagaggtggggacaggcaggtataattggagggtgcagttaatactccaaaacccaccctgggagcagccccaggctagacttctcctgaacctttacttttgctttgctttcctctgcccttactgcctcgcatgattttctggaacattccctcaataaatcacttgcacaagaatttttaccttagatgctgcttctagggaacctgaccacagacagatattctcttgcaactgcatatatcaatcttggatacccaaaacactacattgcagacatcaacagcagcctataccttctgacaggggagcatggcagactggacaccaagagcgagcaaaggccaggccccatactgccacgcctcactctggtaggccggacacagcaacacgggtgggggtaccacgcccatggggtttgtccggaccctgtcagtggaggggaagatccctggctgccctttccctacccccggttggtcatgtgagaaggagtagtgagtgcattataacaggaagctaccttggccaaaacaacatcacgggtttggaccaaaatttagagtct

SEQ ID NO: 19146 - DNA, 704 bp, Homo sapiens
tagtgaatactctctgtgggcctactatgtgccaggcattatgcaccagacgaaaacatatcttcttgagtaagccagtgctaagtcactgttcttgttcatatttggatcccttcccttttcaggttggttcattaacggaaatattaacagcaacttatacgtacttctccacttgttgctccaagagatttacagcctctttttctgtcttcagatactactttgaaaacaagatgaaagccatggaatctcccgagaaaaatgtacatcttacagactttcagtgagttctggaataccaggaaccagagcccacactaatgaacagcagtttcctaacctaatgcgagagatttgagatttcttctggctcccatgatcttctaattgtcttcttagcaagactaaacacatctccaagaaatgtgcactgccatgaatgtcttccagctatcttctatgacagcacttcccagtgtgttctgtggaataatggtacagggtgatattctatgaagaaaaatacggaaagtaatatactccacagtccgtatattagatcggactaataaaaataaatatggaaagtaatatattccacagtcatatattagatcgcctacacaacagcaatttgatatagtttaataggatttgaatgaataaaattaatgcccacagctaaaaaaaaaaaaaaaaaa

SEQ ID NO: 19147 - DNA, 745 bp, Homo sapiens
tttttttttttttttttttttttttttttttttttttttttttttttttttttttttttttttttttttttttttttttttttttttttttttttgggaaaaaccccccggggggtttcccggggaaaggggtttttttaaaaaaaaaaacccccttttttaaaaaaatggaccccccttgggccccccaaaaggggggttttttttttacccttttttacccccccctttggcccaatcccaaaaaactttttcccaggggggtttggccccctggaaaaaacccacccaaaggctttagggggggggggggggcccccccccggaacccccccccttttgggggggggggggaaaggggccctttgggggcgggggtttgaacccccccggggcacaaaaggggaccccccccccccttaaggggggggttttacccagccccggggtttgttttgccccgggaccttatcgccgagacctgggacaaaaaaaaacgggcccggtaaagggggggaaaaccaagtgggccccaaaaaaagttttggggggggccctttgggcccaaaaaacccgggggttcccccgcgggttattccccaagggccccaaaaaaaatttgggggggttttaagcacggggtcaaggccccttaaccccacaccgagagggggttcacgggccttttaaagccgcaaaaaaaaaacccccgggtttccgcccttttacaattttgggccccggg

SEQ ID NO: 19148 - DNA, 622 bp, Homo sapiens
atcagaggaagaggaagggtggtgtatcttcatgaaactactaacccaaacccagaacacagccatctcgctactaaagcacccaggaattgtagttttctgtgcaacagagattggggagctaaggctgaggattcagggtgaataacaagtctggtgcttgtctgcaggacagccagctgacttttgaagttgattcctccaacatgatgaagcgtatgtagctcaggaaaaacggcagctggccttaaatcatatagcgtaagcaaagggctcttccctggactatgtctcatttactatttgaataaacaaaattcaacaacctgaacaataaataaaataataagggaatctgctggatccactgaaaagtaatgcttacttattcaaatttattatgccccatttccccatgcattacatttaaacctctgattttttaaaagaataacatcattattgaaaactaatgttatgctccacagctctattacatgaactgttcttaactggattatggcttctgctgagttctgggaaagactcggattgcatgcccttcttcttcaggttcaccaagactattattaaagaattcccttcctcaaaaaaaaaaaaa

SEQ ID NO: 19149 - DNA, 974 bp, Homo sapiens
tccagtgctacagggtccttcctcttgttcctgtgttcttattccacagtgagaaacctagaaagaaagagaatgagaaacatgaagaaggagtaatttgttgtctaccccaacattccttccttgacaccagtacttatttcccaatagaaaggctggaaatggccaacactgcttttccaggcgtccctgcagaaaggcatgcatgtgtgacttaatcatggccagtgagacgagaacatatgtcttcagagagccttctgggacagattttcctcctggttctgggtatgaagcttgctcagttcagtgcctgtgggattcactgataagatgaaatacactgatccacagcttgtctgagatgaatgcatgtgctgtgtgatcctgaagttctttatgtctgttggcttttcatagtacatctgctggaaagaagagcctttttggacatttgtaagccctttgtgatgggaggggagtaagtctgtaagtatgtgtgaaaaggggctgctgtaatgtaaagccaactcaccaaacatgggctttgcagtaataaggatgggaagctaaagatcagacctcatggaaaagaatttccccctttctttgacttggcctataaatgtagcttttctgactcttttgaggccctgttgcttgtcttgtattcagcacctaataatgttgttgcaaatgtcaggactgcaacaagctcagttgtgttgtagcaagtaggagactgctacaaaatgggaagagtcactaatagttttggcaacaaaacatgacaatgtgcatattaccagaggcaattatgtgcatctcatggggattcaatagactctgggactgactttaatgacctgaaaatccacttgcccttttcgttttctctgttatgtccaagtaatgaaaatattgagaaagttattgtaactataaaattgcagcatagttccttttttaaaaaa

SEQ ID NO: 19150 - DNA, 579 bp, Homo sapiens
cccaccatttggcaagtcctaagttcttgtcctgcatccaggaagaatgaggtatgcggacaactggagggtgaacaaggtggaaaggagctttattgagtgacagaacagctcttgggagacccaaagtgggtggctcctatctgcaggcaggtcatcccagtgaatgtccagctcccagtggagaggagacccagagtgggcagctcctattcgcagagtcatgtggaagcaccaggatcccattcctaccactgaaattaaacaaatgaaaaaaaattagcatgaaattctttgtgcgtggacagtgacctgagaagacaataagacatttcaaagcattgagttaaggataatgaagtttataaaatctagtggcaagatatagctgactcttgacacagacagaggaaaggccatgtgagacacagcaagaaagtgaccatctgcaagccaggaaggagacgttttttggttttggttcctcaccaggaaccaaattaaatgccaccttgatcttggacttccaagcctccagaactgtgagaaataaatgtatgttgctgaaaaaaaaaaaaa

SEQ ID NO: 19151 - DNA, 647 bp, Homo sapiens
ccccccaccccccccccaaataaaccaagggggggggaccccataaaaaaaaaaaaacccggcccccccccaaaaagggggaatttttaaaaaggggggggggaaaaaactaaggccgggaaaaaaaaaaaagtcgaaaggaaaaaaaccccaaggggccccaaaaactccaaaattttgtaaatcccccccccgggaaagggcccaaccccccccctctcaggggaagaaaaaaaaccccccaaaagcggtctaaaagcccccccacttttggtcttttcacgggggggggggaaaaaaaaaaaaaaccccgtgtggtggggaacacccgttttcgcgggctggaaaacattccttaaaaaaaaacacgcgaaactccgcccccccctaggggggccaacaccccccccacaggctggggtgcccccggacccaaagaaaacctgggaaaaaaaacaagcctacacaaaagggggaaaaacgaaccgcccaaaaaacccccctgggggggcgccccgggccaaaaaaaccgtgggtaccccaccagaaacccccgggggcggggaaaaaaactggagccatcaacaaccctgcaaaaggccctaaaccccccccccaaggggataacggccgccaaaaaacaaaag

SEQ ID NO: 19152 - DNA, 845 bp, Homo sapiens
ctggaaggactagagatggaatttatgctggcaaaccagttactcttcaacagggcttaatcaaggttatattaaaggtgcagaagtcattttaaactatggacgactccgaggaacattgagtgataagatctactggcgtcacctttataataataattaatctttgatcaataaaattaacattacttattggatgaacgtatgaccacgcgtcaacagcatgcagtcgaatcttcttccccccacttcctatctcagtgcttctattgcaccccgcaccaccccctcatccacgcccgccgccccgccccaccaaggattcgcttctctgccaaccatcgcgtcgcctaccaaaatttcaaataaaagttccccacacgccccctctccctcgacgtagccaacacattgtcttgcgccaccacgcccaaccacacatccgaacaacccgcccgcccccaaaccaacaattaatttaaatttaaattatcaccccttcaccctccaccctcccctctcttctccccccccccacttacacatcctcccccgcacgatccacacacgatccccgacctctttctcgttttctcaccccttctgtgcctccgcctcccgacttctctctccctcacgctcccactttgcgctagtccaccggctccttacaacgcgcgcacccaccccaactatccacacccgcccccgcacatcacactcatccacaggcctctcatcttatgcacacagccagactcattagcgtcggatagttctgttcgcgccagcacgaggtgtcgacggacgcaccacagaccactgcactcacacacctattacca

SEQ ID NO: 19153 - DNA, 158 bp, Homo sapiens
ctagggttcggagacattgattaaggaagcattttcctgattgatgaaaaaaataactcagttatggccatctacccctgctagaaggttacagtgtattatgtagcatgcaatgtgttatgtagtgcttaataaaaataaaatgaaaaaaaaaaaaa

SEQ ID NO: 19154 - DNA, 883 bp, Homo sapiens
cttatcagtgtccagagcatcatagctcttggagaaaaaggcacataccaatctaccacagaacgtttttaccgacttaccaacgatgctcacgcccaggcccaggccagatttcttctggagcatgcacagggaaaatctccaagttctccttatccaggtagtgtgtttcatgtctatacagcaacagacgaagcttctggggggtatgtgtttggaaggctgaggtgggcagatcacttaaggggaacagatggagaccagcctgggcaacatggtgaaaccctgcctttaccattgacctcaaagcggctgaaatttccccttgcaaatttcacaaaaaagagtgtttaaaagactgatctgtgttgtatcttctcgaccttgctatgaggaaaaatgatgaacataagacttgaacgagcatttaatacaagaaccatatcccaatggccaataaacataagataaggcatctaacttcactgggtatcagcaagaatgactaacattacatagattgacagtaacacatgttgatgaagatgtggagcaactggaactctcatactctgccagcgagtatgaaaattggtatagccactttggaaaactgttttctagtatctactaaagttgaacatatataaaacctatggcccagaacaaataggtctatccacaaaagatatgcatgtgtacattcactgaaaaacaaatacaagaatattcattacagcattatatgtaagggagaaaaactggaaaaatgaaagtggaaaccaagagtacagtggatagaagacttgaggtgtgtttacataattaaatgctaatatcagagcaataaaaatgaatgaataattgcaaaaaaaaaaaaaaa

SEQ ID NO: 19155 - DNA, 463 bp, Homo sapiens
  misc_feature (1)...(463): n = A,T,C or G
ttttaagtgaccagctaaaattttattcctgtggacaaaaggaagaacatagtggaaaacaactaacaatctgtcacaaaagcctttatcaaaaatgagggatgtaagtttcaatgtgagtatttctgaatagtttttttcaaatgcagccaagtcagtaatactctgttgtaactttagatagggtatctatgaattaaaaatccctgaatgtgacattactctaaaatcttgcatcttgaactggagagcactgttgttttctggtaggaggtccatgaagcaggcattagaggtagcttcttttccttggagatgcagaaatcattgaacttcttattttatctggtatgggaaccttttctttaacctgcagtccagaattcttnaaaaaccaagtatttggacatgatgcaactctaaagatttggggatgagagggattaatttttggcgtgccccc

SEQ ID NO: 19156 - DNA, 705 bp, Homo sapiens
  misc_feature (1)...(705): n = A,T,C or G
tatcctancnccgtcaggtgcccgccaaaattatacctctcatccacaaatcttagagttgcatcatgtacaaatacttggtttctgaagaattctggactgcaagttaaagaagatgaggaagttgaggctcagagagcaaataaacttcaaaagatcatggaggtgctaagagaggttaccataccagataaaataagaagttcaatgatttctgcatctccaaggaaaagaagctacctctaatgcctgcttcatggacctcctaccagaaaacaacagtgctctccagttcaagatgcaagattttagagtaatgtcacattcagggatttttaattcatagataccctatctaaagttacaacagagtattactgacttggctgcatttgaaaaaaactattcagaaatactcacattgaaacttacatccctcatttttgataaaggcttttgtgacagattgttagttgttttccactatgttcttccttttgtccacaggaataaaattttagctggtcacttagcccccagtgagagaatacattcctggcctccttgaagttgttgcttggtgtggaccaatggtatgtgagtggaaattaataatgggcacaacttccaggtcatcttcaacttaaaagacaactactctaggctgggcacagtggctcacgccctgtaatnccagcacttttg

SEQ ID NO: 19157 - DNA, 786 bp, Homo sapiens
cctactccagggtttcctgaggataccaccatccaccttcatccacctcaggcgtgtcctgcagatccctctggagaaccagcttcaggttctgctaattttgatgctgcctaacgaaacccatgaagaagtaaatgatggggttggcactgctgttaagagacgccaggaaaatggaaggcagatgaacatgagaatataagacttcccagtccatgtggatcctggaaaacagggcccactgaatgccaatgggcaggccgcagaggaggaagaccagcactgtgagcagatggtcatgtacagcctggtcagtggcatcttctgggatccacagaggatcctgaccactaggaccaggctgggcacacagaggaccacaaataaaaaaatcagccacgtaactgtgatgaatctgatgtttgacaccaaacagaatcagcatcactaaacagggagtcacagaacatccactccaggatgctctacagcagggacagggcccagagcaggacacacacgaccgttggcaggtgtggggtggcggcagcgttaccagatgggccacaggattgacaggcagcgcttggtgctcatggcactcagaatattcaggcctgccaagtagggaaaggtcatcacaggctaaaggattagagagatgggatggacgttattgatgaggcgtaacagggatggatactgtggctggtgaagaagaggaagtcgcccccccccagctgcagatcgagatgaccacgccgtccgcccaccggcccccccgaa

SEQ ID NO: 19158 - DNA, 731 bp, Homo sapiens
tttttttttttttttctttttgaggcggagtctcactctgtcatctatgctggagtgcaatggtgcgatcttggctcactgcaacttccgcctcccaggttcaaagtatatttttgcctcagcctcctgagtagctgggattacaggtgcccaccaccacgcccagataatttttgtattttttttagtggagacagggtttcaccatgttggccaggctgctcttgaactcctgacctcgtgatccccccgcctcggcctcccaaagtgctgggattacaggcgtgagctaccatgcccggtgactcttttcagtccaaagagtcatcattgtcactagaccacctttgaacatggacagcaacagcactatctaatattaactttccctgaatcaataccctcgtttgacaaattataatttaacaaaaatatgtttatgtgtagaaaaaagactagaaggatgcagtgtctccgtgggtgagaaacacgtgatttctgttttattctcactcacttatattttctaaatttcctactgaaaatgttaatgaattatttaggtaatgagaacacaatcttaatcatgtttaattggttcataaggaacgacagagcttggcagcttcttgcagggtgctttctgccatccccagctgagacaccagtggggctcgggagctgccctccaatgacagctggtgatgacggggacactgccagctcccttt

SEQ ID NO: 19159 - DNA, 268 bp, Homo sapiens
aaggcctggaatgcagtggcatgatcacaacacactacagcctcagtcccccgggttcaagcaatcctcccaccttggcctcctgagcagctggggctacaggagcacaaaggaaaggccatgcgaggacacagggagaagacaggcccctaccaatcaggaagggagccctcaccagaaactgagctggccagcacaatggtcttggacttgtagctccagaactgtgaggaataaatttctgttgttgaagccaaaaaaaaaaaaa

SEQ ID NO: 19160 - DNA, 829 bp, Homo sapiens
  misc_feature (1)...(829): n = A,T,C or G
tgccttttcgagcaagaactggcccatgctgtgaatgcctgctcccatgccctgaataaagccaacccatggtgcccggaggtgaggatttaatgagtcttacaagagacactgccactgaaatagccatcaatgtgaaggcgctgtataatgaaacagaatctttgctagttggcagggttcctttgaaaagtgccacttttggggcatcctttgctctgagaagagaagctgaaaggctgcatgaaagccatcgctcttacctacctccgccaagaaaagcttttagaagctgatttcagaattgaccagctaaacacgcgctggccttgagataagcaatattaaacaattgcagctcatccaccagcagagctgactaactgaggccccctgctccacaagccagaactacagctttgattgaataaaagactggtttcagtatttttctcctgctaagagaccacccacagatcgactagttccagccgagttacagatgctgtgcatttgagtgccttcctttccctgcttcaccttttgacatatagggcttacctgtaatatatttcaatgttaagtctccacctaagggaagcatgagatgcatgtaacatgcatgtttattcagtatgcatgccatgttcccccttcatgaatatctggacgaaagactgcatagctcctcccgtaacctgttgaatatatacatatantttggccaacctgttcaacaaaacgtatgtctcatccttccctccttcgaanaccccgctgacagagcttctcacagaagctacacttctcagcctgtcagaatgggcac

SEQ ID NO: 19161 - DNA, 763 bp, Homo sapiens
tcagctccacggatttcctcaggaagctgccctccaccttcatccacctcagacgcgtcctgcagagccctctggagaaccagcttcaggttctgcctattttgacgctgcctaaaggagcccacgaagaagtaaatgatggggttggcactgctgttaagagcggacaggaaaatagaaactagatgaacatgacaaaataagacttccctgtccacgtggatccataaaaataggaaaaactgaatgccaaagggcaggccacagaggaggaagaccagtactgtgagcaggatggtcacgtacagcctggtcagcggtatcttccgggatccacagagaatcctgatcagcaggaccgggctggacccacagagaaccacacataaaaaaatcagccacgcgactgtgatgaaatctgatgtttgacaccaagcagaatcagcaccactgaacaggaagccacataacatccactccaggatgctccgcagcagggacagggcccagagcaggacacacaccaccgctgacaggtgtgtggggcggtggcagcggtaccagatgggccacaggacggacaggcagcgctcggtgctcacggcactcagaaagctcaggcctgcaaagtaggaaaacatcatcacaggatagaggattttagagatggtatggggggatactgatgaaagctaacagggaatatataaggcggcccgctgaggacgaggaagtctgctgcggccatgttgaggatgtagat

SEQ ID NO: 19162 - DNA, 1317 bp, Homo sapiens
cttggatatgtgacgcagctacaattcactgtcttttggagcaagaactggcccatgctgtgaatgcctgctcccatgccctgaataaagccaacccaaggtgcccggagagtcatacaagagacactgccactgaaatagccatcaatgtgaaggcgctgtataatgaaacagaatctttgctagttggcagggttcctttgaaaagtgccacctttggggcatcctttgctctgagaagagaagctgaaaggctgcatgaaagccatcgctcttacctacctccgccaagaaaagcttttagaagttgatttcagaattgaccagcagctaaacacgcgctggccttgagataagcaatattaaacaattgcagctcatccaccagcagagctgactaactgaggccccctgctccacaagccagaactacagctttgattgaataaaagactggtttcagtatttttctcctgctaagagaccacccacagatcgactagttccagccgagttacagatgctgtgcatttgagtgccttcctttccctgcttcaccttttgacatatagggcttacttgtaatatatttcaatgttaagtctccacctaagggaagcatgagatgcatgtaacatgcatgtttattcaatatgcatgccgtgttccccctttatgaatatctggacgaaagactgcatagctcctcccgtaacctgttgaatatatacatatatttggccaacctgttcaacaaaacgtatgtctcatccttccctccctcgaagtacccgctgacagaggcttctcacagaagctacacttctcagcctgtcagaatggccacattgtaggctgcgagtctttatagcaaacaaagtctcctttctaaatttgtgatttttaagctgataccatagaattcatctttcaaatcaggacacttttaagagtgaaatgaagtgctaaaaatcctggtatcttttttcaaaaatttactaactgacaaatacatttttattttttgatggatctgccaaataattattttgaaacactatttcaaaaatattttttctagaaagtagaataacatatatctgtgtacaccaaagaaaacttttaaaacttctttacatatataaaaagtagaaattttataataatataatcagaataattacccctttagtcattttttgaaaacacatttgtctcaaataccatgtcattctatttttctaaagaatgttttcttttccttatatggtcttgctatgttaaaattttgaataaaattgtcccaatattttcttc

SEQ ID NO: 19163 - DNA, 260 bp, Homo sapiens
atatggggtctcactatgttgtccatgctgatctcaaactcctgggctcaagcaatcttcccacctcagcctcccaaagtgctgggattgcaggagcacaaaggaaaggccatgcgaggacacagggagaagacaggcccctaccagtcaggaagggagccctcaccagaaactgagctggccagcacaatggtcttggacttgtagctccagaactgtgaggaaataaatttctgttgttgaagccaaaaaaaaaaaaa

SEQ ID NO: 19164 - DNA, 308 bp, Homo sapiens
ttttttttttttttttgaagaaaaataacatattttaatgttgaaacaaatagagagaagtaagggattgaagagatattttaaagagaaaactgaaggtgttaaaaatgtgcatctgataccataaatccaggctactcttccagacaccaggctcacatgttcaatttcttctggcatgaaaaattccagtggaaaaagtcaaagaagctcttatctcttcgctgaagcagtcatgctagggtaacagtcttttggcaccatgactgtgagatctggttcttgttctccgctatctctgcgacttt

SEQ ID NO: 19165 - DNA, 676 bp, Homo sapiens
tagagttcgtatgctgatatattaaatgccattgccacaaaatgtgactgtatttgaggataaagcctttaggatggtgattaagctataaagacatctttaaggtgggtcctcatccatgacgatttttattcttatatgaagaaatcgggacacagaaaggcacaaagggatgacctttgaagacagagggagaagacaggtgtctacaagccaaagagaaagacctgaggagataccaaacctgctatcactttgatctccgccttccagcctccagaactgtgagaagataactcttgttatttaagccacctagtctgtggcacattgttatggcagccctaaggaatgcatacaacttccaacaaacacacctacacacgtgctacctgattctctgattctacctttaaaatatatctagaatcatccaaattttccatccctaccgcctttaatttctgtgaaccacaccacttacctcttactacaagagtctcctcctgacaatcatgtctccaatataccccttctgagccattcccaacacggcatcatgagtgatttattttaacacaaattttgtccttggccttggctgttgaaaatcgtttgatagcttccaattgctcctagaataaagttacacaaaatgctcggaaaaaaaaaaaaa

SEQ ID NO: 19166 - DNA, 645 bp, Homo sapiens
cctagacgaaacacctaggtttctcataattccctggtgccaagacaaagctgcaaagaacctccaggtcaacctttggaagaggctcccaggggagagttgccgggtcatagggctacacattcttgatgtcactaagtgctgccagattgttctccagatttgtgggcttatatttcttaagtattttggcagaattcacattaagttgaaattttgattttgtgccaacattcaggggcatgttagagtaactttataactgtgtgaaaaattaaagaaaaatatctaatgtttaaagtgcttttatatgcaattctttttagattatttaactgaaaaacagcatttctgagcaatagtgcatacagtatgtagttttattcatatctattaatgtgggtcagattttaggaaaatactttaagtaaaattctactctctatatcattggaataaaggtttatatattgtatagcatgattaatagaataatcagacattttattatgtatattttacatttacaaatgctgtaccatgaattatgtttgccctagagaagacctgccatttactaaacacttcctatgtgtccaagaaataagcacaattttattattcttcacaaaaaaaaaaaaaaaa

SEQ ID NO: 19167 - DNA, 307 bp, Homo sapiens
cttcaggataccttacaatctccagttacaacctgcttagcttgctactcagtacgtgaattaggatgcaggcaacacacctcagaaggcaggaagaaaaaaggcacagctgataatcaagtcgttagagtcaaccatcattactaaagccaactctccacccagcgcatctaagcctgtgcctcttcttgccaccctagcatctcctaagccagatacagcaaatgaatgccggaagctcactatcagaatattccaagacctttccataataaaaaataagtatttttttttaaaaaaaaaaaaa

SEQ ID NO: 19168 - DNA, 522 bp, Homo sapiens
attatgtatgagcttgatttcagagttagaatggcaatttcacttaaaattaactcattaaaaagtataaatatcatggtatagatatgttattcaaaactccaaaatgtagtgaaactggtaacagatgttgctactcatctttgtgcagacacatcaacagtattgatgaaactggttttcagacaagatgtatcacttgttcccttgctttagggaggagagggtgttataacacaggcattattgatacagtgacttcctggatagttgctccttattaacactgttaaaattaagtgtccatgttttactttgtgtgggagttggtgactcttgtccttttgttttttgagggatttctttcaaggtgtgggcatcaaacccactcattccaaaatgcatcacaggggggaatttaagcctcttcacaaagcaaaccactggaaattcataggtagtatgcaaccttggtttgtaactgatctctgataatatggcgtcatcatttgtttggaacat

SEQ ID NO: 19169 - DNA, 751 bp, Homo sapiens
cttccgggaccagacaaacccaaggctcgagtaatcgctccacttataggcgccagattttatttcaccctaatggcaaaatggtcaataaaagcttccgagtctcttgctcttgctctccctgctcctctctcaccgggcagagaagtttattaccttaaggttgttcttgaacaaaagaggctgcacatattggatggctaagacagaaagatctcaccagtctggccttccgaagctgaaacaggctcacacagttgggaagaagaagaaccaagatataaactcagatttttttcttttttttttttttgagacagagtctcactcttgttgcccaggctggagtgcaatggtgtgatctcggctggagtgcaatggcgtgatctgagcatctcccgcgctcaaacgcttctcctgcctcagcctcctgagtagctgtgttataggcatgtgccaccacacctggctaattttttttttttgtatttatagtagagacggggtttcaccatgctggccaggctggtcccgaactcctgaccttaggtgattcccccgcctctgcctctcaaagtgctgggattacaggcgtgagccaccgtgcccagccaaaactcaggtatttttaagctccaaatccagttttttttccttttgttttggctacaccatgctacacattttatctaatgtatgttatggtcctaactataaagtcaagatgaataatgaaataaaaaaaaaaaaa

SEQ ID NO: 19170 - DNA, 588 bp, Homo sapiens
accccgctacagagaggaccattgttgggggagccagaagaccgagagagtagccagtgacagagctccacgtgtctgtgaattggctcatctcctccagcaagaaagatggaatctgagctcagaagagtatgcatgctcaggaaaccagccagcaatcctcccagacggtatcaagaaactgaaatttaccagatccccacatctggaaagtgagaagccagacccctcacccatcatgattccccaggtgaccacctgctgcctgttggccaactcctcttccctgccccttctgtgtttatgaagccccagtatctgcttcataaacaccagatgtgcatgtggggggcatctgtctcccacctgagcagaggctcccagtgcccactggggtgagtgagctgcaacgtcttctcagggaggtgaacaaggtgaaatgctgtaacactgactgttggaatctgggagaaagactgaaagaggcagtggtttcccctgtgtctgaatgagtgctcaattattccttgtggcagcatcccgcggatgatcagttgttgcttgcgggctttgttatttcaagtcaat

SEQ ID NO: 19171 - DNA, 944 bp, Homo sapiens
ctagagacacaaagatttgctgatagatcactgttggaaatggaaaaaagggtaagtgtcccacttattaattaattatttgtttctttcttgttttaggtaaacaatggtaggttttttgtttttattttgttattatggatgacagttttaattagtttagatatttattgagttaatgtattttgcagcaacttctttatagaattctacggggtttctctaggtacgaaatgaccttgttaaataaaatttaatttaccacataattcttttaatgaatttaaaaaaactgtcttgccttgattctgaaatgtactatacacattttgatagtgaatttgatatttttgaaatgccgtttatctcttatggcctgtacctaaaacgttttaatcataaatacatttattttaattctttataaacctaaaatactttcgttcttgaaataaagtttctaaatctggaacatcaaattttcaaattctttttaaagttaatttaataatttttaaaattttgagtttaaatatttaacttaagtgggctattttaaacaaaaaaaagattccaagaaaatccttatgccacttgatgtctttctgcaagtttttattgattgtaatacattcacttgtatttctcttcacttattgttgctcaaaggtctaggagtagtcataggaataactgtacaagtttagcctcatcagttgaaaatgtataaatgatccaaaagttaaaggaaaagagcccaaagattgtttgtagtgtagctgagcagtagctagacttggtagggcttcgaccagagaagaaatgacatgctggtagctatgatcaaggggtaaatacttaggagctattgatataaagacatttttcttccattctattttaaaataaccaatttgcccttttcaccaaaaaaaaaaaaaaaa

SEQ ID NO: 19172 - DNA, 768 bp, Homo sapiens
  misc_feature (1)...(768): n = A,T,C or G
tttttttttttttacgtatgcaaagatattttattcagggagtgaaagaaaagtgacaattgcacaggtgttagaagcccatgcccaggtgacagacagacacagaaaacatcaacagcattttttgatggttcccagggacagagctgctggtccttcttccaaagctctgggaactgacactgttgaggacttactttatcagcgtccacctgaacagtggcaatatggcaaccttataaaggaaaccttttgctattatggatcatcatgggcagatcactcgataagacgaaataatctcactgtgtattccatggtatgctttgatgatataatgcaagtgatgctgctgaacaagcagagacacatatacttataattttatgcttcctgatgaactcctaaggtgtcactngcctttgggaaggacactctggcttgatatgctcgtgaaaggtgttacatgtcgacatttctgaatcccattgacgagcgcggacacgcctgtttacactttctctggttggccatcgctctgcttcttcttgagtggataagtctattggtcatatatgatccaaagagaaacatgaagtagctgtgacaatcttccctcatccccacatcccgataggataaatctttttgagttctatcaaataatatccatacgtcaaatacacatattcactaatatgccttatttctaatatgtatattattctctaatcctgaagttaaaaatagctcgcaccatggacaggg

SEQ ID NO: 19173 - DNA, 132 bp, Homo sapiens
cttcaggaagaggaaaatgatgaatagtagaagctccgcctgtgaagatgattttacctgcagctgaaataccatgacccagatattgaacacacagaataattaaacttttcgtctagaaaaaaaaaaaaa

SEQ ID NO: 19174 - DNA, 357 bp, Homo sapiens
agaagcgtttggtgttggtgtagaattcattgatcaggaactgtccaggtttattgctgccgggagactacactgcaaaatagataaagtgaatgaaatagtagaaaccaacagacctgatagcaagaactggcagtaccaagaaactatcaagaaaggagatctgctactaaacagagttcaaaaactttccagagtaattaatatgtaaagccatgtaactaacaaaggatttgctttagagataattatttggaatttttatagcttacttcacaatgtgcccaggtcagctgtataaaataaatactgcattgttgtttcaaaaaaaaaaaatttttggcctcgttggcctca

SEQ ID NO: 19175 - DNA, 815 bp, Homo sapiens
aataactttcctttggttgcattgtaactcctggactggaacactcgtgatcgtctttggctcctgtggctgcatttaattgcagtgatcttcctgaactgatcaatggtgacagtagacagatgtcctgagactccttatttcccaggatgaactgtcatggtggacaggctctccattgttcatagaatctggtttggataccagaagcacaggtctaaaatagaattctgaactttccattatcatgaaactaatgccatagaataaattggcaaatctggttcctaaacttacctagtttttctcactaattaatgtgacaattaagggagaagaggtaaaatggcaaaatggacataataatattgccatgcttgtcttagttactgcaagatcaaagggtccacaaatccattttgaaggatataaacgatcactgagatgctaggcacaactgtttattatacttgctttgtattatctaggtgtatgttctggaaacttctcatatcatatcctgcctaagtagaaattattgtagtttatgccatttgggtttcttaggtgaatacagttaaggtgtactttacggctctaggctatcccaggcagagggatatttaacactggtctctccagttttattgtcagatatacatttggcctggtatgcataatgttcatctcttggatttaataaccaggtaatcaagttatgccacttaattctttagcaaatgacaatctgagtacaaatcatttctaaattgtttctcacattaaattaatccaaaagtaaaaaaaaaaaaaaa

SEQ ID NO: 19176 - DNA, 519 bp, Homo sapiens
taggtttgcactcaagactgacatttaccgtaatggaagctgttcatatgcccccaggaaagaatgaacaatttaatagaaaatgctaaaggagtgatattaggaaaaaatcaataaatgttactgatgctatcgtcatcatcatcatcatcatcattatcatcatcatcaaggtcatgacagaaagaggacacattacatgaaatctcaacttcatccctgggccatacacacctgtagctaatttttgtatctttctatttgagttcgggtttcgcatcgttttgtcccacacaacagaagctgatctccaaagagaggaatgatgtagcctcaagtaacaaagacattgagggaagtctttcacatcctgggatgcctgtggcccagcacagagggctgttgggttgccaacacagagtttacccctcaggtgtctgtaattgggtaaagagaggtgaagtttagcatgtgatatgtagaacgggcagctacaaatacaattctaaaacaagaaaa

SEQ ID NO: 19177 - DNA, 783 bp, Homo sapiens
cctggtccatcctgctggtaacttcgttctgcacattttctatgtgtgtaaggagattgagctgccactgaagatatgaagttgatattaaatcacagaggactgcacttactcggatttttcatcaactgctaacctactaacgttgctcattaagcaaggcaagctctagcactaggagcagattcaaaagagtaagacagcgttctgaggaactggtgcaggaagagctcctccacaccttcagcgttcctgcccacccaggagaagaaacaccattaaggacatgtcatgggaccaattcaccacatgcctattatttgagaaaacctagttatttcctgcctggaggctgaagttaaattcaatatgcagaatatgctatctgaagatcctctagcatagaagaaggcaccaagtagacagcatggtggattgagagacaaaaggcatagatttcatctcagtctgcctcatcagtaaaataaaggcatcacaggtagtgttctaagaccccacctgctctacaatgagtcgaatatgcagaactgccaggtcagtagcatgcaagttcataatgcagatctactccgattgccacaaataggcctagctagaaatggatgcagaggaacagaggctaattaattcttctccaggaaaaagtcacacctcttcccttccagtaggatagtaattttgttgataaatatatgctaatgtatttgtctaagtaatcaatgtggaaaataaaaatgtaacagtgaaaaaaaaaaaaaaaaa

SEQ ID NO: 19178 - DNA, 284 bp, Homo sapiens
actctgtataaacactacattcggggttcctcttccccaccgaagaaagcaaatcatatcatgcaacatttgccagttgagatttaattctgatgtctgtgtggcatgtcgtaaaaggaacatggcggccaaggtatttggagatatggactaatcactttgggtcataattaaacaattgcaggcttgaccacttaccagatgattattgtattagtcttctattgctgctaaaataaatcaccacaaactcagtggcctgaaacaacacaaaaaaaaaaaaa

SEQ ID NO: 19179 - DNA, 793 bp, Homo sapiens
ccttggggagcactctctgctcaacactaaggggatgacatcacgctctgtatctttttcttcgctcacctgactaggagttggctgatgccactgtggatcgggcgaatatgagcctatactattggagatccgcgcttcagaggaagagaaacctatacctaggtatattagaactagtatcgaagaatacgggaagaggccactgacatcgctatatagagaagagaccctacttttttgtagttgtctgactttgctgcatattagctaaacacatggtattgggcaaacgaagagggtgaacacatttagatactatctaggacatcgttacttgcgttttggtgggttcaactaatatggcggacgaagaaggtccttattcttgtggcaaagaccccgcctattctaaagtgggcttcaatcactgtttcctgattcatcctgggatgcgaaccatgcgaagtcagctaattggacctggatggcgctctctgtgacttcagtgaatacccctatttagagctgggtcatcatttgtcctggtgtagcaagatagtcttcagatgcatgttcccgtgccctgtggtggttggacaccaatgataatgattgctggatatgttgagcatctctgcataacagcgtttatgatacagcgtccgtgttttttatactggcactgtaatacttattccgtgccagcggtttgcgagggatttgtctacagggaaagcccttttggactgacttcacttaagatttatggtcaccctctctttcagaggat

SEQ ID NO: 19180 - DNA, 1045 bp, Homo sapiens
  misc_feature (1)...(1045): n = A,T,C or G
cttcagttgcaggacaagaactcatgacccatcaagtggcagggccaaaaaagctgtaacaccaacagggctgaaacatgccccctgcttgccacgttgaaggtgaagagaaggaggtaaactactgtcaaatcactgtaacttgaggagttttggtgtttcaccttgctgaacaggtgtatggaaagcccaagtcgtttggtaaacctctcaacttttgacaggccacaaactccaaactggatctcctgtggtaggcagtagaatatctaagagtcatcagtgtcctgagaagctaaacgtcctactaaggatcctgcaaagggaaaacagaagaggaacttgcactttttgagaacttgctgtgtgccataagcctaagtccctatgtgggaaggattctacccacacatgacagaggaggagactgaagcatganaaagaaatggcgttttgctggagaaagcagcatagcggaatgtaaacggtaaaagcgtggtatgctggagccacagacctagatgggaaagtctagctctggtacttgacagatcccattctccatcatctccaccctgttctgtgaaccagtaggctgctttgcttgaacgacatcaacaagcttcatgcatcatcatgtctagctgaactcaaccagtgggaagtaccagcaggagatcaaaagaaaggagcaaagtccactgtgggatggctgcttctcttgacccatggtttcagctcctgacagcattttggcatgctttggttgacttacaactgctgcacctgcatcctgtgcctgcaaacattttctggaaccttggaagtctcctttgcccacaactctaggagacaaaacatgtgctgggaaactaacatcctccacccatgagcagatctccaacaatggctctcaggagttggtgaatgaatacccagctccctcatccttgggtggtatcatgctaaggcacgtgttttcaacaactatgcacagagttttcctaggtaataaacactagtcacccaaaaaaaaaaaaaaaaa

SEQ ID NO: 19181 - DNA, 254 bp, Homo sapiens
ctcagacaccgtctcactctgttcccaggctggagtgcagtgatgcagtcctagctcacggcagccttggactcctgggctcaagcgatcctcctgcgttggcctcccaaagtactgggattacaggtgtgggccactacgcctggtgatttttactattttgaagacaatttttctaatagtttttagaaagaaaagcattaattttgtatactttttcaaatacatgagttatacttggaaaaaaaaaaaaa

SEQ ID NO: 19182 - DNA, 811 bp, Homo sapiens
ctcaggctactctagcagaatggtggtagaagtgatggtctgaagttctggagtgtaggccacaagagaccttgcagcttccaacttttgtctttctggaacattcctgataccatgtaaagaagcccaggaagccgaggcaggaggatcgagcgcaggagttcaagaccagcctgggcaacacagtgggatcctgtctctaattttaaaaaaatgtaaaccacaatgagatatcactgcacatacccaccagaatgactaaaactcaagactgacggtaacaagtgttgacaaagacatgaagaaatagcagctgtcatacattgttggtgagaacacaaagcggaacaaccactttggaaaacagttttgtagtctcttataaagctaactgtaatttttttccatagaacccaggcaatcaccttctagatattctcataaagaaaaataaccacactgacacaaagacttacctatgactattcagaccagcttctcttattacggcccttaaactggaaataccccacctggctatcaactgggagatcggaaacacacctggaatccattcataccccgaaatactcagaactaaaacccttatctcacatacccactatatgggcagacctgaaaagcctcatagttccacacaaaacagctgaccaaacatacggcaatggctgggtcaacgaaacgccctcaacggccattctctacacctcacaaacccacccgaaggaaacggaactttaaaaacattacctacagcggacgatgactggttccctcagccacaccatga

SEQ ID NO: 19183 - DNA, 851 bp, Homo sapiens
atgaaaaaattctgcgacacccatagacctctagaaaagaactctctacctcttcatgggaatatacttttgctgcaagaaaataaaatgttttctctttatctcttcatggcagacctaagtgtgagaaaaaggttgctggtgatttaccacaccacagcctgagtacacccaggcacgcatctttaaaacatgcccaaagatatctctgtgaaatgtattcagtagtggattccagtattcacagccttcatttacacagttcactttatttaatttgtacttactggtaatattaagtaatcagagttcatatccttgggaaaattctcccctgaaggccaattcattcgtaataaaaaccacattttgagcagtgagtgaatccagctggttgcactagtaagccattttcattttttatagcacatttcagctttccaagtattgcatatttgtatgggagaaatgttttctgaagtcaagcttaatgaaacatgaagtcaatgatatatgcaaacatctatttattcctctgctgtctgggaagttttgatcaagaaaacacttctgctcattagagaattgaccagatgcagtgctattaacatttctgtgatcaaataaagctcacccagatgaaagaagaattgcaacactaacagcctggaagcactcaaccgtggagatattacccccaaaagtgaagcatgctaagatacaaaacaaactgacttcaagcgcatctgattaacatggccattgttaactttcccactacttgggcagactttaaacctgcttatggataaacagtcatatgatgctggtaaaaaaaaaaaaaaaaaaaa

SEQ ID NO: 19184 - DNA, 1024 bp, Homo sapiens
gcgctcagggcaggatttatggtaacagatctttgtaccagttctcactggatcttcagattgaaggtgactgcatctcagtaataaagtggcaaaacttaagaaatcatgggaagaagctggtacctccttcagaccaaaataaaacgatgaagcccaaggagggaagtgctggaatcatggctaaagatatcagatggcaagtgtctatactctggtgcaaacagcattagagaaagcccaccattaagactccagaactcagtgaaacttgggagcacaaaccatgatcagcatgtttagactggtcactagaagaagggataacatccaaatgccaattcaatcatccctccagatcccgggatgaagggcacttttgcatgcagaaagaagcaaagcacaattccactgggtggtcaggcccagaggccaagatggctgcaaaaattgggcaggtttcccttctctcagttgccatcctatagagaggttaatgagccttctagttcttctcctgagtcagtcctgttttagggatgtgccctcaggatacctctcatgaagtcccttggtgtctgtacctctgaattaatgcccagataatattttctcgctggggaaggatctatcattgaaatccagggtaacattcaactgggagagtccgatagcttgatatttaaacccaagttggtctgattccagacctcttaataacctggctgagtgagggggacatatcaacaaataggaatacttcagtactagttgcaaatcagccataacataattatctgtgtgttttgggaagtcattttaacctctctgtgcctaaatttcctccattgtaaaggctggggatcaagtcaaataatttctaatggttcccttggctctaacgtttaattattttagcttacctggctctactcacgcaactatttctgtatttgtgcagcaatctatgtgtaatatctatttacagtcaaaatttattttataagtgatttcacattacaat

SEQ ID NO: 19185 - DNA, 867 bp, Homo sapiens
  misc_feature (1)...(867): n = A,T,C or G
cttccgagcaaagagtgtccaatctctacanacccacanatctaacanagtctctatattcctcctccgagacctcanagatccagaatggcagctggtccttgctgggctgttcctgtccatgtgcctggtaacggtgctggggaacctgctcatcatcctggccgtcagccctgactcccacctccacacccccatgtacttcttcctctccaacctgtccttgcctgacatcggtttcacctccaccacggtagccaagatgattgtggacatccaatctcacagcagagtcatctcctatgcaggctgcctgactcagatgtctccctttgccatttttggagtcatggaagagagacacgctcctgagtgtgatggcctctgaccgctttgtagccatctgtcaccctctatatcattcagccatcatgaacccgtgtttctgtggctttctagttttgttgtctttttttttttttttctgtcttttagatgcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttgggtttcttcccatctcgggttcccttttctcttactataaaattggttcctccattctgaggggttcatcatcaggggggaagaataggccttcttctcctgtgggtctcacctgttaattggttgctgattttatggaacaggccgcggaaggcacctcacctgaaatggttatttttcccccggaaagggtgcaggggcctattgatggacata

SEQ ID NO: 19186 - DNA, 583 bp, Homo sapiens
acaactgatgacctcaccgtactttacggcagctggtccttgctgggctgttcctgtcctgtgcctggtcacggtgctggggaacctgctcatcatcctggccgtcagtcctgactcccacctccacacccccatgtacttcttcctctccaacctatccttgcctgacatcggtttcacctccaccacggtccccaagatgattgtggacatccgatctcacagcagagtcatctcctatgcaggctgcctgactcagacgtctctctttgccatttttggaggcatggaagagagacatgctcctgagtgtgatggcctatgaccagtttgtagccatctgtcaccctctatatcattcagccgtcatgaacccttgtttctgtggctttctagttttgttgactttttttttttctcagtcttttagacgcccagctgcacaacttgattgccttacaaatgacctgcttcaaggatgtggaaattcctaatttcttctgtgacccttctccactcccccatcttgcatgttgtgacaccttcaccaataacataatcatgtatttcaaaaaaaaaaaaa

SEQ ID NO: 19187 - DNA, 403 bp, Homo sapiens
  misc_feature (1)...(403): n = A,T,C or G
acacctgggacctcacaccactttnacggcagctggtccttgctgggctgttcctgtccatgtgcctggtcacggtgctggggaacctgatcatcatcctggacgtcagccctgactcccacctccccacccccatgtacttcttccactccaacctgtccttgcctgacatcggtttcacctccaccacggtccccaagatgattgtggacatccaatctcacagcagagtcatcttctatgcaggctgcctgactcagatgtctctctttgccatttttggaggcatggaagagagacacgctcctgagtgtgatggcctatgaccggtttgtagccatctgtcaccctctatgtcattcagccagcatgaacccgtgtctctgtggcaaaaaaaaaaaaa

SEQ ID NO: 19188 - DNA, 830 bp, Homo sapiens
  misc_feature (1)...(830): n = A,T,C or G
agttgttttacgtcaccatagatcaactaaaaaaaccacagcttgtgtccactcaccaggaccctggatctcacaggtgtctcagaattccttctcctgggactctcagaggatccagaactgcagcctgtcctcgcttggctgtccttgtccatttacctggtcacagtgctggggaacccgctcatcatcctggctgtcagctctgactcccacctccacacccccatatacttcttcctcttcaacctgtccttggctgacattggtttcacctcggccatggttcccaagatgattgtggacatgcaatcgcatagcagagtcatctcttatgcgggctgcctgacatagatgtctttctttgtcctttttttttcaattattattatactttaagttctagggtacatgtgcacaacgtgcaggtttgttatatatgtatacatgtgccatgttggtgtgctgcacccattaactcgtcatttacattaggtgtatcttctaatgttatccctccctcctccccccagcccacaacaggccccagtgtgtgatgttccccatcctgtgtccaagtgttctcattgttcaattccaacctgtaagtgagaacatgcggtgtttggttttctgtccttgcaatagcttgctgagaatgatggtttccagcttcatccatgtccctacaaagtacatgaactcatccctttntatggctgcatagtattccatggaagacatgtctaatgtttaaaggttggaaataaggcaaataactcataaataaaacatgtcctgttctcttatcttgatacatataccttaat

SEQ ID NO: 19189 - DNA, 578 bp, Homo sapiens
agaacccagaggatccagaacggcagccggtcctcactgggctgttcctgtccatgtgcctggtcacagtgctggggaagctgctcatcatgttggccttcagccctgactcccacctccacacccacatgtacttcttcctctccaacctgtccttgcctgacatcggtttcacctccaccattgtccccaagatgattgtggacatccagtctcacagcagagtgatctcctatgcaggccgcctgactcagatgtctctctttgccatttttggaggcatggaagacagacatgctcctgagtgtgatggcctatgaccggtttgtagccatctgtcaccctctatatcattcagccatcatgaatccgtgtttctgtggcttcctacttttgttgtctttttttttttctcagtcctttagacacccagctgcacaacttgattgctttacaaatgacctgcttcaaggatgtggaaattcctaatttcttctgtgacccttctcaactcccccatcttgcatgttgtgacaccttcaccaataacattatcgtgtatttcaaaaaaaaaaaaa

SEQ ID NO: 19190 - DNA, 498 bp, Homo sapiens
ttcaggacacaaaagaaatcttggccaggtgtggtggctgaggcctggaatcccagcatcttggaagacagagattggcggatcagctgagaagctcagaggatccagaacagcagcctgtcctcgctgggctgttcctgtccatgtgcctggtcacggtgctggggaacctgctcatcatcctggccgtcagccctgactcccacctccacacccccatgtacctcttcctctccaacctgtccttgcctgacatcggtttcacctccagcatggtccccaagatgattgtggacatctaatctcacagcagactcatctcctaggcaggctgcctgactcccatgtctctctttgccatttttggaggcatggaagagagacatgctcctgagtgtgatccctatgacccgtttgtagccatctgtcaccctctatatcattcagccatcatgaacccgtgtttctgtggcaaaaaaaaaaacaaaaaaaaaaaaa

SEQ ID NO: 19191 - DNA, 830 bp, Homo sapiens
aagttattttgccaaaaaatgagccatgaaaggatggacttatttttcagcctactggaatacggggttttgccttgttgccgaggctggtctaaagctcctgagctcaagcaatccgcctgcctcagcctcgcaaagtgctgggattacagaaatacaaacctggtcgatgtgatgatattttgaaatggaagcctcccagtctgaattctgtgaattttcgtctaaaaataacaagaatgggaggagaaggaacctcagaggatccagaactacagccggtcctcactgggctgttcctgtccacgtgcctggtcatggcgctggggaacctgctcatcatcctggccatcagccctgactcccacctccacacccccatgtacttcttcctctccaacctgtccttgcctgacatcggtttcacctccaccatggtccccaagatgattgtggacatccaatctcacagcagtcatctcctatgcgggctgcctgactcagatgtctctttttgccatttttggaggcatggaagaaagacatgctcctgagtgtgatggccctatgaccggtttgtagccatctgtcaccctctatattattcagccatcatgaacccatgtttctgtggctttctagttctgttgtcttgttgtctcagtcttttagactcccagctgcacaatttgattgccttgcaaattacctgcttcaaggatgtggaaattcctaatttcttctgtgacccttctcaactcccccaccatacgtgttgtgacaccttcaccgataacatagtcatgtatttccctgcaaaaaaaaaaaaa

SEQ ID NO: 19192 - DNA, 581 bp, Homo sapiens
aagctcagaggatccagatggcagccggtcctcactgggctgtgcctgtccatgtgcctggtcacggtgctggggaacctgctcatcatcctggcctttagccctgactcccacctccacatccccatgtacttcttcctctctaacctgtccctgcctgacatcggtttcacctccaccacggtccccaagatgattgtggacatccagtctcacagcagagtcatctcctacgcaggctgcctgactcagatgtctctctttgccatttttggaggcatggaagagagacatgctcctgagtgtgatagcctatgagcggtttgtagccatctgtcaccctctatatcattcagccatcatgaacccatgtttctgtggctttctagttttgttgtcttttttttttctcagtcttttagacgcccagctgcacaacttgattgccttacaaaggacctgcttcaaggatgtggaaattcctaatttcttctgtgacccttctcaactccccatcttgcatattgtggcaccttcaccaataacataatcatgtatttccctgccaaaaaaaaaaaaaa

SEQ ID NO: 19193 - DNA, 787 bp, Homo sapiens
gctagactcagaggatccagaactgcagccggtcctcactgggctgttcctgtccatgtgcctggtcatggtgctggggaacctgctcatcatcctggccatcagccctgactcccacctccacatccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggcttcctagttttgttgtcttttttttttctgtcctcagtcttttagactcccagctgcacaacttgattgccttacaagtgacctgcttcaaggatgtggaaattcctaatttcttctgtgacccttctcaactcccccatcttgcatgttgtgacaccttcaccaataagataatcatgtatttccctgctgccatatttggttttcttcccatctcagggacccttttctcttactctaaaattgtttcctccattctgaggggttcatcatcagggtgggaagtataaagccttctccacctgtgggtctcacctgtcagttgtttgctgagttaatggaacaggcgttggaggtacctcaattcagatgaagtgcatcttcccccgaaagggtgcagg

SEQ ID NO: 19194 - DNA, 1003 bp, Homo sapiens
  misc_feature (1)...(1003): n = A,T,C or G
ctggcaaaaggtgtccaaactatacatatccacatagtctaacagatgtctctatattcctcctcctcaaactctcacaggatccagaactgcagccggtcgtcactgggctgttcctgtccatgtgcctggtcactgtgctggggaacctgctcatcctcctgtctgtcagccctgagtcccacctccacacccccatgtacttcttcctctccaacctgtccttgcctgacatcggtttcacctccaccgcggtccccaagatgattgtggacatccaatctcacagcagagtcatctcctatgcaggccgtctgactcagatgtctctctttgccatttttggaggcatggaagagagacatgctcctgagtgtgatggcctatgaccggtttgtagccatctgtcaccctctatatcattcagccaccatgaacccgtgtttctgtggcttcctacttttgttgtctttttttttttctcgggcttttagaagtgcagctgcacaacttgattgccttacaaatgaactgcttcaaggatgtggaaattcctaatctcttctgtgacccttctcaactccccccatattgcatgttgtgacaccttcaccaataacataatcattgctattcccctgctgcaatatttgggttttcctcccatctcggggccctttttttctaactttaaaattgtttttccccattctggaggggttcatcattaaggggggaagtttaggccttctcccacctgtgggtattacctgtccccccctttgtgattttatggaacaggcgttggaagctacctcagttcagatgtgtcatcttccctgagacagggtgcagtggcctcagtgatgtacacggtggtcacccccatatcaccctctgtgacatcaggagtagcatctttctaaaatacctatgcctcatttngaaaaatgtacaccccctgtgacattagaagtaacatcgcccgaggaataagaaataa

SEQ ID NO: 19195 - DNA, 952 bp, Homo sapiens
ctttttacctgcaggaaattttgcctaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaaggaacctcagaggatccagaacggcagctggtccttgctggactgttcctgtccatgtgcctggtcatggtgctggggaacctgctcatcatccggccatgagccctgactcccacctccacacctccatgtacttcttcctctccaacctgtccttgcctgacatcggtttcacctccaccacggtcccccagatgactgtggacatccagtctcgcagcagagtcatctcctatgcaggctgcctgactcagaagtctctctttgccatttttggaggcacggaagagagacatgctcctgagtgtgatggcctatgaccggtttgtagccatctgtcaccctctatatcattcagccatcatgaacctgtgtttctgtggcttcctagttttgctgtcttttttttttttctcagtcttttagactcccagctgtacaacttgattgccttactaatgacctgcttcaaggaggtggacattcctaatttcttctgtgacctttctcaactcccccatcttgccgttgtgacaccttcatcaataacataatcatgtatttccctactgccatatttgggttttcttcccacctcgggagacccctttcctctttactattaaaatcgctccctccattgctgagggtttcatcatcagggggggaaggataaagccttctccacctgagggactcacctggcaattgcctgctgattttatggactaggtggtggagggtccctcaaggcagaagtgtcatttttccccacaaggg

SEQ ID NO: 19196 - DNA, 741 bp, Homo sapiens
tttttttttttttttagatggaatctcactctgttgccaggctggagtgcagtggtgcgatctcggctcactgcaacctccgactccctggttccagcgatttttctgcctcagcctcccgagtagctgttgggattacaagcatgtgccaccacacccagctaatttttgtatttttagtagaccctgcagcttgttactttctagggtgaaatttgacccttgttacttggaccaagtatattttggcatattgtgagatggcagtgacatctgttttattattttgcatagattatgaccatttgtaagtgtttctacaaatggtgtgtatttaaaacataaagtgtgcacaaataaaaatcccaagagatggggactcagttgttgtcataattcattggtgcttctggcatgttggccaagatggtcttgatctcctgacctcatgatccaccagcctcggcctcccaaagtgctgggattacaggcgtgatccaccgcgcctggcagcccctagacatttttatcggctcccaatatccttctagtaattcttttgctgcctaagtgaaccatagttgaaccattatagtttgcaaaggtctctgaaatgtgctctcaaatagagaagttaagtgttaatctgcctaatattgatgctccaagagttctgaaataagaaaggtcataagtgatgccacaaatctataattaatgtggtttactaccctaccgatt

SEQ ID NO: 19197 - DNA, 850 bp, Homo sapiens
tgtgggatgattttattaataattttcgttgccctataaacagccgagtacctttggttaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatacatatataatagaaaagggccaagaaaaatatgcatcttgatttggagacaggctagtattatgcacactgtaagagaagccattttggaaattcacgatagtactgctccaccccagttgagttatttagaattttatctcaagtgaaagctgatggattcatctgctttggctgaaattaaacttatcattagtctagctagcatttcagcatgatattgcaagcacttctcattgctaaaaataagtaaaccaaagtttaaccgaaaaaaaaaaagaatggcctcgttggcactcagcggtggagctctgcggcca

SEQ ID NO: 19198 - DNA, 875 bp, Homo sapiens
cctggtacgacagagaatacttactctgtggacaagagccacgacaggcagcctctgctacatctttcttacggcctggcaaaagcaatctccctaaatgccctcggttggcttccgttccatttcccacagcagctattatgaacattcactgtcccataatctccccgcttgatgaggactacagcacctacttcacagaggaaataaaggcaagaacttcctaggcttctccctctcccgtactccacaggtgctaatgcagccaggaaacacaacaggagcaaagaggggcctggccttatgcatggaagctgaaggactgaaatttgcatttgatcgtcttcaacttctggcacctgttgtcgcagttttctgagtgcccactgagctatccacaagctggcctcctctgaggagtacaacactcccaaactacttctctcagcttccacctaactctgcagaactcccttcctttagcgagaccaaacttagctagcagttagaggtcacccaactgtgccaattcctactaaattgtaacagaaagcccccagacctctgcaattgaaaaagaatcagccatacttaccaccactagtacaagaagaagggtccacagctagcacagataatttgtgccctctttcagtaagcacttttccaaaatattctataaatgttgattttccagcaccagggggcccagacaatcctacggtggaaagagatcttctaattcaatgaaacaaatgaaatcagaactacgatcagttttactgagtaaaatattagactacctctatttcccctaagtgtattaaaaccaccaattaatatatttcagcatgtcctaaaaaaaaaaaaaaaaa

SEQ ID NO: 19199 - DNA, 418 bp, Homo sapiens
gtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaaaaaaaaaaaaaaaaaaaaaaaagaaaaaaaaaaaaaaaaaa

SEQ ID NO: 19200 - DNA, 234 bp, Homo sapiens
ctagatactacagaatttccaggacttgaggaataattgcactcttgaaagagcctatgaaaaagaagagacttgggaaatttaacagaagttcactttccaccactgcgcaaactaaggaaaaccttaaagcagtaaatagctgcggttggcaaagctgttttggctcaggagcagctatcaggccttgataaggtccacaagtctgctgttctaaaatcaaaaaaaaaaaaa

SEQ ID NO: 19201 - DNA, 364 bp, Homo sapiens
cttagatctgcacacagactaaaacctcttagtcccttaagcaatgtttgtattcttgggaacatgtgggaaaactgcgtaagtggtgtccttggagtttgctttaaaagtaagatcttttgaaaaatgtttattcatgttctttgcccactttttgatgggatttttttcttactgatttgtttgagttccttgtagattctggatattagtcctttgccagatgcatagtttgcaaacatacttgggtgacgggtgcactaaatctcagaattcaccactatagaattcatccgtgtaaccaaaaaccacttgtacctcaaaagctactggaataaaataaaataaatgaaaaaaaaaaaaa

SEQ ID NO: 19202 - DNA, 840 bp, Homo sapiens
cctagtggtacaatggtatgaggtaactggggcacaacaaaggagactaagaagacataacaactcgatgcaatgtgtgattctggactggatcttgcattggaggagaaaatgctataaaagtgtcttgctctttcacccaggctggagtgcagtggcgccatctcagctcactgcaacctccgcctcccggattcaagcgattatcctgcctcagtcccctgagtttctgagattacagacacgtgccaccatgtccagcatatatatatatatttttgtagagatggggtttcaccatgttggccaagctggtctcctgaccttgtgatctgcccaccttggcctttttttctctatgtttctctgactcaacctttgacacttagaaggtagcacacttccaacatatccttccgtcttccaagatatagtccatacaactttccatagttcgaatgtttatcccccaaacctcatgttgaaatttgatccccaatgttggaagtggggcccgatgggaggaatttgggtcatggaggtggatccctcatgaatgacttgatgtcctccttgtggtaatgagtgagttcttgctccattagttcctgagaaagctggttgtttaaaaacaaaaacaaaaacctgtaagctcccttccctctctctttcttgtcatttggtctctgcacatgccagctccccttctccttctgccataaatggaattaacctaaagccctcaccagaagcagacgctggcactgtgcttcctgtgcagtctgcagaaccgtaaaccaaataaatctcctttcgttataaattaaaaaaaaaaaaaaa

SEQ ID NO: 19203 - DNA, 921 bp, Homo sapiens
ctttaggagctacccaagagaaatatttgcagattcccaccacccaccgaagacgtgttcatagtacctgtatgtataggagccccaaactggaaacacccatcagtagtaaaatgggaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagagatacttcttatttatacatttaggaaagcaaataatgcctactactccgacttttatagaagctacttttaaatcagaatatttaatttttgatattcatataattaatagaagttgcatttatattttttaatggggcatagttccttatgagttttttcaatgtattgtcatactacatactgaatttgtatggttttaaaattgttacatctagaccactgtaaccattatttttttagctagtgcaaacctaatacctgccatttttactaatttttttctttaaaaacaacaag

SEQ ID NO: 19204 - DNA, 727 bp, Homo sapiens
  misc_feature (1)...(727): n = A,T,C or G
tttttttttttttttttgaagcatttctaaacatttttaatgcatgcagaaagaactacatagactctccaagcagctatataaggtggctcaagtaacattatgatttattttggtctaagccctttcataacgtccttttaaaatacaaagagaatggctacgaaatggtgccagaacccagaaggcccagctggactgacaggagctctgagcagttcataggacaagcagggacccgccgaacctctcccgtttctgtgctttctctaaatgcagcaggtcctctctttactgcccacgcttttaaactatgaaaaaaaattttttaaagaaatctagcagtgattaatggagacctcaaataacactgtacatgggctttgttagagacaggtaatcattcttaacagctcttttcccagaggaggcctgggtgggccgagaggcatccaaagtttaggaagtgcttttattgcagactgcaccttggctaatactatcctctatgtactggctgcctgtgccactcctgctgaggactgtggaggggatgcgagagggacgcctcttgtggttctcctgacataagcacgagatcatcttcttgatggggccatacatgtcctcggccttgtgggagttaatgatggggttcacgaacggagttgagcataggcaggtncaggaaccgatcttttacatggctggacggcgaaattgcatg

SEQ ID NO: 19205 - DNA, 536 bp, Homo sapiens
gccacgaagacaaacgtcgggggtagggagaaaggggggggcgcttatagacacaagcttcaggaagacatgtgacaactgttccagccagttccagttgaagacaccacccctggccatcaagaggctactctgcctccactagacagagcagggtgacagttccgtgatccccaataggtagggactttgcttcaagccagcatgaggcagttacagaagaaagaccattagtcactccacctcccataaagatttatggggatgacatttttcagggaggaaatgaggcacgaaaataggatctggaggcatagaacataaggcctattcacacttcagctatgccgggaaatattatctccatttacatagggcatacacaaagtaaccaatggaaacctctagagggtatttaaatcccccaaaattctgtaacaggacccttggacccctatgcttggacccactcccacactggggagggtacttgcaccttaagaaggatcggcttttggtggttaaaaaaaaaaaaa

SEQ ID NO: 19206 - DNA, 792 bp, Homo sapiens
cctagagatatacagaatcggatgcttaatgcaattttcagaggcatcatggggattcgtgaaagtccttggaagatttgagattcaggaactcaatgaataaatttaactatccataagtgtggattttacacaagactttgagcatcatgaagacaggaaccatatgctattcatcgtcataccctcagctacttggcaaggtatctggaacacagagagaactctatatagatttgtcaagctgtactgaacaaccccaagcggatgcagattgggtcacaccaaatgtgactgctgattcatgtggtcatttggcaaatattgattgagtgcctatgatgtgccaagcactattcttagccaacgctaagccaaatacacaaaaataatgataaagtgagtgcttgtcaattaggtacaacccaggtattttaccaggctagttaattggtgtgttgagtcaatatgaagactgttttaaacttcagcttttgctataatattatttaagcctagacaggaaattcagggttccaataactcaatgctctctctttcctgggcttcagtgtccacacctacatgatgcacatatactgtagtctcccatgagatattttgacatatgtttatacaggatccttctgaaaatccgtgacacatttttaaatcttaacaatttgcctagaaacacctttacaattgcattaaggatttcaaggctaacaaaacactattgcccaaaatgcctttgattttaagacctcacgaagaagccctgtattattt

SEQ ID NO: 19207 - DNA, 740 bp, Homo sapiens
tttttttttttttttaggatgtaacacagtagatttattttctgaactgaattcaagaaggaggatccaagttgctcatattctaggaagaaaatagacttccactcagagatgacacaaaataatatcaaagaaattgcttatgaagaactcggaattacaacatagagaaaattactgagactccaagatggtagagaaaccaggttaaaaggaagaaacaactggataaaaagatctcttgtttccgagtcatcatgaaacataaggatagtcaaaaagttacaattaaataatagaaagttctagagataatcagaaaattaacactatttttatccacatcccccaactgtgcacataaatttcatcatagttgcatttgaagaaatgatgtggaaggcatctaaattaagttgtgaatacagtcttggtacttttgaataactttgaagagttccagtgctgttatggtgatataggtcccctacagcccattcagtctgctgatttaaactctgggcaatatattaaaaaaagaaaagaggaaaagagaaaaaagaaaaagtaggctctgatacttaaataatcatagtaagattgtggtagagaggcaacatccgataaaatgactcctccattatttgagtttctcactttttctttcaacttatccaagcgttctccacagtcacggactaacacaggcaggggtggctaaggttgttacggaggaatct

SEQ ID NO: 19208 - DNA, 763 bp, Homo sapiens
  misc_feature (1)...(763): n = A,T,C or G
ctgaaagaagatggaagaagaaggaaagaaaaggcataatgtaaatataaacgctgtctttatttctgggtctagcaaagagttagtttgaaagagcaattgcttataagactacaaggctgatttctcccatccctgcaatgctgaaagtctgtgcccttctaagcaaattctagtttccctgacaattagtctaatggaatgcctggatgtaggaatattgattccgatgacagtacttttacagatggacctgacatatttctgctggttcttcactgacaacacacaacatatggatgatcataactttcccatataccccactagggcaaacccagatgctgagaaagctagatggaagaatagtgaggcggaaggggagatctccactaggaaggatccgatgagtatactaacacatggacagagagggcctatctttgtgctgaggaagcagagttggcttataggaaccataatgagtcattgcataaagccattattcataactcatgattagtgtgcggggttgctgatacgggtagccaaccctgaacggtaccatagctccaacagaacggttttgggggccagcctgtgacnaattagcggctttcccgtatcntgagggggcccagattggccccttccctctcggaatcgaaatcgaggacgaaaggttatcaaaaattaaaaactccgtcggacctgacgcactctacagccaagagcgggccagacgagaagtgatgcgaggggg

SEQ ID NO: 19209 - DNA, 265 bp, Homo sapiens
tggcttgcgatcaccaaagatctgaggcttgaaatgctggaccatgtattccaccacttccctgtgggggataggagtggcctgtggaagctgagagactaccaccacttcaagttttggaagtaattcaaagtccaggcaatgtcccatctattatactcactcctaacatctactctatgacagtgcttctcaaactttaatattcctatgaatcacctggagattttattaaaatgtagcttctgattcaaaaaaaaaaaaa

SEQ ID NO: 19210 - DNA, 653 bp, Homo sapiens
  misc_feature (1)...(653): n = A,T,C or G
ttaggaacataccaggaaagccaatagaagccacagaccccttgaaggaggtggattgccactgcaggctccattggacagccaaggaacttctagctccacagtgagagcctatcaaactagtaagtcacgagtgaccatgagccctggcttcagctcccagtggaacagcagccaaccagcctggaatacatactcctttccaagagccagcctgcactaccagtcccatgccagctatacctactgtactggacaccctgcttctagctccacagtgagagcctatcaaactagtaagtcacgagtgaccatgagccctggcttcagctcccagtggagcagcagccaaccagcctggaatacatactcctttccaagagccagcctgcactaccagtcccatgccagctatacctactgtactggacaccctgctgtgaaagaaatccaagagtgaacaagaccaagtcttgctcttatggaacttctattctagggaatggggaagttggttattatataaaaagaatataaatacaaagaagcaaacaagagagaaaattataccaccgntgttatatgctaagcaaaataaattctacacagagacttaaaataaatagaagtaacagagaaaaaaaaaaaaaaaa

SEQ ID NO: 19211 - DNA, 613 bp, Homo sapiens
catgattgtcttcaagtttacagcctcatttcagtttgtcatccgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagacataactttataacaattttttttaataatgaaaaatattttcgtgacaagtgagctctaaattctctttattgtaaaagagatgtaaaggttttatattctaaatcctagtaaaattgacagtgatttttaaaaaaaaaaaaa

SEQ ID NO: 19212 - DNA, 626 bp, Homo sapiens
ctttgagaacaatgagaaggcagttgtctgcaagccaggaagaacccttaccaagaattgaatctgctggcacctttaacttggacttgccagcctgcagaactgtgaaaaacaaatgtcttttgtgatcaagtgccaagatgacttactagaagcagctagtatgctccactctcgtgaaaaggaaatagactggccagtaaacactagcacttcaactggatcttccaagaggacatgttgggattcagcaaggaagcaacagaagccatggagaacaaaaacagcaagacacaacagccacccacccaggattgagtggagtcaggggaggatccttaccacaaagaaatagtgactgagagagagccccatggccccatacttctgtcatggacctttgtaatcataggcacagcctgctgccatccatgtaagatgtgacttgctcctacttacctttcaccatgattttgaggcctccccagccacgtggaactccatatcaagaaggacatgtttgctgccccttccaccataagtgtatgtttcctggagcctccccagccatgcagaactgtcagtcaattaaaactattttgattctaaaaaaaaaaaaaaaaaaa

SEQ ID NO: 19213 - DNA, 782 bp, Homo sapiens
ctccattgaaaagaaacataatatactggaaaaattactagaaaatctaggaaaactgactgaatgctttggaaagacacagtcaagtttcacctccttatgctggatatgcgacgactccaggaattttctaatctaagaacgagcgtgttcagtgaaatatcatcggtgttgcaatccgagggagcacgtgaatgtgcctgccaggggagtcaaaagcccttcttgtagaaccgtgaaaggaaataggaagtgaaagctttgccatgtagaacattcctccacactgagagcacagaggatacagacttagttcatatcccagcttcaatcttagagtgccgtgtagatattcctctgtgagtaatgacatttcctcaacatttatataaccctgaaatatcttctgatttctgcctttggtgtataggaagcaacagcacttcttttaaaaggggaaggagggtcagcgcggtggcttatgcctgtaatcccggcactttgggaggccgaggcgggcagatcatgaggtcaagagatggagaccaccctggccaacatggtgaaaccccgtctctactaaaaatacaaaaatcagctgggtgaggtggctcacacctgtagtcccagctactcgggaggctgaggcaggagaatcgtttggacccgggaggcggaggttgcagtgagccgagatagtgccactgaactccagcgacagagcaagactctgtctcaaaaaaacaaacaaacaaaaaaaaaaaacaaaaaaaaaaaaaaaa

SEQ ID NO: 19214 - DNA, 272 bp, Homo sapiens
ctgaacagctctgtgacggcagatacttttgtgcttaggaccctggtgcaagtttccgcactcaatctcctcatctgtaaaatgggcatcagatgatacctccccactctactctgtgttttccaactgtgggtacagaatctgagcgggtgatgacatccaaccagcaggggagaaaaaagcatcaactagaaagtgacggagtgtgagcacacaataaagatgaagattagtcaaaaaaaaaaaaaaaaaaaatggcctcgttggcctca

SEQ ID NO: 19215 - DNA, 1051 bp, Homo sapiens
  misc_feature (1)...(1051): n = A,T,C or G
cttgggtttctcattctctctttgtctgctgccatccatgtaagatgggacttgctactcctagacttccaccatgattgtgaggcttctccagccacgtggaactaccaatacgccaaccagcaatgacccttctcaatcaaaatggcttctaatagggtccttccagtttgaaggcaaagtgtgcaacattgtttaaatggtgatattgtaggaaactataccacaaacagaatcaagtgcatgaagcttgtttccgctttccctgccctgggacatcagactccaggttcaccagcctttggacttgcaccagcagcttcccggggaatctcaggacttcagccacagactgaaggctgccatgtcggcttccctggttttccggctttcaaactcggactgagccattactggcttctctctttccccagcttgcagatatcctatcataggacttcaccttgtaatcgtgtcagttaattctccctaactgactcccttttatatatacatatatcctactggttctgtctctttggagaagcctagtacatgccattttaaaaatgtacatgtgtgtacatgtatagttctgtgcaattttatcttgtgtatagattcatgtaactaccaccacaatcacaatatataactgttccattatcacaaaagaactccctcacactgactgcctctttgtatttctacttactcccccattcattttccccaggccctgtcccctggaaattattcatctgttctctatctctgtaattttgtcattcaagaatgttatataaatggaaacatacagtatgtaacattttgagatttaattcttctcacaaagcataacacccttgaggcccctccgggttattgtatatatcagaagttcattcctttttattgttcagtagtactccactgcatggatataccagttttgttaactattcacccactgaaggatacctgtgttgtttccggntattctgctnattacaaataaagcctctatgaacacacaaaaaaaaaaaaaaaa

SEQ ID NO: 19216 - DNA, 512 bp, Homo sapiens
tgtaagaagtgcctttcacctcctgccatgattctgaggcctccccagccatgtggaactggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatgatgcttctagtttatggacaaagacccctgaagaaattgaagaaaaaagagcaat

SEQ ID NO: 19217 - DNA, 393 bp, Homo sapiens
gccccagggagactctttcccatgctactctgtggtgaaatggaggtcacatgactggttctggccaatggcatgcaggtggaagtgaggaatgtccactccagacttgacctccacatttcccacccccagatccttagctcagtggctcttgcttctgtctcttggttggatgattcaagggtgactgaagccaggaaacagcagagtcacaagatggaaggagcctgaatctgcttgttatcacttgatctagaaaacttgttcatggctttgtatgaataaggcatcaactttgatgctgttaagtacctgaaaagttgggggatgtttgttacagcatcaacctagcctgactgacaacaacagtaataataaatttaataagttata

SEQ ID NO: 19218 - DNA, 291 bp, Homo sapiens
ctgattcttattgccaagtcccctctggctcccttcacctcatttgtctacaccatcaaggaggaaggcctggttcttcaagctggaaaatgaaaacattaaccttgattcaagactttgaaaactgtcgcaacccattggtgggtcatgaagtggaattgatgaatcacaaccagcatttgaagacagagagagagagaagacagaagaaagagtgaagaaaaaatatcagattatatcacacatattgtttcatttcataaaatatttcttgtgtgaaaaaaaaaaaaa

SEQ ID NO: 19219 - DNA, 788 bp, Homo sapiens
cctggatcgaaacatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtactaccaggactcttcgaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctacacattctaacccttaaagctaaaacagcacaaaaaaatttcacttttgaaatgaaatttttataattgcccccccaaaaggctatgtaaaaacaaattttgcatcttaagacaaatattcttttatttctgttaaactgaatatacaattgttccctaggcaaccaacttttgcttataaccacaatttaatttcaggttgataaaacacagtccccagacccctttgtgaagatctaattacaataataaataaaataatggcctcgtcggcctcagcggtggagctctgcggcccgaa

SEQ ID NO: 19220 - DNA, 337 bp, Homo sapiens
cttatgggaacttagaaaggcctttcaggaccacacggttgttttaactgctgaaagcaagcctgcgtcttggtaagactactccagaaagacccctacgagatgcttacatcaccggtgatgtctcccacatagcggcaatggatcacctggggtgtgtatggcagagagatcatgtggccctgcatcttgaagaagtctgatttgtagatcaactaaagaaaaataatccccccaaaacatatgtattagagaccgaatgattaacattcatccctagtctctactccctgtctttcctaagaaaatacccacctcactgacaaaaaaaaaaaaa

SEQ ID NO: 19221 - DNA, 392 bp, Homo sapiens
cctcggaaacactaattctgaagattaagaacgagacactcagacctccaggactaagatgaagtgagccgatttgagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagccttggtggcagagcgagaccctgtctcaaaaataaacaaaaacaaaatgcttctgtcagttaacaatctttattagagggtttttagtctttctttctcagctgtatgttaagttggttgacaaatgcaaataaacgtctttattatcctttcaaaaaaaaaaaaa

SEQ ID NO: 19222 - DNA, 289 bp, Homo sapiens
cttagactccacagaaaggacatcatggggaccgaccaccatccaaagcaactgacagtcgttctatctctcgttctcttagctcaatctgaagatatagtcatgctgtcattttaaaaaatctggttttcaaccaaatgattaacactgtacaaacatttatttggatatattttcttatgtaccaatgtatgcaagagattaacattcatatttgtgtccatatattatatgcataaatgcagaacaaaaataaattacatagaaaatgtcaaaaaaaaaaaaaaaa

SEQ ID NO: 19223 - DNA, 636 bp, Homo sapiens
actctctaatttccaccgctacaggaagtgcagcacatgaataattcacagacagacaagatgggttcctatcagccgcccttggagtccttcctccatgccggcctgttctgtttagacccccttccacttcgggatgaaatcacagctgttggtggctgggaatccctcgccttctgctctggctcagcccagctgggagtctccgcctgctcactctccggtgaccggctcttccccaccctgtgcccttgtgacccagcccctggtgaagtccctggcccgggcctccttgtgcacacacccagcccttcccagaacacgagtgggagcagaccctctatggcgtggcccccacttcccactggagtgagtgggcaacatggaccagccccacagctgaggccatctcctcactacgaatgtgtgttcagtccccgcgggaatggcggcatctcacccttctccaaagtgtctgcgactcccgggccacatgtcccacaaacccaaggggggtttgattccgccgccccccggcgacccccatctcttgtcccttaagagaggttcactcaacgtggcgaacctggcctgcctgttcctggcgaatcggtcacccaaacccaacgcccgccg

SEQ ID NO: 19224 - DNA, 593 bp, Homo sapiens
ttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggccggcatggaggaaggactccaagggaccgtctggcaccgccgggctgataggaacccatcttgtctgtctgtgaattattcatgtgctgcactt

SEQ ID NO: 19225 - DNA, 937 bp, Homo sapiens
catggcttccctccatctgaaagagcataaaaaaaaaaaccaagtgattgttttctcaatcgtcatcaaggttaaaagtggatacgtgttctctgctagccaaggaggaacctgttgggggtttctgggaaagctattccttctctgatagcggaagtgcaagagcttttaagctgctcctcatccctgctccctgctcccgaatatgctgatggtgcacaaagctacagaggggatcctgtgtcagtcagatgacaacaagtgaatcaaatgcctgagttcttggtgacagcattaaacaaggcaaacttcaggttttgtgataaatagggaaaaaatcaaaaaggatttaaagatcatactgttacttgctggcaagctcaccttaaaagaaggaacaatcaagccttattaaagcaggaaaaaacaaacaggaatttttaggaaagtatttaattttaggataaagatctaatgttaaaaatttcagttttcgtgaaaaagcagtaactatgcaaaatcaatgactatatagtgaaagaagatttttttgctgacttactactttcaggcaaaatgccataaaagttattatagttctgaattaatagataactgcattcgaaagaggcaataaaatagtttaagatttttacagggaatgaaaagattcaatagtttcttgtagactctttaaatgacatatacaaagagatttaaagtaattttggttttagtttatggttaggactagggcaaaatacaaaagaccttatttatgtcttttgaaactttattactgccaggcaagtaatatatgtttactggggaactgttgtaacttagagtcattttatttcacaagtatttatcagtaaatgctctatttttcacaataaaatggtctgagggaataagcaaaaaaaaaaaaaaaaaa

SEQ ID NO: 19226 - DNA, 1389 bp, Homo sapiens
cagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaggaacacttcggaatctgaatggccgcagggtcaccttcctctgtggggatgctggccccctcgctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtactttggagcagcccgtggcatggctggaattactatatgttaatgcagccggcagcaaaagtggaccaagaaaccttgacagaaatggtgaaaccctgtattgataatgtggggcaacaaaagattatcggatgtggtgaaataaccccatctctcattaacgcaataaaactagcgcaggctggtgcaactgagtcccagagcaacacacgggggttcatccaacatgctcatgcgggggtaccagggtctttaaggagaagaagtgctttgaaaggcccatggagtgtaacgatgtaattggcaaaaaaggtttgatgcggaagggctacggaatatgccatgggagtgctggcaacggctattccttcctgtccctttgccgtctcacgcaggataagaggtgcttttcccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaaaaggtgcaaaaagacaactaaaatacccatttggaccaaaagccgccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacaaaaaaaaaaaaaaaaaa

SEQ ID NO: 19227 - DNA, 697 bp, Homo sapiens
gtagacggatcctaattcatgtttaactggtttattcttgaagcataacatttcatcaaggtgtatacctgtatgtgaatatttaacaatttagaaactgaaacagatgcagatgaagaatgacctacttgaaaatttaccagccaagcctgtaagctgtgtagagtaatgtcaacacaaaggaaatatcaattcaagtggattccaatgtgcaatcacagtcattagtatggattggtgtcaaactttcaagcatttgccttatttattgaacaacctaataattcaaaatggtaatgggaagagggtggagtaggaaaataaggatagactctgaaaccaaggtccttagggcttctatatgaatttcagaattactgtcaaataaatatttattggtgtcctttctcttgtatgtagacaataagtacacatacagatagctgtctaaaaattaagtgttaagctggaattagatattgaaattgagtaccaatattatctttagtcaatttcccttaggatactattttgtgaagagaaaatattattcatgtgcatattaattaaagcttttaaaatgatcactgaaaatgtatcctctgatctgcagagtatatccagtgtatgttcttaagtcctggtgctagatgcaaattaaagatgagtaatgcaaattgaaaaaaaaaaaaaaaaa

SEQ ID NO: 19228 - DNA, 582 bp, Homo sapiens
ctagggtcaccagacccaaaacatatttctgaaagtctaggagctgaggtggaggtctcgagaaagatctgtttagtgaaatgggatttaccctcggtgttgcatttgtgcatggatcacctctgtgacaggcgaatcaccctgatgagatgaagaactctaagtggattgagggaggcctttgactcatcccagccccacattggatattggacattgtgttcaaaaccatttgaaaatggacaatatttggacatttatggaattacaagggaccaggctggggaatatgaatgcagtgcggaaaatgatgtgtcattcccagatgtgaggaaagtaaaagttgttgtcaactgtaagtgtcatcaccttttatcaaggtaagttctgagaaaagataaaacaccttgaaaaattctgactgaaatttatgttgctgtttttaagaggttgtctattggtaaaaatcacctactaacactgaagacgtgtagatgttgaaatgttggttaaattagtctatgtagcaacaattgtcccaagtaaacccacaatagttcagtctgaagaaaaaaaaaaaaa

SEQ ID NO: 19229 - DNA, 639 bp, Homo sapiens
  misc_feature (1)...(639): n = A,T,C or G
ctagggtcaccagacccaaaacatatttctgaagcctaggagctgaggtggaggtctcgagaaagatctgtttagtgaaatgggatttaccctcggtgttgcatttgtgcatggatcacctctgtgacaggcgaatcaccctgatgagatgaagaactctaagtggattgagggaggcctttgactcatcccagccccacattggatattggacattatgttgttaagtgtttagattttgttttgttcccttaaagagtgttggattttttttaaacaggctcctgtatcacctgcaaattattttggtccattaaaccttgttattaagctttaaaggataggccaaaaagagtctttattctggcttttattcagccatacaactaaggcattagccttttggaatctccatcagtctctgcanaaccatttgaaaatggacaatatttggacatttatggaattacaagggaccaggctgggtaatatgaatgcagtgcggaaaatgatgtgtcattcccagatgtgaggaaagtaaaaggtgttgtcaactgtaagtgtcatcaccttttatcaagataagttctgaaaaaagataaaacacctttgaaaaattctgactgaaaaaaaaaaaaa

SEQ ID NO: 19230 - DNA, 413 bp, Homo sapiens
acccaaaaaaaaacaaaaacaaaaaatctgacagaaaatctagcagcctagcaagcaggctttttccactttaagaatcgattttagcagctggaggagacagttcaaaggcctgaccactggctgagactcacctgtgctccagagggctattccctgattgctgagtaactgtggaccagctttggtctgggcaaaccagaaaacatctctgccatccagtgggctgcaactacatccagtgggctgcaactacaacaagtcctgaatccagcctagagaatcctccttccaagttagttcttccttgagaactctccttcagctctatggtagcctatggaagttaggctcttattgtcatagtttgtattacttttattaaaactttttaaaatcgaaaaaaaaaaaaa

SEQ ID NO: 19231 - DNA, 423 bp, Homo sapiens
ctagatacaacatgagcagtgctctaaggtacacggctggggtgcagctagaagctgactgactcaccttttcctgagtgacccacatagccgccttccaccttctaacaaggtcctataacatgccttcgctgcgtggcttgtggttcacattgtgaccaaggcatctgcatgatacacttctgctgggggaggagagaataaagatctatcaatcactaagccagaccctgaacttgctcaccaaactgtccactctgctgtgactataatcactgctgctcaggaacctatcgaaagtgcatgcagcccttcgaatctggggacctgcatccatggattcaaccagcagactgaagatattcgagacaaatcactcaaagatggctattacgaattacacaatagagtgtgacaactctt

SEQ ID NO: 19232 - DNA, 772 bp, Homo sapiens
taggttaaagaggaaatgatggacaacagaggcaactctagtctacctgacaaacttcctatcttccctgattctgcccgcttgccactgaccaggtccttctatctggagcccatggtcactttccacgtgcacccagaggccccggtgtcatccccttactctgaggagctgccacggctgccttttcccagcgactctcttatcctgggcaattacagtgaaccctgccccttctctttcccgatgccttatccaaattacagagggtgcgagtactcctacgggccagccttcacccggaaaaggaatgagcgggaaaggcagcgggtggaatgtgtcaatgaaggctatgcccagctccgccatcatctgccagaggagtatttggagaagcgactcagcaaagtggaaaccctcagagctgcgatcaagtacattaactacctgcagtctcttctgtaccctgataaagctgagaccaagaataaccctggaaaagtttcctccatgatagcaaccaccagccaccatgctgaccctatgttcagaattgtttgagttgctgtttccaaatagaaatgaatggtatgccgaaaaaaaaaaaccggactcggtggcctaatcggaggatctctttagtcgcctccctttacggagggtcgattcgtgacgctcgcccactgaccgcgctgatcttgatgtttctcctaacgccaatccgctctatcttctttctcggcagaaatccgtcctggcgcacatgggggag

SEQ ID NO: 19233 - DNA, 546 bp, Homo sapiens
  misc_feature (1)...(546): n = A,T,C or G
cttgacagagccaattcgctattaaaccagactcaacagccttacaggtatctcattgaattctaagattgattcactgacggaatctattgcacaacttgagaaagatgtcagcaacttaaataaagaaaagtcagctttacttggcattagatttagaacaacttctaaatcatcgtgaggaattggcagcaatgaaacagattctcgttaagatgcatagtaaacattctcactaaaacagaaccaaaacatgtgacagaaaatcagaaatcaaagactttgaatgtgcctaaagagcatgaagacaatatatttacactaaaaaagaagcacctgagtggtctaagaactctaaagattaagacctagtgttttggatgggaagcaccngnaagaccattataaactcctgaacaaaattcagcttaatcgggtactcagcattttttaaattacattgtttatttgactaatattaaattaacaaattccagtgtgatcacaatgtggtaagaacaattattttataaaattaataccgtt

SEQ ID NO: 19234 - DNA, 468 bp, Homo sapiens
aggacaaccccttccgccagaggattgcccaggtattctctgaggatggggatggccacatgaccctggacaactttttggacatgttttccgtgatgagtgaaatggctccccgcgacctcaaggcttactatgcttttaaaatttatgattttaacaacgacgactacatttgtgcgtgggacctggagcagacggtgaccaaacagacgcggggggagctgagtgccgaggaggtgagcctggtatgtgagaaggtgctggatgaggctgatggagaccatgatgggcggctgtccctggaagatttccagaacattatcctccgggcaccagacttcctcagcaccttccacatccgaatctgatggcaccacagaggagccgagctataggagggcggggtgacccctcacccgctgtggactctggtttctgagaataaacacaagtcactgagtcacaaaa

SEQ ID NO: 19235 - DNA, 182 bp, Homo sapiens
tgtgaagcacagtggaatgagaatgcgtgccctgacaccaaagaaaaataagtgactggaaagctgaagaatcaccggcttcagtgacatggaacccagtgatttgatttttgacgagtatcgggtgactttgaggtggtcaagaaaccacactttaagaacaatgtccaaaaaggggaaaa

SEQ ID NO: 19236 - DNA, 601 bp, Homo sapiens
ctgatggagtctcgctctgacgcccaggctggaggcaatgggacgatctcagatcactgcaaactccccctcccgagttcaagcaattctctgtctcagcctcccaagtagctgggattacaggcgcccgccactacgcccggctaatttttttgtatttttagtagagacggggtttcaccatcttggccaggctggtcttaaactcatgatctcctgatccacctgccttggcctcccaaagtgctgggattacaggcatgagccaccgcgccagccaactacttttgaagtcaggcttacgaagatataatttacattcattaaaactcatcctttttagtgtagacatctgtgagtttggacaaagtcatatcattgtgtaactatcacgacattaatgatataaaacaatttataaccaaaatttccctcattttctgttttagtcagcctcttccacactccctgccaatgacacttaacttattttctgtccctgtagttctgtcttttccagaatatcatatacataaaattatttgtcatttaaatgaattaaaagtatgtagccttttgattatgtgttctacttactgta

SEQ ID NO: 19237 - DNA, 505 bp, Homo sapiens
aatgaggatttgccatgttgtccaggctggtcttgaactcctaggctcaagcgatctgcccacctcagcctcccaaagtgctaggattacaagtgtgagccactgtgcctggacccactatcttaataacaaacttgcaaatatgttatctgagaagatttcaaatcagcctcaccttctgacccagggtgctttcctgctcatttgtattgaaaacagtgacattttccagattaaactgactctgcaagttaagacctagtaaaaaaacaaaaaaaaagatgcatagcaagtccagtgacacctaaacttatgtataacttgtgtcataatcaaaactacaaaatgccaaatccataaagagcagtcaaaattaacacatttgatttcaaatcctttcaaaaattcatttcttaaaagtacctttggagtatgggcataccttgttttgttgttcttcacagtttcttgtttttttaaataaattgaatggcaaccctgaaaa

SEQ ID NO: 19238 - DNA, 760 bp, Homo sapiens
ttttgtaaagcactgaaagtgagacgcctcattgctaatgactttgtaaatgcttttaactctggagtagatgtcttgctaacccccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaagaacaagtacagtttcctgttattcaacttcaagaactcatggatgattgttcaggagtccttgaaaatgaaaagatagcctctgtctctctaaaacagtatacatatctgacaaattataatgacttttaggctgggtgcaattggctcacacccgaagtggcctttctatagtaggccattgtctagcggatcatgatgtgtatattatctataacattctcgttatctatgcatataccccttctactcttataaccctttatttctcctgattgtatggccagccattgcataacgcgcttctttcccagtagaagtatgtagataacatttcccttgtttgttgtagtcattgcaggccatatttttacaataatatgtgcgttgtttcgtgttagacaagatatctgaatgacgttattttattacaaatgtgcaatgattggta

SEQ ID NO: 19239 - DNA, 864 bp, Homo sapiens
agttccagctcttgggaagctgagaaaggatatctgcttgagcccaggagttcgtggctgcagagagctgtgatcacaccaccgcactccagccagggcaacagagtgagaccctgactccaaaagcaaaaacaaaagagcaaaaacgagattccaatgtatactcccaccaattaatttgaaggtgaccatatccctcctatcaaatactgtcactcatttacatctttgccaaatgtgggaaaacataaagtttcgcaaccctatattgactccaccatgccttgggaaaggcagcccgcatcagtggcaggaaatattggtggagcgagctgggacttgcaggtgaccaagaagggggatcccggaaccggaattgtctcccctggcgttccggaagtagaagcagagtcattgctgggtggcgccagccctcagacttgcctctttgcagtaggaagaaggcctccccacataccttcccacactcatcaccttaagccagactcggtgtccagtgaatatgaccatctcttgcccattttctaatgagtgttttcattaatgagttataagaatgtggtgggtaaatctatgggctttgaactagtgaatcaacttggtttcagaatctggcactgctacttactagtgaatttaagcaagttatttcacctttcagagtgtcagttccctcatgcatacaaggaagataaaaaataatgtatacaaaagtattggagtaattaatacatggagaactacatgtaaagcgtttagcatgatgtctgacatattaagcatccaatattagttgcttgcagaatttttaataaaagagactgcttctgaaaaaaaaaaaaa

SEQ ID NO: 19240 - DNA, 980 bp, Homo sapiens
ctaggtgttcccttcccaaagaacttccttcagatctgcaagaagatcctgtgccgccttttccgggtctttgtcaacgtctatatccaccacttcgaccgggtcattgtgatgggtgcagaggcccatgtcgacacctgctacatacacttctattactttgtcacagagatgaacctcatagaccgcaaggaactagagcctttgaaagaaatggcgagcaggatgtgtcactaatgctccacctcaccctttggaagaaaggaaagctgtttcctcctggtgccctgagcgggcaggaggtggaccaccctggctgaaatgacacacctactcccaggaacagcagaggtggaggcaagcagtgactcctgagagacattccccactcactttgtgtgctcttaaccttctgagtgctgctagcctagacctgtggacgaggcagaccacaacgtgaaagaaggaccagccccttgaccgttctggctggggaattgtccacgaggaagcctctgcacttccacacatggcacagttctgcctgtgacctgccgcctaagctttactggaattcaggttttgagactgagatgcgtgaacgtatttttgcacttatctgacttggcaactggccgacttctctgtgattgacttttcaagagccgggagaattttggacctctggatgggcgacacgttgttatgaaataccgcttactttaagggccataaaaactactgatctgaactgagagtataaactgcacagaactgcccttctttccgatccggcccccaaagggacccgtgcatctacctagtgagcatgcgcgggcggggttgagtgtttcgtgatggagggatagacacagagtagtcctgcgccggcgtgcgcacgctacaccaccttccatgcacggcgtattgtcgcgcccacccctatcgcatcatctgcctcgatcactcctcctcgcgct

SEQ ID NO: 19241 - DNA, 1398 bp, Homo sapiens
atgttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttataaatgacctgtttggcccaagacccaactgccagcaggaaaacagtgcctgaaatacctacattcagagatcattcagttctttaaaacatggatactggttgtagaggacaacgaaagcagccaacagcggcattacccctggctagagagtgatactgtggtggactcaagcattgtggcaactgttcactgactgtattgactcactgcatgagagttttaaaaataagctgttgccaggtgatgcaggagccctttggttgcacctgatgcattatgtgaagcaagtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcaggattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaaaaaaaaaaa

SEQ ID NO: 19242 - DNA, 775 bp, Homo sapiens
ctggcccgtgccatccccggggaggtacagaaaaagtaacaaaaataatttttggcttcaagcacccaacaatggaaatgctgaaacccatgtcctttaagtccttttcttctcctagcagagggccctctgcctacatggggcaccgtggtggccatttaatgtactcctgcttggtacccacctctgctctgccccctggtggccacagacaccattgctgctgcctcagcacagtttgaccttgttgctgccaagagccacctctcctctcatcactgtccccactctcctgccatgcctcaggtggctgctggcagaagagcagtgggctttgtttcttcagaacatcacagcaaccactgtcttatcagctcacaccctcaggatcttactgccccttttcccaaaaatctccactccggcaaccctggccctgcatcattgaaggacatttaagtgatataacatattgttgcctcaaaaaagttttttccctcttcaacagctgggacaacaggataaccacatgcaagagaatgatgtttggccactaaccacaccatacatacaaattaactcaaaatgaatcaaagacttaaatgtaagagctaaaacttagaacaaacaggagaaaatcttcacaaccatggatttgggcatggattcttagataagatgccaaaagcacaagcaacacatggaaaaaaagagatacattagacttcatcaaaattaaaaacttcttttgtgcatctaaggacactatcaagaa

SEQ ID NO: 19243 - DNA, 818 bp, Homo sapiens
taggatacgaagcaaagaaaaataggagtgatctatcacaacaaggaaaaaactagaaaacatacctgaagaagcttccagtctttccaatctgctgatcaaccagtcgagggagccagaaaattgagcacagtttttacgatttcctctaattagagccgctgcaaaagaagaaatagatttcacctttatgtgattttctagctcgaaaattgagataagctaatatgcagccctaaaatattggatcaagaacaaaatatcctctgttacatctaaaaacttatgcaaacatacatacacgtacatatacaacactgagacattaaagacaaattaataattattaattgagactgaagcaaaccactgctcattagaaggaatgtaatttcggaaagtgaatttcacattgggaggtaatagtaaagggtaatggaaaaacagtctcctgggagttccctcacttgggttctaatcccctttgcttttaattagccatgagattaaattatttttctctctcaagcccaattttcttacctatagaataaaaagagcaaatcagtttttctgaaaatgaaccacaaaatactaggagatattactagtaattataactcttaccaggtttacagagaggatataacctaatggtacatttaatttatggatgagaaggaccattagccacctactcctgaaacccttttattttcttatatcatttctccgtggatttcacgagtcacaattgcttcttaaacacctgaaattctgcataataaaaccgattttaactggcttataacactgtt

SEQ ID NO: 19244 - DNA, 744 bp, Homo sapiens
ttttttttttttttttttgattgggggggttcttattactgactcaattatggaacttgatattggtctgttcagtggggaaatgtatacctttaataaaggtatactccaaattctccacgatctccttggccaactcagtctctggatataacttactgaggaaaattgtggcttactgttggcagataatatcctcaataggcttgttctccaaagttttaccaccaagaataaagcactgttaaaaaccctttgttctgaaggctctacagacacatgcagccaatagaaaagattatattagtgtcaaaacaatgaaattagacttactgacattagagttcttcaagccttctaggttcccacgagaattctttataaagcgtactagaaatcttcagctaaggcaagcaatgtgcatcatatgttgaattggcccctggacattctgtaatcccagctactcaggaggctgaggcaggagcacagcttgaggctaggaattcaagaccagcttgggctacatagtgagaccccatctctggggaacagaagggatgagtctcctctcccctgctagaacgtcagtggaggccaagtggagaacctggacttcaaccctcattgggcactagtgaggagatatccaccttcccttgctgacaagtaggcagaggatggcctgctacctttttttttgtgtgttcctgtattgcggcgcaggcgggggacgctaccaca

SEQ ID NO: 19245 - DNA, 758 bp, Homo sapiens
ctaggtgtacgtggaacattagtacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccagataaaatccagggggaagagtcatctaagtttaccatgcagttgtttaccaaaaatagaggaggagagtcttaacttttgctcttggatttaagtcaaggtactgtatagaagttgtgtaaaatcaggatgaaagttcaatgttgctgttcttgctcagtgattttaaagaaattgagtaggtcctatgtgatggtttatttggttttctaaactgaattactgtgcccacctacggcatgcctgtatgtattgactactacagggtttaaaaaagggtgtcagatattgctgtaattatgtacaagctaaaatgaagatgttatgattggatcacaaaggcagaattacttaattacttagtgctttatggggcgacgtgtgatattcagagaaccggagacgagtggtatgaaaaaattt

SEQ ID NO: 19246 - DNA, 728 bp, Homo sapiens
acctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccagttaatgtaactgctagctattggcctcccaaaagactccagtactattttaatttgtattgaagaagttcagaaatttaaaagcagagcattttttatgatatcattgatggtgttaattgtaagtataatttgctggaacacaaagaccagaatgaaagttttttgctgcctgcttaaaaatgaaacaactagcttaggtactttggaacactactcttacatgtataaagtgattgacttgactttctaactaaccttgaacggaggatataaaaatgctatggtgaggattaatcatagtacttggctttgtactattaacatgatgtactaaagattaatcctt

SEQ ID NO: 19247 - DNA, 454 bp, Homo sapiens
ctttgattggacaaatgaggtacgttagtgttcgcgactttaaaggcaaagtgctaattgatattagagaatattggattgatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctgattgtcaactttattaaggattactttgtctgcccaccacctagtgtaaaataaaatcaagtaacacaatcttaaaaaaaaaaaaa

SEQ ID NO: 19248 - DNA, 362 bp, Homo sapiens
cacgggctcccgaggtctcactttgtcacccagctggggatgaatggcacgatcttggttcactgcaacctccacctcctgggttcaagcaattctcctgcctcacatccccatggctgggattacaggtgcccaccaccaagcctggatttgaagggcttaacataactaaactgtatgatggacaatgtgaaaactcttgaacgtacgacaaagaattataaaacctactgaatctccagattgccaagtgaaacacaatggttgcctcttcaaatatatcccctttaattactaatggttggatcaaactcgttgatttatgtcttcaataaatgattcttagcagaaaaaaaaaaaaa

SEQ ID NO: 19249 - DNA, 813 bp, Homo sapiens
atcttgaagacaaccatcaaggcatttttttcccaaaaagcacagaaggagattcaatcatcaaatgagaggcctcactcacctctgcatattggcccttatcctttgaaagagaataaagtaacagctgctattctttcagccaagaaagggccactggaacaggtccagaaggaaagaaaagagtgatggcaactgctgattcaagaagattgttctgtttcagtttttattttattttagatgtaccccttctccacaatgagtttctcatacacgcatctaatgaaagacgcctgttctcaaccctcctagaatttcaagatgggcaaacttacaaggaaagcaaggatgagtgctaatatgtaccatattcatgtgaatataagtttttttaataagaaaatcaaactctaaaaatacaatatacttcataattacagattgaaaaatggggccgtgtgtcctaggcagctgcccactgctgagtccagggtacactgccatcctaggaagagagtgaggaggagggtgaaaaaactcacccaggaaaggcagtgaggggtggggagggagcacaaagaaagtcacttcaaatctctctctaaaactatattgcttttctgtgcaaaaatattttcttctgggcccccttatagactagcttatataaacactgcaaagtgctttgattcttaagggtctggaacccaacacaaaccatttaaagttaaattcacaatcgttggaaagaatgatatgccccacttttcatccacttacaaagcagtgacaccctcgaatgtatctaag

SEQ ID NO: 19250 - DNA, 425 bp, Homo sapiens; identical to SEQ ID NO: 7292

SEQ ID NO: 19251 - DNA, 1340 bp, Homo sapiens
gcaaggagcaggctccatgcatgcatttgggctctgtggaaaatctggccagggatgcgggcctttctgaacgccgctttcattgtgccccctgcagcattatctcttcaatgcgatgtccctgctgactgaaatgcagagaagctactaagatccacacaccagttgctgcaatcggagccctgctgtttgtcccccattcaccccaggtgattcagctcttctggcactcccagtgattcctgtgggacaggcccatagtggacttcccacgaagattcccagactgggggagagctctaagatccacttccaattcctttgtctcacctaggagactctgggtttatggaagttctctctgattagtgctgttgcagccgggtttgggggtcatgtagtctaaatgattgtttctcttactggtggtgatttttccagtttctgtgggcccagtggatttctctgcttctccttagagttctggtgaactcagaatgttagtgttattcttttctttgaaaatagtttccatttgtaatttgcttggagagagattctgggggattctattctgccatcttgctgctgtcactctttaataagatttgtaactaattctcaaattgttcatagtcttaaaactacatagagttgatttcagacattttattgtgagaacaataaaagtatttcgtgcctttgctagtgagatttttagttatacagaaattaccagtgtttcctgctatgatcaatcattccaagattcattatacatatgttaaatatgttatacatttgtttacataatgcatattttattttttttctgagatacccaaagcataatctccctcactatcctgaataattataaattagtatttcatatatgatagaaaatttgtgacatccactatttttaagaacggctaggctgggcatggtggctcattcctgtaatcccagcactttgagaggctgaggtgggcggatcacgtgagttcgggagttcgagaccagcctgaccagcatggagaaaccccatctctactaaaaatacaaaattagccgggcgtggtggcacatgcctgtattcccagctactcgggaggctgaagcaggagaattgcttgaacccgggaggtggaggttgcagtgagccgacatcatgccattgcactccagcctgggcagcaagagtgaaactctgtctcgaaaaaaaaaaaagaaaaaaaaaaaagaagaatggctagtttcagaacatgtttatatgtatgttgtattcaatgtctttaattaaagtctgcttctttatcctaaaaaaaaaaaaaaaa

SEQ ID NO: 19252 - DNA, 1055 bp, Homo sapiens
taggacaagaaagatattgaagcggaggtgaatatttttaaatgaagaggggcttctaatgttcacctaaaaatgaatgaagtagagcatacagatctcttcccactttcaattattgccaggcagtggccaaagggaagttcaactcctttgtgacttctgacagcaagaaagaaccataaaagcacttctccttcctgccaccttgtgaagaaggtgccttgctttcctccatgaacgttaagtttcctgaggcctccccagtcatgctgaactggacagctcttatattaacaaaaccttttctgaagacgatgaacacacaggcgagctccacaacgtatagcaaatgttgcacagccacaggcaaggttctccagctccaagtacattccgaactcccagtatcgatggcaatggagagtgacaggcgccattcctgaatgatgaaaggaaaaccccattttcaagtagagaaaccatttctgcatgacagctcaaaagatacttgtactcaaagcagtgtaaaattgcatcttgcagttttccaggatgaagtgtcactatcaaattattctgcttcattgaaagacagttttattcccattttaaaaatatgctcatatatgtaatttcatagtcagtatctttagtttcttttttcttctaggattcctacaacacattttgagaagtttaggtcataacagactggaatcaatcaattaaaactctcttcatcaaaattgtgctatctatctttaactcagcataattttccttttgcttgaagaaaaaagtgatccttatgatctgtgttaacggtttgcaatatttcattataatacttttttatgtattaccttatataatttctaacacatacctctgttatatattttgttaactttgaatattaacgtgctgaataagtgtcctttatgtaactgaagaatttctgagaactattttcttgaaatagttcaaataaatctttctccctttcaaaaaaaaaaaatggcctcgttggcatcagcggtggagctctcgccaag

SEQ ID NO: 19253 - DNA, 715 bp, Homo sapiens
  misc_feature (1)...(715): n = A,T,C or G
cgcatcatgttttatttagaaaaacttgtggcagaaaacaatagttataaaagtcaatacatttaatgtgccaggtatttttttgtttgttcattttctgaaagagataaaggatcttgagagtcagaaagccaagctccaaagggagcaaagcagtaagatcatccacaagcaaatgtaggtaatgatgacaaatgataatttaagtgctggtttcccactcaaatgaggttataattcaaaggttatggagaagactggagaacattggaagaagcgagcttgctggcagtaggcaagaaaggcacttgtcttgggtgctacatttaaggggtaccaaaaaattcagtaatcaagataagtaatattttaatgcaatgtttcaaaaaaatccacgacaaatgaagtatccaaattttaaataaagacagaagccttaaagggtgccgtgaatttctttgccaggactacaggnattgactgntttcctaagtgaagtntcaaggggaggggcaggtnnaaactgttngaagataaaacccaaagataggcttnnaaggacttggggggcagcanantttttcccttacagcccccattcatcctcatcttagtctaggaaactattganggattttgaagaagtcattgaagcttntagccaggccaggacaagttttgttagtttccnanaanaanccttgcttaaagttaa

SEQ ID NO: 19254 - DNA, 696 bp, Homo sapiens
  misc_feature (1)...(696): n = A,T,C or G
acatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttttctacttagaccctgaagtggaatgtctgaaggccaacaccattgaagttctgggggcggtggtggcggcgttcacccaataactctgctcggggtgaaccattctacttttgtctcaaggaaaccaattagttgttctttagtggacttattgtgtgcagtaattcgagcttggccacactgtgagtgtgttggtgttgtacaagaagaggggggaggcttatagctttgtaagaatgtaggctggatatttacgttgaaccaataggcctttctttaatatgatttctaagataaattagtacaggtaattgagaataagctggccctatgacctcgcttattgagtatanattaag

SEQ ID NO: 19255 - DNA, 961 bp, Homo sapiens
aggcatgacagcaagcgctgttgcggctttgatcctcatgacgtcctccatcatgtcggtcgtggggtccctgtacctggcctaccttctgtactttgtgctgaaggagttctgcatcatcttcaagcaaagagtattatgatggaaaagaccagtccaagccccatcgctccggagtgggagccagtgttcttgctaattgcttctttctgcacgaaccactcagatgtctaatttaattgttttgcagccaaatacctggatttgtttttttttatggctgacatgctgcccagtttgcttcatcggcagaatccgcaccaggtagacacatctcaaggcttaatctgcccatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaatccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatcacttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcagccagtttcataaaagagagcttaagtcagaaaaaaaaaaaatggcctcgttggcaacagcggtggagctttgcgccaaa

SEQ ID NO: 19256 - DNA, 849 bp, Homo sapiens
  misc_feature (1)...(849): n = A,T,C or G
ctggacatggagaatatctctgtttttccctgcagctgtgtcggaagtcaccagctttggagaagccatggaaagatccaccccagaagaaaaagcctattgataaaccatttaaaactgaataaatggaagtcccctatgcagtctatcaactattatattcaagtttttctattcatctataattttctatttaattcccagcaagtttttgaaaacaaaattaggccctcaaaaaatatagcttgaaaaaaatctggaataatttgctgtacatagtacagcaaaaatatcaaagagtggttatttctgggtgatggagttatggagcactttaatttgcttatttaatgctatgtgctttctaatattttgcacaataaacatggattccttaagtaataccagacgaaaaaagaagtatcatcaatattaatatgtcttcgaatgtattaaataagatatattacaaaaaataaaatataaaaattgccctttttgggcctccccggaggagcctctggcgcccgttccctttatggggggggtttattataaaaccctctctactctaactccttggttcttgggatttcgggtttgggggaaaggggatttacccttaccccaaggcgggtatatccgcgttttcccaggatatagggggtttaccccgaagaaaaacactgtgaacccaaggggccccccaaaggcncagaaaccccaataaagccctgttagcggagtattttctcaagctccctcctccattaaaaatatcacaaaatatccacctctaagctatagtgggtaatacctgccggtatttaataaatccagggtgttccc

SEQ ID NO: 19257 - DNA, 786 bp, Homo sapiens
ctagttggtggtatttgaggagataggtgaagattttggttggaagagggaccagcagacaaacttgttctcttgtgtataaaaagccataacacgccccacatccctcaagctaggaagaaacctgggttggatggtgacccactggagaagctgtgacatcctagcatggggaagagtaccaggatgcccactcctcttccccaggaaccaccaaggagcctggagcctggctttatctcagccctgagtccccctctcccggtgcgcacacccctaacttttttttttagatggaatcttgctctgtcgcccaggctggagtgcaacggcagctcactgtaacctccacctcccaggttcaagcgattctcctgcctcagcctcccgagtagctgggattacaggcgcgtgactccatgcctggctgatttttgtattttagtagaggtagggtttcaccatgttgaccagggtggtctggaactcctgatctcacgtgatctgcctgccttcaccctcccaagtgcttggaattacaggtgtgagctaccgcgcccggccaatctggggctcctacatttggtgaaccaactacccaaatcccccacttctttccaagaggaatgttcagaaacagtgaccattctgggtacagaagctgaaagggccccaaccacgctgcaataaacctgccctcgcctcctaagataaaaacactaaccaagccatcactcatggacgcacatcctcctcgcgcacgtccctaagcacacataattttat

SEQ ID NO: 19258 - DNA, 1144 bp, Homo sapiens
tagactccgatggcattctttaattgcaaagtacaatctgagtcatttgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggtgaaattgattgagtttttatttcattatgaaattaaaggttgaggtgagggaaccaattttgatgtccgagttaagaattgccctcactggtcactttataatcttttggcaccagtatcctcccagacccgtgtgtcatcccagggcttgtgaaagtcctcactggaccgagtctcttcagaactggctctgtctccttcaccaccatcactctcaatgccaccttctgggggtagcccctactcatcttctctactgatgcttccttattatttttccatgctctctgctttccccagacttcttcccttctttcttaaaggaatgtggtaaatttgccagcagggcccgtgccgctccaggatgagagtaaagagaaaccagcctttctcctctacgtactgcatcactgtttgccacacctaccaaagccaggacagaggctggggcagacagaggaaaggagggagcttacgccaagcaggaaaaacgagggagtgaagaatgcccctttctcacttatctgattatttccttttggtttcattctactgtagcctgtaaacttggagtttcatgtaaggacttgcttagattcaagtttaacatttctggtaaaaatattttaaaagggaagttatgtactacattttgcattatattgagaggtatataatgtcaggttgtcccattattagtaatgcctggttttatcatctggttaagatggtgaccactagatatcttcattattaaaagtattcttttccaaaaaaaaaaaaaaa

SEQ ID NO: 19259 - DNA, 731 bp, Homo sapiens
tttttttttttttttccttttttttttttttttttttttttttttttttttttttttttttttttttttttttttttttttttttttttttttttttttttttttttttttttttttttttttcaaggggggggggaaaaaaaacggttttttttaaaacccccaaaaacttttggcccccccaatttccccccccctaaaaaaccccaaaaaaacggggggggacccggcccccccttttttaccccgggggggaaacccccccgttttggccccccccgcttacccccttatttaaaaaccccccccccccctttttagggggcccggggacccccaaaaaagaattttttttaaaaaaaaaaaaacccctttcaccctcccccccaaaaacccccccggaaatttttttgggaaaaaaaaaaaagggggggaggtgtcaaggaactcccgcggcccgggattttgcgcacccccttaaccttgggaaagtttttttctcccttaaaagaatcccccccgcccccccctcctttaagccccccccccgcacggcgggggggggggctcctttgggggccatcccccccccctgggttcgcccaaatctcccaccccggggaaaaaaatcggggatcccttcttaccccccaaaaataattctctcgggcccctctccccctcaaaatcagcgccggggggtttcacccccttttttgaacgaaaaaaac

SEQ ID NO: 19260 - DNA, 786 bp, Homo sapiens
ttgccgggaagtgtgtgcggcatttcccccccgattatcttctgaatgagagtggccaagtcctccaggcgttgcttcctcaggtcttctaatttgaataactaataagaaatgatggatggacttatcaaaaatcctctgaaacctcacagcatacaggaaaggaattttcaggagacaaaatgccatcatgttggagtcaattacattgaaaaaaagaactgaaaaaccatatgcattatatatgatatggataatggtccatgagaaaattattttgatggattcatgaaagtcttacaatttttattccagtgattcagaatttatgacaaatcagagaggggctgaattgaccttaagtttaccttcacactgtctatgaggatgcaaattactaatggaaggtagatgctggaaaattctcttaaatgaattaaatactttccaaaatcttaacgtttccaaattaccagtcacctgctatactcattacacttcacactcatctattcattgacaaaaaaatttccttggggttctatgaggtagaatgctaaaagtattttttttaacttaaaaaaaatttcattttagtgctttcctgtgcctctaaataatggggctgtagttcttaaattaatgtataattcaggtattacaaatacagactggttacctgcagttgctttgaatgttgtaccggtggcctaacagtttctttgtgaattcttaaggggtggacaatctgccaaagcaaagactttgatggttcataaaaatacg

SEQ ID NO: 19261 - DNA, 833 bp, Homo sapiens
cccgcccccatcatgctaagactccagcctacagcaccggcccgcagaccctaggagcctcgaccatgaactcatctcctatctgaggcaggacccaacatccctggcctcaagaaacattgcacaagaacaattctgacacctaaaacgaatccagcatccctgacttgatgatgcttccacctcagctccaccttcagcatacacttaccaactgatctttcatccatcgtttgactcccaagctgaagaacacctcaaataccccaggaaggatctccatgtaccaccttctccactggatgaggcatgagggtcgccatatttactgctagcaaagcctgtccccatctctcccccaccctcaccaaaatctagtcactctaaaatggcctctccggtgatgtccctagatctgctggcacagaagtggaaatatacagtactttccatttccatttccttagtaggttgttgactcgaggtcactctctgtaacattctttctagggattcttatagcacagacgtatttgtgcacattggaggcagctatcaccttctcccaagaaatctcacttacaacatcttctcacatcctctaggtttccatcttggattattcatcagtgtgtaatcattttagcaggggaaggtagattggttggctttttaaaaaaattgagatataattaacagaataaaatatatagatcttaagtgttcaggtcatgaggtttgacaattgtatacaggttgtgtaaccacccctgaagacaagaaatgagactttcccttgcacgagggtgccctcatgcccctttcttgagact

SEQ ID NO: 19262 - DNA, 319 bp, Homo sapiens
taacatgaatgactcagattctgaaggaagaaaaagaatgacaaactatgttccaggagaagtagaattactgcatcacagggcacttcatttttagattacgtatcatggcggcagaccttcaataccaaggtgcatcttctcccgcaagttcttcagcatcctttccagaagcattcggcagccgagaaagcaggctacaccttacctactccttcctgggctaaagatctcagacttagttgcttatcttaatttggggaaaataaattaaggagttcttctatcattaagcacaacataatataatctatttaat

SEQ ID NO: 19263 - DNA, 348 bp, Homo sapiens
aggccacatctggggacgcccatgatgtggctgatatgcgagagcttacgctgtgaaggaagcaacagcctcaagctcgaacctactgtacctgtcctgcacgacggcgtcctgaccgaggccatgatggacacccatgtgctagatgctgcccaacctcacgcatcaaatgatgctctggctgaagagggggaggcctgggccctaggacggactaacctgatgctcgtgtgcatggcggatgaccatacactgacgggagcctggacgatgactccctcacatgcctgcctttgctgccccgcacatttgggaaatgctgcctgaaataaatcaccggcggggccg

SEQ ID NO: 19264 - DNA, 759 bp, Homo sapiens
ctagccgcaacaaggttactatgttttaaagaaaatgagagcaaacatccactcggaagtaaagaataactgatatgtacgatgctttggtcaaacgatcccttacataaaatgtatgttttgagaaaatgaacaattcacagtgcctgaaagcaaggtcaaccagatgccagcaacacagcttctttctgcagtgcaagggtgcatcatctcaagttttcagtctgagaacatgcagcaggctctcacctccaaatacttcccaaagcttaaccctgcggtccatgcctccagtggccagtaaccgggaacctggactgaactgcacagcgttgacttccccatcatgtgcatcctgcaagacaagcaccctgtgtcaaacccagtcattctcatcccaagagctcaagatgcgcgaacactccaaatgcctaattcatggggacacactcatccttaaatacaggtggagccaatcataaactaaactggacttctatcccaagtcaactaagattctattatcattttattcttctaagtacagatgcattataaagcagaggaaccttcttaaaaaggacgtaaaatctttgtagactgcttaaaggtgggccttggtttaatttcatccgttctaacaatgatggcctatatttatcttaaaagtccaaaagtaacctcgaattaattttggaccacagaaaaaaacccgcgctgtgtggctccacgggagaccctgcgcaagttactttatgt

SEQ ID NO: 19265 - DNA, 774 bp, Homo sapiens
  misc_feature (1)...(774): n = A,T,C or G
gaacggaatgtaatggaatgtaatggaatggaatcaacccgagtgcaggggaatggaatggaatggaatgcaatggaatggaatcatccggaatggaatggaatggaatgcaatggaatggattggaacggaataaacccgagtgcaatggaatggagtgaaatggaatggaatggaatggaaacaaccagaatggattggaatataatggagtgtaagggaattgaatagaataaatctgaatgtaatgaaatggaatggaacggacatgagtagagaaatcaaagaacagagatgagcataaagcatgagatgaaggaccacaaatttgaaaaataataccagcaactcaaggtgttaagtactttctttctatattaaaacattttgttgtgtccatgcaaaaatcaatttttgtaacaaatggaattctctgngtgtgtgtgttctctctaatgaggaaagaagtaaatgaacagggattatatnagcgttataattctctaccnctttnagtttatcagtggtacgcaatttatattcaacagcaggccaggcaatgcataagnaaaatatggctttttgacacataaatgccaacatcaaatattnggtcttctatctccagnnggcctcctttntatataaataattatgagaaggacataagaaataggaaacctgtgaatagtttagtgaaatatttaaaataagtttttgcctggattttattataaaagtagtacattttgttgttaaaactttagaaaaaat

SEQ ID NO: 19266 - DNA, 859 bp, Homo sapiens
  misc_feature (1)...(859): n = A,T,C or G
tcagcaaacaccaggtttcatatggagatgcagctggataggaactgagcaccaataaaatgcttcgtcttccactggcaagattttggagtctaataaaagtcacttttccaaatacaggaaaatgctatgagtatcctgaataccttgaggtggggcagctgggtcagcacatggctgaggactgtcaaccacacatcaaataatgttctggatctctcctaacaggcataaaaacagattcacagacaaatgaaacagaatagaaaacccggaaataaatccatgcacctacagtgaactcatattcaacaaaggctccaagaacatacactggaaaaagacagtctcttcaataaatggtgctgggagaacccaatatccatacgcagaaaaataaaactagacccctgtctcttaccgtatacaaaaatcaaataaaaatgcatcaaagacttaaatctaagtccttaaactctgaaatcaccacaagaaaccattggagaaaaantntcttggacatcgttttgggcaaaaatttctctaggcaatacaccacaagcacagtcanccaaagcaaaaatagacaaatgggatcatatcaggttctgcacnacaaaggaaccaatcatcaaagtgaagagatggcccncagaatgggagaaaatattcgtaaactaaccatctgncaaaggattgataatcagatatggaancagctcaaacaactacaggaaaaaaaaanctaacaattggatcaaaaaatgagcaaaggatttgaatagacatttctcaataaaagacatacaaaggtcnaactggcctatgnaaacatgccaaaaatcactgatcatcaaat

SEQ ID NO: 19267 - DNA, 798 bp, Homo sapiens
gctgcacagactgagttaggacagcaaatcctggcagattttgaagaagcgtttccttcccagggcaccaagagaccaggaggacccagcaatgttctacgggatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttcctcgtgagtggtgcatggctgagaggattgcggtggaattttgccatgcgacaagggcagaacttgccaagattatgcgtaccagagcgaaggaaattgaagtgaaattgcttccttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaacaccaccaaaagggaggctggctgggaggaccagctctgagaaacctgtaaccatgtactttgcagctagccctgcattcattctttcccagcaccacgagggcaggagccaagagagcagagcttccaggagcagttctgaaatgatgcaatcaaatgtgtctggtcccttgattaaatgattgtaatagaaa

SEQ ID NO: 19268 - DNA, 745 bp, Homo sapiens
tagagatcgagtcttgctctgtcacccaggctggagtgcagtggtgtgatctgcagcctcaaaatcctggaccaaagcaatcctcccaccttagcctcccaagtagttgggattacagaagtgagctactatgaccagcttcaaatttctttaatagcttaaacctgtccaagcaagatgagaaacataacacctagtctattatctcactggttccatgattttatgagtcagagcgaactgaagtttggctcaaatcaaagtttatgttattgctcctgcattcttcttttgaatcataataaaaatctcatccaacaaggaagctgaggttcagagttaatgatgagagcatatggaatttgaatccaggttgagacaacttcaaagctggtgccattttccactacccagcacagtcactggtaaaggtatccttccagacagaatgtgttttagttacgggtatgcattttctttcctgaaaaagtaaaccctctatctgtgaaataactgctaaatcttcttgtgtggtttttatatactaattaatctcttaacaacccaatacatgtttttgttataaataacctaatattcattttgtgaaatgctgcaaaaaggatagaatggtcatttccctttcattaagatacttcattttctcttatcattctctataaatataagaaattaataaaggtgatttactattaataaaatcttaaaaataaaaaaaaaaaaa

SEQ ID NO: 19269 - DNA, 554 bp, Homo sapiens
cacatgctagttcctcatcagaaggaagttcttcatcaattacgtcctcttcatattcatcaatttcttccccatcatactcatcttcgcttcccacatcacttcctgacacctctgcctcatcctccagatcgcttcaggagttcttcttcatcatcatcttcatggtcttccagtgccagatcattaccagagtcactgtgttcatcctacaaaatcagcatcatatccaaattaagcagaataaaatgcgtcctcaatgaaaaaaggatttataaacatctgcccaaatacctcattctaggaaattgtttctgataagatgccaaacttagaattctcaagaactgaggggaaaaaaacacttgagggcagcaatacatggagctcagttatgattactttgttcccttcatactcacctcatcactatcaaactcattatcatttgaaacaagccgaaagtctccaaattcctcctcctcgtcttcctcttccctaaaatgtaaatcaatgaatcaataaataagttgttgaaagcaaaaaaaaaaaaa

SEQ ID NO: 19270 - DNA, 1044 bp, Homo sapiens
tagtctcgctctgttgcccaggtctggatacagtggtgcaatctcagctcactgcaacctccacctcccaggttcaagtgattcttctcctacctcagtctcccggaatcctttttatatggagcatcttgcaaaattagtgttctgagagtcataacatgggaaacaatgcttaattgttttgaatgtggtccaaggacgcttgcatcagaatcactgtggatgctgattattgatacaataaatcatcgccacgtcttgttatgtcagaagctcttctaccagaagcagaaagagaatagcctttcaaggaacatggagaagttaacgtgaggatgtcagaacaagaacacagagggtcccttggtccctaatactttgggggccaccatattatccctggactgcttagcatggaccggtatgtaatagagaaataaatttatctcctgtatttgccattgctatttttgccttcgataatgcagctgatctgaaaactaattaattcagagataaaaagagaacgtacgttctgactaatcatggtgagtagtctctgttctgttctttattaaaaagcatggatttctctgttgtgatgtctttctttttaaggtaaaaagataaggtctttcttctttttttctctttttaaatttcaatatcttttgaggtacaagtggtttttggttacatggatgaggtctgtagcagtgaattctgagattttagtgtacccattacccaagcagtgtacactgtacccaatatgtagtcttttatccctcatccctctcccaaccttccctctgggtcctcaaagtccattatatcactctgtatgtctttgcatcctcatagcttagctgaatcaagatatattttaaaggcaaaaatgttaacacttgataatggattggatatgtggcatttagagattggataggttgggattttttaaacgttctgatttgtaatttatgttggaaattgtccaaagcactttcattaaacttctgatttctcaaaaaaaaaaaaaaa

SEQ ID NO: 19271 - DNA, 1282 bp, Homo sapiens
ttgggccaggaatacctcaggtactttttcagcgtgatgctccagtccgcaacatctcccctccacatcaacaaagtgggactgactctctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagtcagcctgggacctcccaaagtgggcggcttaccagaccacccttaaatgactttcatctggtttcctctttcaccaaaatatactcgtattttttatatttcttccatagtggctggctatattccaagaaaagccatttaaactatttcattggatttttttcctttttttccctcatttgatacagaacttttatataaaaccccaaacactgatggttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaaa

SEQ ID NO: 19272 - DNA, 743 bp, Homo sapiens
aggagctgtaacaatcaccgcgaaggtctgcagcttcactcctgaggccagcgagacctgacacacctggaggaatgaacagctctggatgggaggaacaaacaactccagacatgccgccttaagagctgtaacgctcaccgcgaaggtctgcagcttcactcctgaagccagcaacaccaacaaacccaccagaaggaagaaactctgaacacgtccgaacatcagaaggaacaaactccagacgcaccatttttaagaactgtaacactaactgcgagggtccacggcttcattcttgaagtcagtgagaccaagaacccaccaaatccagacacaccaccatgtcacttcctcaacacatggggattagaattcgatatgaggtttgggtgggaatgcaaagcaaaaccatatcattctgccccagcccctgccaaatctcatgtcctttttacatttcaaacccaatcatgtcatcctgcattagtccaatctcacaatgctataagaacatacctgagactaagtaatttataaaggaaagaggtttaattgactcacacttgcacagggctgggcgggcctcaggaaacttacaatcatggtggaaatagaagcaaacccatgctttttcacaaggcaggaggagagaaaagaatgaatgctgagtgaagggaaaagcctgctatgagacaatcggatcttgggagaactgactatgatgggaacagggtggagga

SEQ ID NO: 19273 - DNA, 496 bp, Homo sapiens
ctaggaattgcttgaggctgcctgatgacacgtactctgtgatgaagatgacctgcacggtgcgagctcaggatttccaccagctgcgggttcgtccccatgcccgccccacctagctgtggtctctgcctgcccggggccttgcccgtgctcaccctcgcgcaggcctcagaggtatccagccagtacttgtgcaacttcacgatgttcgggtggtccaccagcaccagctgctcgaacacggtctggatcttctcctggggagggagggtggtcgctgggtggtcagcaggtggtcacccaagcaggatgaggagggggcagcggtctcacctcgtgcgccgcgaaggccttcctgtctccgaagtggagctcgttccacaccacttctaccccctcctccgtgtccatggctaggaaggtgctctgaagccctggcatgttcccttggtttacctgggggtgaataaagggttatgtgtgaaaaaaaaaaaaa

SEQ ID NO: 19274 - DNA, 775 bp, Homo sapiens
ttacaattttgcaagtataatgaaatgctgtacacataatggactagaccctgctgtgtccaagatggtttgctattaccagcaatgccacttctgggtatctgttcaaaagaattgaaagcaggatctcaaggagctacttgtgtatccatgttcctggcagcactattcacaatatctaagaggtagaaacaaccgaaatatccattggcagatgagtggataaacaatatatagtatatatgttcaatgaaatgttattcaaccttaaaaaaagtaaatcctgcaatgtgtgacaacatagatgaaccttgaggacattaaaataagtgaaataaatcaatcacagaatgacaaatattgcatgataccacttatatatcttaaatattcaaattcacagaagcaaataatagaatggtggttgccaggagctggaaagagagagaaatggggagccctaatcaagcgatataaaatttcagttaaaaaagatgaataggttctagaggtctgctatacaatattgtgcctacaaatgataatactgcattgtatactttttaagctgttaagagggtaggttgcatattaagtgttcttacaattttttcaaaaaaattaactcaatacaaaaaataatgtaaaagaagcataaaatatatctaaagaaaattaggaaacatgagtaatataaaggaaaaaccaagaaccttataaaacaaaaaaaaaatttaatgaccagggtaatagggattaaaaaactaagatggaa

SEQ ID NO: 19275 - DNA, 707 bp, Homo sapiens
attgctgggaagatcaaggaagagaaaatgaataatatatgtaagagaactttgcacactacatagccctacacagaacgcattattaccaagtattttacatttataaagtgcttttcaaagcactctccacttaaaattcaattcacaatcaccagctaaggctgaagattcagacacaaaatccccgcctgcatgaagctcatgttctggactccagcctgggtgacagagcgagactccatctccaaaaaaagaaaaaaaaaaaagaaagtaacaaaccagatccagcaatatgtgaaatggaaaaaaacaagtccaaaatataaatatttatcttgtatgaaattctagaactaaaaaacatttgaccccttatctctttaaattgtacttcaaaaaatatataacaggggctgtctttataatagagtaatatgtttattgtatctgttttgaagatatactctgaataatcccttgttccacagttcaaatctgaggtaacattgaagacagaaaacaatggtgacattatccccactcccttaaggccagccctgcaatgatccggcattggaaatgctgctgctttacttcactaaatgatactttgttttgcaatttactgtgaattacatagcttaatctacgcaataacaatcctgaaaaaagaaatgtttctggtttatttctggaatttaaat

SEQ ID NO: 19276 - DNA, 362 bp, Homo sapiens
gatattttatttctgcgaggagctgctcccactgaccagaaaataatgccacaaacaacttcagcaacatccttactacggcccatgatcccactggaagtgaaaacattgtttcctgttgctcaagtagaaatatcttaaggacggtggtttctggagatactaagatgatcttcttgcagactgacaggcatctagatattttcccaccattccaattctttcttcacctgagaagagagagaatccattatttgtcctattgcttttgatatatggtttgaagtctctagccattctgctaaagaagataatttttatgcacttaataaatggaagaaaacatctcaaaaaaaaaaaaa

SEQ ID NO: 19277 - DNA, 801 bp, Homo sapiens
tacagacgcaggcagagatctggcacagccactaagatgaagcagatgtccagaagagccaccactgtggccaccagcacaacgaggctgtctccgtaactggcaggaagatatgctccaatggccgggctgctgacaagactagccgcaaaggtggctgagacctgtgggaaagcacactctcacccagggtcccataggtgaacacctctggggaaagcatatccttacccaggtctgcctgctgcaggtgcacaccttcaggaaagcacactcaaccagggtcccacaggtgcatacctgcagccatgcttccctggctttaagtgagacaaaagaaacgtgttgcatataaattttaagaatgaaagagaattaaagtgatttaagaatgtgttcataaactattaactggagataccctgcagagctacaagagtaaaaaaggattatcttattacaaacaaaaattgtaaacaccttccccacaaataaaacattagctctttggtcttctttaactggggaccggggatgtgagatggtatgaaaagaattcctgcagggctgatgataaaacttacaaactactcaagtactgtgcttgatttaatcttctaaaaacactgcactgtttgaacattttatcatttggtgggcatgttattatctatgccttgggttagggtgaaacctctggtattctttagaaaaaaccattttcacagcaaataatttgttgaggggaaagtggaaattttttgaacagaacgctgtgaatttcttgctttttgtacaacc

SEQ ID NO: 19278 - DNA, 348 bp, Homo sapiens
tagcgctggagtgcagcggcataatcatggctcattgcagctcgacctgccaggctcaggttatccacctgcctcggtctcccaaatgccaactgtggggggaataaagttgcttagcaacgtggaaatgggagaagctataaggcttcccagtgttcacgcaatcgtccctatttctgtgcctcttctacctttcgtcccagaggttaactggtgctgtgaattctgaaatgtgtcagacccacactgcagtctgaaggctctctcgacctacgcttgctccatctcccgttcatcctccatttatgtttcctctaataaattcttgcacatctaaaaaaaaaaaaa

SEQ ID NO: 19279 - DNA, 491 bp, Homo sapiens
ctgacggaggcttgctcttgttgttcaggctggagtgaaatggcgtgatctcggctcactgcatcctctgtctcagcctcccgagtagctggaattacaggcaccctccaccatgcccagctaatttttgtattttcagtagagacagggtttcaccatgttggccaggctggtcttaaactcctaacctcaggtgatccgcccacgtcggcctcccaaagtgctgggattacaggcgtgaaccaccgggcccagccaagtgttttaatttttaaaaactatttgaccatatgaaaatatagatgttccattaaatatatatagcctaagaaatataatcagcaatgcagtaaaagattatgtatacggatgctcctgacagttggatttgcaatagggaaaagctggaaacaacctaaatatttgaaaaaagagagtggtaaatacatcaaaaatacaataaatacagtgttaagtgaaaaaaaaaaaaa

SEQ ID NO: 19280 - DNA, 641 bp, Homo sapiens
ttagttgacctgcctctgttttttcctcgagaccagccaactctcacatttcagtccgtttatcactttaccaacagtggacagctttactcccaggcccaaaaaaaattatccgtacagccccagatgggatggaaatgaaatggccaaaagagcaaagtaagtgaatctgtcgttatttccaacagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcattttgctcacacagcagcttttgcacgccccaggcagccccgactgctgaaatccaacttgagctggctggtggtccctggatcctagagcccttcacttcgggttactccctctttcttgcctctatttcttagttgggagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaa

SEQ ID NO: 19281 - DNA, 686 bp, Homo sapiens
cctgcctctgtttttccctcgagaccagccaactctcacatttcagtccgtttatcactttaccaacagtggacagccttactcccaggcccaaaaaaattatccgtacagccccagatgggatggaaatgaaatggccaaaagagcaaaaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcagggacgcccacgcctttcttccaaagcctttgtctctgagacctcttaagttctaagattaaatgcccctcgctgttcttcctctgaaaaaaaaaaaaaaa

SEQ ID NO: 19282 - DNA, 1201 bp, Homo sapiens
cagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagtttgggactagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgtttttattttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaa

SEQ ID NO: 19283 - DNA, 793 bp, Homo sapiens
tagttgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacaaccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggtatgcccacgcctttcttccaaagcctttgtctctgagacctcttaagttctaagattaaatgcccctcgctgttcttcctctgaaaaaaaaaaaaa

SEQ ID NO: 19284 - DNA, 625 bp, Homo sapiens
tctagttgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaaaaaaaa

SEQ ID NO: 19285 - DNA, 455 bp, Homo sapiens
ctctcaatcaaactaatttccagctttgattaataatcacagcgtaattcggcctctggtaacatctccgttttcagaagctcagaaaagtaagctgcttgctcaagaatggacggcttcaaggtggcagagctggaagtttctaactcactcacctcatactcagacctgcactgtttttcaagacagtcaatatttcaggccatctactgattggatgaggcccaccagcattctgaaagacaaggaatctgagacctggctgggagaagaggacttgcctaaagttatcccacacagcaaattagttggaaaaccaggatagttgagtaaatatcctggagcccagccaagtaatgaagccagaattcagaaagctgttttggctagatcttggatttttacaataaagggtctgtaagggatatttgtgaaaaatgttaaaaaaaaaaaaa

SEQ ID NO: 19286 - DNA, 931 bp, Homo sapiens
catgtttgcttccccttccgccatgagtgtaagtttcctgaggcctccccagccatgtggaactggacatggtcacccaggctggagcacggtggtgcaatcacagctcactgcagcctcaaacttcaaaggatcctcacatctcagcctgctgagtagggcctctcagcttgtggcatgattcactgaaatacatcaaacatgacagaagatgcaagcatttggagacttacatcagccatcatcaaattaaaaagctaaaaagtgctatcagctggcttgctcatcattgagagacctgaagtgatggatgatggagaggaggttgctgtgagggtagaggtggctcagtaccctgcaggagcaatgcaaagagagactgtgcccaagaccatctccccgggggggatgggtggcattcctgccttccttccaccaacaaatgttgactgtgccatgcactgggatgacagagatgactcagatgtgcccttgttctcaatgtgttcatggttggatgaggagaacaccagtcttactctagagactgaaggctaagacaaagactccagcctcaaacttgaggaaggaagttcatgtttcttcctgggttggccaatagaaagtggtatttgtggccggacatggtggctcacgcttgtaatcccagcactttgggaagccgaggcgggtggatcacgaggtcaagagatcaagaccatcctggccaatatggtgaaaccctgtctctactagagatacaaaaaaattagctgggtgtggtggcatgcacctgtagttccagctactcaggaggctgaggcaggagaatcgcttgatcctgggaggcggaggctgcagtgagccaaaatcgcaccactgcactccagcccaggtgacagagtgagactccatctcaaaaaaaaaaaaa

SEQ ID NO: 19287 - DNA, 917 bp, Homo sapiens
gtagtggtattatggggttgtgggtggtgggtagtgagggggtggcttggtaagctacgcaaaaatgaaaacttgagcaggacttgttctgggacttgtcatctttgatgctgctgtgactgccccaactctagagtccatcaaactatgactcagaaacctatgaacaaaccttagaagccctggataatttgtaccactatgaaaacattcctgttgataaagtgtgaggatgtagtgggtgtgaatgttggggggatgtcatcagtttgtggcctatgttggttatacatggtgcgtcgggatgggtcgatgtggaatttcatgataagaggttgttggggggaggaagggatagatatatggggagaagcgcgtactgctgtggcgtctagagattcggtaattgtaggggggtaattgtttggtgtttgttggcttcattgtggagcttgtggtttgggggtgtagggtgggaggtgtcatcttattagattttatgttttgcattgtcaggtagtgtcttcaagtcggtaatgggggttggagaggggaggatgacatgagttatcagtaaatgtagaaaatgttgtgttttattggtgatatatggagagagggggatgcgatggtgaatagtgtaggatgggtgagggatttcggttggtagatgttggtggaggtgggcgtggtttgggggaggagacgggccggggggaggatctcggagtatcttgttacaatgcgcgtcaggatgtttgtgatgcgagagtagagtgattcatctgtggaacaggatacagaagataagagaatgggtagagatagcgacgaagttaggagttatgttgtaggggttggggatgtgaatgatgggtgtgtaggttcgggtgggtggtgtttacggcggtttatat

SEQ ID NO: 19288 - DNA, 802 bp, Homo sapiens
  misc_feature (1)...(802): n = A,T,C or G
caggtattggctgatggcaagcattgtacttttccacatctgcctggcaaaacctttgtctataatgcttctgaagatagactggaattgtgtgtggatgctgcaggacatttccccattggtcctgatgttgaagatttagttaaagaggctgtaagtcaggttcgagcagaggctactacaagaagtagggaatcaagtccctcacatgggctattaaaactaggtagtggtggagtagtgaaaaagaaatctgagcaacttcataacgtaactgcctttcagggaaaagggcattctttaggaactgcatctggtaacccacaccttgatccaagagctagggaaacttcagttgtaagaaagcataatacagggacagactttagtaatagttccactaaaacagagccttctgtattcacagcttcttctagtaatagtgagcttattcgaatagctcctggagtagtaacaatgagagacggcaggcagcttgatcctgatttggttgaggcccagcgaaaaaaattgcaggaaatggtttcttctattcaggcttcaatggacaggcaccttcgggatcaaagtacagagcagtcaccatctgatcttcctcaaaggaaaacagaagttgtgagttcttctgcaaagtctgggagtcttcagactggtttgcctgaatcttttcctttaactggtggtanctgaaatttgaatacagaaacaactgatggctgtgtagcagatgcactgggagcagcctttgccacaaggtcaaaagcacaaaggggaaattccg

SEQ ID NO: 19289 - DNA, 666 bp, Homo sapiens
  misc_feature (1)...(666): n = A,T,C or G
agaaagggagaggagagtcatggaccctactttatggttgccatggatgcaagcctcatctccattcctttctactttgaacatagcaagtcctggaggctgctgggtcgtcttccagccacaaggtggctcccccaatcccttctctcaagccaatcgatgtacacctttgctgagttctccaggcggactacaattcatagctaattatgatctataaatgccattattttcattgtgaagtaaatggcttatgaccaagaccctggtacactaagatacaatgcaaaattagtctttaaaaataggagaaagaaaaatacctttgtatttgcctaatttctcttcacccatccttccaaaagtacaactgagctatccttagagtaaaataagaaaaataataaaaggctccagaggaacctaattttgttgtcaatgaacatagtcatagactagacaaggtcaaattttaagaaaagtatacaacttattctcacttaaactagacctacttttggatttgatattctaccacaagagagttttgatgagaagactctgcaaaactctcttagaagtnccacatcacgccatcattgaagaacagtgatcntcaatacntgcaggcctttaaaaggagtggaaatattacatatttccttt

SEQ ID NO: 19290 - DNA, 888 bp, Homo sapiens
tttttttttttttttttgaagcagtgaaagcagggatctattcaaacatgaaagcattctacagggtgggaaatctttatgggaggcagagggactgatggtctttccttctgtaactgcttcatgctgattggggcatagtccctacctattgtgaccacagaactctcgccctgctctgtctaaaggagatgttagtgccagaggtgtttgaatcagaccaattccatcttgagtaggggctgggtaaaatgaggctgagacctacggggctgcattcccagacattaaggcattctaggtcacaggatgagataggaggttggcacaagatacaggtcataaagtgtaggagatcggtcaggatggtgagaaaaatcgtagaaagatgcaaaccttcttggaaggccaggaggttttacaaaagcttcaggaaaggattttgctgaaggcagccagcttctcttatcgggaggcataaataattcacaatgcaataatatctaattatagtttttagcatataaatcaagatataccgtaaaaaatggacatccaccagccctttgggctactgtctctaagaagtaaccatttttaactcccccccttcttaaatacagttgttttcgctttaaagactcgctctgaattctttcttgcatgagatccaagaaccttcccttggggtctgcgtcgggacccctttctctgtaacaataggaggcctgagcttgttctgattagttgtccatcttgggcagttagggtgagtatcatctggaatttgacagctgataaattattagttccatatcagacgagacaatcaggatagaaagtctgaacttttcctttttcagggcctgtttccattcaggtatgtca

SEQ ID NO: 19291 - DNA, 563 bp, Homo sapiens
cgatcagcatttattggctactttttatacataaagcatttagcaaagaatttgacacattgccccatttattcccacaacagccctatgaggtagttatattattgtccctatcttacaaatgtgggaactgagagcagagattgattaactgtagcctgtgggccaaatccagccactgcccgttgttactggaacatagccttgttcattcattcatgtgttgtctatggctgctgccatttacattgagtagttgcttgcagcagaaaccatatatggcctgcatagcctaaaatattcagtgtctaaccctttataggaagagtttactgacttctactctagaaggttaatttataaggtgacaaaactagttatggtggaggcatgagtccaactccgttcagtttgattccaaagctcaggctcttggttgtcacatactcccactggaggcggtggattttcattaagtggtcgttagacaagttctggtgggtgggaagtccaagatcaaagcgccagcaggtttgtagtctagtgagggctgctctctgctt

SEQ ID NO: 19292 - DNA, 822 bp, Homo sapiens
  misc_feature (1)...(822): n = A,T,C or G
agtatgccacatgtatgctggagaaatgtcactgctagagaacagaagactattattccaaagggtatttgagactgactgaatcaggtctggaacattattgaaatgtaattcagcatttccagtgacatccttctggctgtgcttcaaagggaagatgacgctagagctggcagcatgaccagcactgtgtaaatcacccagacagacaacaacacaacatccatgaatagatggcagagttagcaagaaaaaatagcttggaggatggaaaaaccccaaaggtgtgaaatctctggctttttttccattttatttagctttgcttatcattatttttcttttctttcctacccatttgcctttatgttctaagatgtagtaggaatctttagtagtgatggatcataatttttgagtccacaagcagacattatctgatttaataaaaaaattggaaaggtggaccttacccatttagaacaacttcttattagcaaatcaaaactctgagcaagagtcttagagcagggcctataaaatgagaagggccatgtattagagagttagctcagacctccagagtcagcctcacctacacttctgacttaggccaggctacaggtaagcaggataaacaggaacatctagttctttgttttgtatcataaactacttggataggaagttgtcttgttagaacatgccccatgtttccatcatcttgtcttaatattgattacacccaacaaaaaagacaatagcactcacaagttttcagcataaagagaaaatgtggtgtcaccattgaanaagccagag

SEQ ID NO: 19293 - DNA, 438 bp, Homo sapiens
atgtctataagggagaattccactacctgactttcttaaagaaaaaccacagtgtctactatggtgaggaattagagtaagtcctcaggagtcacgggggaaagaaagacctcaaggagctcctgatttatccagaagaatccgaccacctcgtgcagacaaggggacacagagctctgggcccaggctgggcatgatgtcccagaaacctgggcagattcatgaacagactgacaccggctgtggaaattggagccagagaatattccaagaggctgtcttgaaggaatataaaatccaaaagcgcccaggtgcggtggttcacgcctgtaatcccagcactttgggaggcccaggtgggtggattgcctgaggtcaggagttcaagatctgtttagccaacacagtgacaccccgtctctactaaaaatataaaat

SEQ ID NO: 19294 - DNA, 550 bp, Homo sapiens
gggaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccaggtcagcataataaatgttcattatcattttaaaactcatgagcaatttttgtaaattattgtgataaattccaataggtataacttcatttaatgattttagtttctaaacttaaacacgtgtgttttcatagttgtatatatctgtggatcatgatgtttccatcattttatttcccttgtgtactccagattttgagaccttttatctacgaaataaactgaga

SEQ ID NO: 19295 - DNA, 431 bp, Homo sapiens
tttccatctttaccaagcagcagttgtaacaacccaactgtcctctgtggggcaaaattgcttcccttgagcacagatctataccacaccagaaggagattcccaaagccacccaatacgttggagaactaagagcgttccctacctgccaagaagtctctgctccattattccagtatggagccacagcatggagcacagctttgcagtccagattgcagccgcttgtcatgaatatgttacctactttttcctctgtttcccgccttctgtcatctaactctttctggagcatgggaccagctttctgcaaaaatgcccgagatagtggtcctcctccaagctgaagattcatgggaacgctgttgacaatgacatcggccttaacgaaaatagcaacagttagagattgaatcaataataaatactga

SEQ ID NO: 19296 - DNA, 428 bp, Homo sapiens
gagagctccccgctgaggccacgaggccatgggtttattttacttaacataatgtccttcaaattcatccctgttgccataagtggcaggattttcttcttttcaggctgaatagtatttcattgtgtgtgtgtgtatatatatacacacaatttgctaagcagggagatccgcagaccctcttggctcccagcatgctggggtcaggtttgcagtcttaggagatcggtgaactctttttggagaggatctgcaaataccaacagtttcagggtttcctcaggtccaggagtgccaggctcctgtgcactcttcctgtagtcccagctactcaggaggctgagacagaagaatcacttgaacccaggaggtggaggttgagcccgagattgtgcccggcattccagcctgggtgacacaacaagact

SEQ ID NO: 19297 - DNA, 447 bp, Homo sapiens
  misc_feature (1)...(447): n = A,T,C or G
aaatcctcctggggccttcggagatccttccatctggaccagtgcacagaattccctttacatcttttgggatacaccctaaagaagatccaatctttgttcaccttcacgagtttcttcaatgtgaaagctacaggaggctttgttcaaagaaactctgacccagaaacccaacatggaagcaggcagagcaggacacttttatcttcaggtggctgggggaaaggaaggcttcacaaggtgcacactaaaaaccatgggcctactgtgactgacgccatgctccacaggacagcagaatggctcaggagctgcctccagaatcatatggcaactagttcaacagaactgtgatagacttggaaatgcatgttttgaagagctgtcattcacagcagcttgaaaaagcccccacnggccaaatctngtacnatctgagcggccaaa

SEQ ID NO: 19298 - DNA, 878 bp, Homo sapiens
  misc_feature (1)...(878): n = A,T,C or G
acgccgctctgtctttattatttttagactgtgatattttatttctccttaaaacatattaattatttagaaattacaaggcagaaaaaaactcacatttactcatttaaatactactagaaattaaatgagaatttaatcaaattaatatgcactataattaatgatttgtgcacctcatgaaaacataatgcacctcacgaaaacataatggaatcggtatgaaatatgattgtgatttgaatccttcagcaaattactaggtaccattgactaatatcatccatcaaaaggagtaaacatacatctataaaagaaacattatttatatatcttacattttttcactaggctcaatattttggtgattcctcagcaaagaatttgtcattactacttccttaaatgggattcttatggtgggaatactgcttgccttgctgtcttctctcttctgacatactaatatttcctgatgtcttccttccatattttcacatgtggcggatttgcttaatgggggagggctggagacagagtccatccatttctcaggaatatctggtgagtctggctcactttccgtgcacaagagtagaagactccattttgcagagtgctgtcactgtttgtaggggcccaaatgatttttctggggcttctgattcatctttcttggggataggtacatcccctcgtcgtgtgcatgtcggnattcagactaagtatcatcaattcttaaaataatgacagagattttctgcatatccaaggaaaaactctcctttccagtatataatttcaataacaggtgaatctcnaatcganaatgcaaaggccggaaacctgtgganccanngatgggtctcnggcgnttt

SEQ ID NO: 19299 - DNA, 409 bp, Homo sapiens
cctcgagctgtggcaggttttcgagggacagttcgttatgcatcaatcaacgcacatcggaacaggacaaccagatactgcctcctgatgtgattcaagaggaagcatacaacccacctctgaagtatccttgcaaagtaaaactggaatcttatataatcatcaatttatagaaaatacaggggacagaaatacatattaaagacaaccacagggaaacaaccagcaaaatccagaatatggtaatgtgtgcatgtcaaattcctccatttttatcaacaacaataaacacaatgaaaagaaaattgcaagaaaataaaagacagagggtgaaccaattgattaaaagaggcttaagagataagcaatgtgtgaaccctatttggaactcaattcaaataaaccagga

SEQ ID NO: 19300 - DNA, 381 bp, Homo sapiens
  misc_feature (1)...(381): n = A,T,C or G
gttgttaaaggactccagtagcaaagatcaaagtctccgaattttgcctttggagaagggggtttcatttcagacatcaaagaaatccaacgcagaaatgaccaacaggttttcctaccccctcaggctggtgagctgttcctctgggcttntagaggattctgtatgactgcaatcattatcaattttcatactatattgcaattgtacatttcacttgcctggctttagggacaaagacttgagactttgatcttgccttgtactatggagccaaatgcagggccttccatccactcagtgctcagtttccatgtctatgtgtatgttggacaanaaaaananaagtctatgtctcagttgagatnnactgaanaaaac

SEQ ID NO: 19301 - DNA, 502 bp, Homo sapiens
  misc_feature (1)...(502): n = A,T,C or G
tagagacgggtttcaccgtgttagccaggatggtctcgatctcctgacctcatggtccgcccgccttggcctcccaaagtgctgggattacaggcatgagccacctcgcctggcccacatgctatcaaatggacccggtggatcatccaaacaaagaaattctctcactgcaaggcttttcaaaggaaaaaaaaatgatctgaagtacaaataagtttgcaaaagatagcaaaaagcaaaagttactttgaagctgtacagtgttttaaacaagttggttatgtgttttcatacaagtaactaaatataaatataaaactatagaagatgcaaagatcttaaggtgttttctaagatcttagaacataaatatcacaaatttattgttacatacaaactacggggcataaaacatacttcacaataatggttcaagagaccaacatagtgaatagcctctttatnannanaaaganatattagtctgaactaggggnnagtt

SEQ ID NO: 19302 - DNA, 190 bp, Homo sapiens
aggtctgtgattctcaagccatgctcttgcagggcactgatattcaggatgcaggagaagagtactttgcaattaaatcagagtaaaagcagatgcggccgcatcatggaggtccctggattgaaaaaggagcctctcccactcctcctaccaccgaagtggttaggactaatatataaataaaccaaga

SEQ ID NO: 19303 - DNA, 247 bp, Homo sapiens
cttcaaaatggcgagaagataatgagaaaaggaaagaatctatggataagaagtaaggagaaaatcgttgacaattgtcaaaatcttgcctcattacttctccaggaatgatgtctatccttttcttcaaacacgttctgtattctaggaattctgaattattttggattagccaaactcactataaactctactgtaaagaaggcattccaagagaaggaacaacgtgaaaagaaacaaacaaaga

SEQ ID NO: 19304 - DNA, 185 bp, Homo sapiens
tcggtatttatttccacatgttcttccaagtccccattcttgaataagactctgaccaaaattgtctttctcatagtcctccactttcctaaatcccatgttcactctatgtcctgtctttcatttcaaatggtttcaaaggacagcattctggagtgtcacaatggaactctgcctttggacag

SEQ ID NO: 19305 - DNA, 275 bp, Homo sapiens
taactatcacctttatttcaagacaatttacttgtgtcacaactcttaatatattgtctctcctcagcaggttaaagctgcaagtttctttcctggacaatggcaaatcctccaattctaagagagaaaaaagacagagagataggagagagaaagagaagagagtttacatttgaaaatacattccatatgaaagaacaataagagagaatattgtagctttatacaaaagggtcaagaaacatgaaattgaactacagaaaaagcagaacaag

SEQ ID NO: 19306 - DNA, 910 bp, Homo sapiens
atgcaaacttattttagaagaatcaaaaactggatggcccaaaacccaatggttcttgacaagtcagcttttccagacctagaggagtcagactgctatactggccccttcagccgtgcacggattcaccacttcataataaataataaagacaccttcttcagcaatgctactcgaagcagaatagtctatcacatgctggaacgcaccaaatatgaaaatggaatatcaaaagtgggtatccgtaaacttataaacaatggctcatacatagcagcgtttccaccacatgagggagcctacaaaagtagcccagcccattaaaacccatggaccctcagaataacagacatttatataatgagcgctgggcacgctggggaatgtggtataagcatcagcatctggaattaatcaggctgtactttggtaagaagattggactatactttgcttggctggaatggtatactggaatgttgattcctgcagcaattgttggtttgtgcgttgtcttctatggattatttacaatgaataatagtcaagtaagccaagaaatttgtaaagccactgaagtctttatgtgccctctctgtgacaagaactgctccctgcagagactcaacgacagctgtatctatgccaaggtgacatatttgttcgataatggagggacagtcttctttgctatttttatggcaatatggggcaatgcagtgaacattggcatcctcatttaattaaaaccactgtgcccaggtgaagtattgaaaatagattttacctggttcatttctgtcgtcataaagtcgccgatgggaaaatgaatccgttttcctttttccacacaacaagtagcccacaagagtaagcaatgagacacacagaataaacaccgatcggccag

SEQ ID NO: 19307 - DNA, 501 bp, Homo sapiens
cttctccagctttctggcaataccaaggggcagacccgggaatgggttgttcagtcactgccgtaccgcccatgagcggcagagggcagcaaaacacactcatcggacgggcatcaagggagcctgaggataaccagagcttgaaaatgcaatcaacccatgaaaatgtttttaaagaccatgattctgttcatcaaggagacatttaaagttataagaatcatctgaagtatgaatgaatatcgtaaggatttcaccaaatctatacagttcattccatcgtcaacatctaaaacaatgctgaaacagagcaagctttccagtcttactttacgagcaaaatcaagatctacatactacaactttcacttacgtttctccatctaacccatcctctctttcaataactgtaactgtttgattgaagactgcatcttggaatacattgccctgtttaagaaaataaaataatcagaaaaatctaaatgcaataaaggaaga

SEQ ID NO: 19308 - DNA, 191 bp, Homo sapiens
agcatacacggacctcccaaaatgctgggattacaggtgtgagccaccgcacccggcctgatgaaaaacagtgacaccaatgctatgattcctgtccgggactcctccttcctctgggcctctaacgtttagatgcttaacactgtacggtggtacattcattcattcgcttaataaaaatggatcggccg

SEQ ID NO: 19309 - DNA, 593 bp, Homo sapiens
cggcccatccacgtttattatgaattttttcaatgtaattgcagtgtaatttatataatttacatacaataaaatgcatccatttaaagtatataattcagtgagttttgataaatgtgtaacaacataaccttgaccataaggaagatatagaatatttctgtcacctccaaaagttctcttgtgccattttatatggatctaatttccataattttaggttacttttttcctattcttggatttcatataaatgaaataatataatacatacttttccacaaagcatgattttgaggctcacccatgctgtcgtattagtagtttgttcctttttatcggtgtatagttttccattgtgtgattatcattttgattatacatttgattatccatttgatttgattaattttattatccattcacctattgatgaacaggaggtttgatttgatttgattatccattcacctattgatgaccaggaggttttcaattttgggctatggattagggtgatatggacttctaagtccaatcctgttggtggccatacatttcattcttgttgggtgaatatcgtggcccggggg

SEQ ID NO: 19310 - DNA, 361 bp, Homo sapiens
atcaatctggggagaattggcatctttactgtgttgaatcttccaatctgtgaacatggcctctctgttccttgagacacaacaatattgaaattgggccaatgaataaccctacagtagcctatcattcactttggggaacggaagctgttgtgagcaaccctatgtgagcctcctgtcctcagctacatcgatgagcttggcagtgaattatctagtcccatccaagcttccagaagactgcagccccagctgacagcttgactgcaacctcatgaatgtttctgagctaggaccacccagttgcttctgaattcctcaccctcagaaactatgatacaataaataccgatgctggccg

SEQ ID NO: 19311 - DNA, 791 bp, Homo sapiens
caatgaatgagagttcctattgtttcacctgctcgccatcatttggtgttttcagagtttgaaatttgggccattataatggagtatctgtctcttggcttcctgagaatctgtcgtgattaaatagtgaatgaaagaaactgaatggaattttctgtaccattgtgcccagaattggttccttccggtgggttccttgtctcgctgacttcaagaatgaagctgtggatcctcgtgagaacagagaaaaactgttttctgaaaagcaattctgcataaacattgacattaacaaaaaacacacctgcttggaaaagaggataacatgttggacaatggttaaattatatttactttgatatgtctctggaggttaaatcaatacctgtatgaagcttgaagttcacatttattatggagggcacttgtaaaagtgtatctgaagcctgtaagaggcagaaggactcagtcatatgctgccttctgtgcctgatgttttcttttgactctagggagagacgtgaacatacagtctgttattgtagtttatgcacaaaaactcaaataagaaagatgtgggtgtatgtataagaaaaggtttagaaagcttggcatattttctatgaatgttaagaacttgtattactgtaattctgtaagtctaaatgcaatcgaaggacacaaacatctctatgtataatgagattaactgaaacataattgaacaaaactggaaataaagaaaaatctatcaaataaaaaaagattcgccctgaggtttgttccccccc

SEQ ID NO: 19312 - DNA, 242 bp, Homo sapiens
ctccctacagcattttttagaaggtaccaaataagaaaaacgtggatgaagatggagaaagcatacaaaacttttacacactgctttgaagctgtcaccgcgcggaacataaagaacaggccaagaccagtgcaggcatcgacgactttctccattcagagcctccgcgcatcccaaataaataaacatgtagcaggtataaatcggataaaatgatgagggcagtcgcaaacattgaggag

SEQ ID NO: 19313 - DNA, 413 bp, Homo sapiens
cgccatcttatgtggcacagctatagccgatcgggcgatcgtgaatgttactacttcgcgtggggtggcgtgacgtactctaatacctcctgccgcggcgttgatctctttcggcgcttttatctacccggcgttgataatgtataacagtgtgtgttcatgttgttcttccgcattcttctcccctgattgttgctcgacctccattcacttaccggacatccggggttccaccggtatacttcagttcatcgagctctttcagcattctcataggcataccgtggtccccgtctaattttctatctaaaaccgcgggagggggcagtaatcctaatctacggttacacagagcgtatgtctgcaccgtatagacgagcgactggtgttgttgcttttttttacctaatatc

SEQ ID NO: 19314 - DNA, 764 bp, Homo sapiens
ctggccgatcttggttttgggttggaagaatttgaggagaattgtgggcttgcaagctctgatcagcttacttgctgattcacagataccaccattgctgcagccattcctcagtttctctttcctttatctccacgccctctcactgcttaacgggaactctgccatcagccgtctgatgctcaccacttgcaatggacagcccctttgatgggcttgttcttttccttactaagacctaaacccctgtgagaaaaagttctagtagatgtggttgtttctcacacatgctttctgatgaattatgacagtaacaattacatcctgatctcatcagctgttgcactgctaagcagagaaatatcttcctgctgttccatcaccctcaggattcaaacacttaatgcaacttaaagaaaggagcccgaggtagagtgggtggaaggcccttgtgagagcacatcaccaggcacatggggatggtgtggctgcctgactgagggtaatatcacctattgttgtggttgaaatgacagcgcttccagaagggctcagagtggttgtttcagaggcattaaggtaggcatctgagatagcattgctgcctggggtagggttgagttttgcattggcggcggagccgctgaatgtctgcgtgtcagttccagcagagggcgtctgcgagtctgcgtgcgtgggaaggtgaggcgtctgtactgatgaaacaccagtgggggaaggtgttgggctttgccctgggatcc

SEQ ID NO: 19315 - DNA, 183 bp, Homo sapiens
ccagcctatacctttaggtccagccttgtatatccaaatgccagtaccatatatatttgggtatttactaggaaatgatttgcagctgagtgaatcaggaagcgacagtcatgactgaagaaatatttagctataaataaaaatttatacagcatgtataatttattttgtattaacaataaa

SEQ ID NO: 19316 - DNA, 654 bp, Homo sapiens
  misc_feature (1)...(654): n = A,T,C or G
cctcagaggaaatgctgtcattctccaccagaagtctactcttccatctgctctgttgatgccattctctccagcctagtcagaaacaccatcacctaattcagtggtccccaacctttttggcaccagggaccagtttntgtggaagacaatttttccgtggaccaggggggttgggggagatagtttcagaggctttagattctcatacggagtgcacaacctggatccctcacatgcacaattcacaataggattcgcgatcctatgagaattgaatgctgccattgatctgacagaaggcagaattcaggcagtaatgctcgcttgtcccctgctcacctcctgcagtatggcctggttctggcccatggcccaggggttggggacccttgacctaaatcatcactctttatagaatgatacatctctcttttcccaggggcatctttccctttgccttcaaaactgcacaccttcatctgaataatgattaaactctgctgctcaccattaaaatgggctgattgctccaagcagtatctagaaagaaactgtttctagttcttcacccctaatcatttttctagatttttgcaaagaataatcattaaatagttcatatgtataagaaaataaacaaagatcggccag

SEQ ID NO: 19317 - DNA, 745 bp, Homo sapiens
cttcctcagacacacaccgtgagggagatgggactcccctgagaccatcataccgcggagaggcgggacacccccagccagcctcacccacaccccctgaggcgcagaaggtaagccactgctctacttcatggccacccctcctgttcaccacgatcagcggtcccacggggacatccgctacgtctgcaatatgcctgcggacacgcggaatggacgcctggaccactggctaatgacatgacgaatgtctactggactggctcgtagtgccacagcccccttcgttaccgcatggacacataccccccttacctctcccatgcgaacccacagtccggaacgcccgctaaacgaacatgacttgccgggactacctctgacctgctcagccctcgccagcctctcgcgtcaagaaccctcacccaccgagaccctcagactgtgggtcgtccgccgtctccacctgtacaccacgagtcctcacgcccgcgcgctcccctcccccccgcctccctcgcccccccctccacccacccaccccgcgccctacgacctctaccctactcatttctccatctccccttctcccaactatgcggctcgtcccctcgttccgtaaaccatccacctacctcctctctctaccacctccctcccacccttcccattacctacccccccctcacctttcttagtccacctcgcacccctcgacccccgccccctcccccccgccccccag

SEQ ID NO: 19318 - DNA, 851 bp, Homo sapiens
ctggacagcatccgtgtttttatctctggtaatccaaagaaaataggaatatcagtagcagagaggaagaccataatgaaaatggccacatttcttcacaggggcagcaatcaatgcagggggcctgtaagactaaggctgtagttttcagtttgtctgaatactgtaataacctgagggttaatttgaaggaaaatatcttgatgtcccggcatcaccccagactcctagagaatttggaagtagaactccaatatcaggacttcagaaaactcctcaggtgattccaatgtgcagcaaaatggagaaccaacaatctaaagaaaaatccatccaccaaaggccagaggaaacagacagagtttctgaaagtccatcgggcagcaaaggcccagccacattgggaagtccacaaggaacagaggcctatgagatgcagacttctaagggctctttgggtgggcttgaggactgcacacagaagaccatggcttggtcttgagtgatacaggatgtgctccttttgttgttccccagaatgtggtgaagtcattcagccagtgcctcttctgtcctatggcacagggcaacctgaatgaacacaggttgggcctcatcagacactcttgaatacaacatgccagcaggtgtgtgcttggctgctcaacagcccagctcctggcacaccacggccacatccttcatgtcccagctgtcatcacacacggtacctcagtgaccttcctgttccacttccactcttcctttgcagtggtgaggaccattaatcaaacggactttggtcgggggctgtgtagcggtggtaggttaagagagtcgttgcagcataa

SEQ ID NO: 19319 - DNA, 431 bp, Homo sapiens
ccttcgtgaccctgggagaaggtgcaccctagagagaatgtgtgcagcgggagcaggcttttttcctactttcactcatctccagccaccacccaagcgttgctacctgcaagaccttcacagaggctggtggcgaactcctgcctcaagtgttcctcccgcctaaactgccggaaccgtgggattataccgcctagctaccatgccagaccaaaattctaacgaggaatgcatatatcctcacacatgtagatgtgtgacgtggaatgtgaacatcctactttgaattttctagtgattatcttcaacttttttttaaaaccataccactacctgtatttttctaattatcaaaaacaaaaatacaacagtaaaaaataaaacccgatgcgcccaccttgccgccttttgtgtagcgcggaattgggtgc

SEQ ID NO: 19320 - DNA, 509 bp, Homo sapiens
gttgtgaaattctaattctatacatgagaaaacgatattttaggaattaaaggaaaataaaagcattctcatataaataaaacaagaatttgttgttactagacctagccttaatgaatggctaaaggaagctattcaaacacagaggaaatgatgacagaaacaatcttggagaatgagaaaggaagaaggaacaatggaaagatgaaaaatatgggtacataacatgagctatccattatcttgtgagttttataaatcataaattatgactagaacaaaacgtatagcagcatctgatattcaaagcagtgatatgtaaaagtggggatggtaaagggtctaatacaaaagtgaagtttccacacttcacttggaatagtaagatgctgacaccagtaaactgttataagtcacatatgtatatagtaaccacaacagaaaccagtataaaaaaaacagagagcggccgtcctttttttcaatgacaaacaaatcgaaacaaggaa

SEQ ID NO: 19321 - DNA, 405 bp, Homo sapiens
catgtgtttgatgatctcagaggctcagtatccttgtcctgggttggagatagcactggggtgtgttgagggactgtggtgcccatgggctcatggttgttcatctgttggtccctgcccctgccacaaaggaggtactgccaggattgggggaatggaaggaggatcagtcagctccttatccctcatgatatacagctgggctcccactaggaggacacgctgaggatacattggcccctggtcttaaatcaggacttgttgcctggctgtcttattatcctgcttgaacaagagcaggggcaacatctcctgccccctggtattccataatgcatgtgtcatagcattgaggcacatgatagttatattagaagcctaaagaaataaatgaagaggcgtccg

SEQ ID NO: 19322 - DNA, 544 bp, Homo sapiens
cttagaggagcctcacaagcaagtcttgtacttcacccatgctgtcccctatatttagcaatccctcttgaagaacactcagcctcactgtatgacacacctgtgtggagaagacagcgtagcccctttgaagttactgcttggatgattaatgacgatgaagcaacaacaaagccaagacgggcatgtacactagcctgtgcatgcaaaacaggtctcaaagtcatgcaacagcaccactacaacttgcaaataatgtcagacttgaaatgaagctacatgtctcacaagcagtggcaacttttaagtaatcctgaaagcattaagaagcaatgaaggcaaatcttattttgtataacttgaatttaattttctactaatattttacatgtttaagaaaaacaagcttttattaaaatttgaacattcgagcaatatacttcattgactgatacattaatttaaaaattctgaaaattgctcaagatatcaacttatacaaagtctaccaggatattaaagtacttacacaaaaaaaaaaaaa

SEQ ID NO: 19323 - DNA, 808 bp, Homo sapiens
  misc_feature (1)...(808): n = A,T,C or G
gctaggatccacgacatccaaacaagtgtatacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcatagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggagcaagccaacaatgccattggagactactntgctgatcgacanaagtggttgaatgctgtacaatattatgtacaaggacggaaccaggaacgcttagctgaatgttactatatgttagaggattatgaaaggttagagaaccttgccatttcacttccagaaaccacaagttactttcagaaatagcacanatgtttgtcagagttggaatgtgtgaacaagcagtgactgcatttttgaatggagtcaaccaagggagcagtagatacctgcgtacatcttaaccaatgaacaaagcccgtggattggcttaaaatcataggatgaaagaatttgatctctggtagctagggatgcattt

SEQ ID NO: 19324 - DNA, 792 bp, Homo sapiens
cctagagcacactcattggtggagaagacagtttaagacctcctgaacctgatgcatgtcttgagtgcatattcagatcaattcctcaacatggtgtgcgtgaagctccaggagtacaaggacacctgcactgcagcttacaggggtattgtccagtcagaagaaaaacttgtcatcagtgcatcttgggcaaaagatgatgatatcagcagactcttgaaatctctaccaaactggatgagtatggctcaacccaaacagctgaggccaaaaagagaggaggaagaagatttcataagggcagcttttggcaaggagtctgaagttcttattgggaacctgggtgataaattaatccctccacaagacatccttcgtgacgtcagtgacctcaaagccttggccaacatgcatgagagcctggaatggttggcaagtcgaacaaagtcagctttctccaatctttctacatcccagatgctttctcctgctcaagacagccacacgaacacggatctccccccagtgtcagagcagatcatgcagactctcagtgaacttgccaaatcgttccaggatatggctgacccgctgcttgcttgtcttacatctggaagtgaggggtcactgtttccactatcttatccctcttggcaaggaggggaactattccctttggggcttatgtggaaaggatggattatgaccccctggtggtcaagctcaacaagatatcaccccccttgaagagggcatgagcgccagccttcagcaaccacaagtccaactttt

SEQ ID NO: 19325 - DNA, 795 bp, Homo sapiens
agataagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgtccagccagatgagcgcccggtcctggtgaagagcattcactacctctacttctccatgatcctgtccacggtcaccctcatcactgtctccaccgtgagctggttcacagagccaccctccaaggagatgggcaagccacctgaccctggttactcgtcacgacccccgtggtccagaaggaacaagcaccaccagcagttccctggtctcttaccctctctcaaaacggaatgccaaagccagcaccagcagcaacggcccagttcaagatggtcaaga

SEQ ID NO: 19326 - DNA, 792 bp, Homo sapiens
tgatcagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagttcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcttgggatgtttctggaagaggaccaatgaaaagggtgccttctggggcctgatctcgggcccgctcctgggcttggttaggctggtcctggactttatttacgtgcagcctcgatgcgaccagccagatgagcgcccggtcctggtgaagagcattcactatctctacttctccatgatcctgtacacggtcaccctcatcactgtctccacccgtgagctggttcacagagccaccctccaaggagatggtcagccacctgacctggtttactcgccacgaccccgtggtccagaaggaggccgcaccaccagaagctcccttgtctcttaccctctctcagaacgggatgcccgaagccccctactagctccaccgtttcatttcgcgattgtgtcagaaaaacccgtataaaactcgacagctgtgacatgacccccagtctttcccaaggggcgaaggcctt

SEQ ID NO: 19327 - DNA, 543 bp, Homo sapiens
atgaaagaagatcttcagatatattttaaataccataagaatctgccccgagctagggcaatctggcaagagtgtcaaggctgcgcctactttggggtaatgttgagaagacaaacttcttcctggaaaatgtttctatgcatcaagttgttaaagaaatcaaaagtgggactagggagaggaacttggcattgcgatttatgtttatttaaagtgtcccatactttgaaattacacatgaaaagttgtaatgggataggcctgtgaggagcacctatatctggtgagaaaaccagtgtcttcttctaagatgggttttaaaaatgaaactaagtaaaaaatgtcacactttgggctccctggaatgatgtctacaaaccgtctgtatccttcaggctccaaaaggcctgaatagactctggcagcccccaacttgaagataggtggcctctttttcagaaggacttgaaatgccccactgtcttctagtgaacttgctttctaaaagaaataaatggttctgcttccctaaaaaaaaaaaaa

SEQ ID NO: 19328 - DNA, 785 bp, Homo sapiens
ctttggaggctgaatgaatgtatttctccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttactgaactggataacacatttagcctgccaggtgtgaaagcactcggcaacgacgacgagagccgagaccgccgctaggaacgtccctacgggaatggcggcggaatgagcgccccgcatttcggcgctcgtattcgtccgcctataatacccgtagtcgggaccggttcgaccgacgcgttcgtgccgttcacagcaggtcgtacgacatacccatacagaataacaaggagccagccacccggcccgaacctaatcactataaccgcaatctattctccaacctccacaccaatcgcaagtgcttttcaccctccgtcccaaattcttgcgatccgtggcacccccatctgcaattgagaaggatatcggggatccccatatttcatgtcgcccggcgtccagcaagtgcgtattccacgtaatgttaactacccttacataatatcccacttatcctaagtgctccactcggctacgcg

SEQ ID NO: 19329 - DNA, 764 bp, Homo sapiens
atggatgttcacttcttctccacaatgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagaggtgtccaacctcatggccttcctcatcatggttgtggtgtacctgcggatctacgtgtacgtcaagaggaaaaccaacgtcttgtctccgcatacaagtgggtccatcagccgccggaggacatccatgaagctaatgaagacggtgatgactgtcttaggggcgtttgtggatgctggaccccgggcctggtggttctgctcctcgacggcctgaactgcaggcagtgtggcgtgcaacatgtgaaaaggtgggttctgctgctggcgctgcacacctccgtcgtgaaccccatcatctaactctaca

SEQ ID NO: 19330 - DNA, 782 bp, Homo sapiens
ttggtgaacaaggcagcaggcagttttccctgtagcttgtcatcacatctgacgattcttctaccagctcaagtgtgctttacaaagttgccttaggagtggcttccattccatctaccgtgcgtgtaaaaagagaacatgaagagctttcataattttccatggcccaggtatgcaagtggcatacctttcagaatttattagcaaaaattattcatctgtggctacatctacttacaaagaagactggaaaatgtagactagttgttgtatactcaggaagatcccatgttgtctgtgtgtgtgtgtgtgtaaatatgtatgtgtataaattgtgtgagcgcgcccccccctaaagaaccgcacgccacgtagtctaccgtcacctattttcatactcccacgcccccctacttccctccgcccccccacccaccctcttcctttccccccgagcccagaccccactgtgccccccggactctccttatacccctcgtgccggcaacggcagccgtccctacccccaggcgtccccgcatcttcccttcttcctcccccccatcacgctcccccgtaccacccctaacatgttccccaatttcatcccgaccttcccaggctcccggagccctccggtgcccctctctcgggcccgccgacgtacgagtcgggcccctccgcagtctggtcgtggtgcgggcgccccccaggcactccgtccttggcccgggccccgtgcccgggccaacttccccggggcgaggagcccgcgcccccgc

SEQ ID NO: 19331 - DNA, 780 bp, Homo sapiens
ctgattacaagactgaataagattgacatgacctccttcctcctggacctgacaattgttccttcaaatcacttccacacatgcattgcctggggactggggactggggtctggatcccatggccagaccaaaccccaaaggaagctattggagaatacacaccttcgaaatgcggagaaatataagaaaaggaagacaagagttcaagaagccaggcatccaacaataataactaaagaggcaaggtaattctcaggatgatgtaacagaaagtccagactggtgaatgacaatgaagaactacaagaggtttgtactctgaaaagaagaaggaaaaaagtggaactcacagtttgtctaaagtttttgacatgtttcaaggaagtatatggttctgtgcaaagttagcaaaaggtacattaaaaaaatgagaaaacaacaaaatcaggcaattaccaactaaaagtataaagaatttggtacaaaaaaggaaattaataatacactacatgctaacttgttaacaatttttacatagtaccaatacaataaatacaatgttaatttcaaactgcaattaattatgctggaaggatgtgggagtgttaagagagttaaattaaaatcttcataacaggaagccaacagataatacctactgaatatttctactttttggacggatggtgggtctggggaactactgtttcatttccttagaggactattggggctttttaaatggccatgtacccatgcattatcctacatagtctaag

SEQ ID NO: 19332 - DNA, 889 bp, Homo sapiens
acagacaggtacagagggaagaccatgtgaagacaggaaaaaagacagccaccaacaagccaaggagagaggcctgcagcagattctcccttgcagccctcagaagcagccaaccctgccgacacccactgacaccttgatcttggattctcagcctccggaactctgagacaatacatttctgttatttaagccacctagcccgggtacattattacggcagccctattaagctgacgcaacaccataatactccagataaacacactggaaatcacttgcttgaggaatcggaagcccagaggtcctattcttggctttgccactccaagccactccacatcccaggaatgcctgggatatttacatattttaatagagaaaagagaatgacacttgagtaagtcacttcctccttaagcctttgtttcctccttcaaaaaagggcaagatcccctccaacatgaacagcttgtatttctgtggcctctagacaggaccaaggacaactgtccacgtcagccacaacctaacagtgttgtcactgtgaaaaatccccatgtcccaacattcaaacacgctgacatcccagtgtcccaccggacctggccacattagactgtagcttccaaaggacagggccagtggattccccactatcaggtccctaaatgatggctgacagggatcctgtcccaggctgtatcatggagcatccttagctctctcaactgcctatctagaggtctggaccctacatccaataaatgctcataaaacttaacattcaagtttacaaatacaaaggcatttttacacaataaaaaccgatgcggccaaggttttgttttttttttttttttctcccaactcctaccctcatgaaccc

SEQ ID NO: 19333 - DNA, 341 bp, Homo sapiens
ctctctaatttccaccgctacagatatatgatctctggttgttttgtgatcccaggatctactgagatgtatagcatgctgtattttgggtgataaaagtacttcttccatgaaattgctgggggttaagtgagataacaaaggaagaaaaacaggtcccaaaccagaacacgacggccaggattcatctcctaaccaatcaaatagaggattcataattacccaatcaagaggaggattgaatggaccaaggagaatttgggagggaacaacatgggaatataagtcagactagcatcggcaccctcttccgggtccccttacaccacggtttgctcaat

SEQ ID NO: 19334 - DNA, 835 bp, Homo sapiens
  misc_feature (1)...(835): n = A,T,C or G
cctggctgaacaatgtaacaattgggagttttgaaggattccaggctgtgtctctgaagcaagagggagatgaccaaccctctgagaccgaccacctatcgatggaggaagaggacccgatgccaagacagatttcaaggcagtcaagtgtgaccgaatcaactctttaccccaatccttatcatcagccttatatctcacggaagtactttgctacacggcttcggagctcccagctagaagggtcttgaagaatattgaatccagaatccaacctttgatgcacacaaatgaggtatgacttggtgccaaggtcaacaagcaacctctgggccacgcaagaactagaagacaggcctggaacccaggaccctcgatgctttccaccacatcccactgcctctgaccttggaaaatgaatgaaaagtcacagaaacaaagatccaaaccacttgccatcagtctgcttggaataacctttttcctttggtttcaagtcatctgctattatttgttaagacgtatctaaaaaaaggcccagtgccttctctgaacaaaagtacccctcaaggctaataactaagagggatattattgataatcctccttgggttggggagacctggatattcaaaagccactttctttatgagaagaaccaaatctttaagcccacaatgggggaaaaaaattttttaacatcttcttgaaggacctctttattttggcagataccctttattanaaaagttgaaagcgcaacttgggattggggaataattttttaaatgttttcctggggaatgtgtaaattacctgccaaactatagggacg

SEQ ID NO: 19335 - DNA, 832 bp, Homo sapiens
gcaatctggaacgactctcttaatcctccaccgctacagcagttgggatatctaaagcagaagccttagaaactctgcaaattatcagaagacaatggctcacaaataaaccaagatatgctggtacatctgagtcacacaagaagtgtacagcactaggaacttcttgagcaggagcatacccagggcttcttaatcaccttctgttcagcactagatgatattcttgggggctgtttgcccttaatgaaaacaacagaaatttgtggcgcaccagaggatggaataacacaatctaggtatgcagttgtcccttaaatgtgcaaataccagtaagtttttggaggagcgagccgtgaaccatcttgtatggtcacccagcggcagttcttggtatatatgattggtcgaccttgctactgtctgatttagtccccgtttgtgtgtatcgtattgcaagagccgtttagcgacgactcgtgttatttcgcgtcccccacggttcaatattttttttcctctcccccctaattttctgtaattgtgctcccggccgtgcctgattaaatcagacatctgcggtcggctgagatgtaggatagtcgcgctaatacagagttacaacagattccgatatattgcgtgtcatagcggtctgcgcacggccaggtattgttgatctccgacccctacaaaataacctattatacgatgcatagcgggccgtgggactgcaatttatttatatcacgagtaccgctacgggagcgcgtagcggaatggtatatagcggggacggaggctgagcggttgggagtcatgaacacaccat

SEQ ID NO: 19336 - DNA, 782 bp, Homo sapiens
cttggccgcatcgttgtttatttatatctttaagggtaacacagtcccacttgtacacatttgatttcacaacatcaataaatttgtacactttgagatttgtttctgggttataattcttcctctgggtctcgtgaccgtttccgggtgctcaaggaaccttctgtttgcaatgaacatgcagaagtaacaacagtatctctaaatccctgaggctaatgcaggaacaagcaaggccagatttctatcaatctttgttgccatctgattggttaaaattacagctaatctgtgattatttgcaaggctgatcatttgctgggctaggccatttaataaccgagtacgaagagacaggtcatctaggtcatgaccaaatggaaaagcaataccatgcactatcactaggagaacctttgagtgttctgaaaggaaatctggaacaagataaacttgtgccattcactctgtctagccccgaccgccaatatagtaaatgtgacaaagaatactatcaagagtgaaatcctccaatgctttcacgagaaccctctccttgccttctcactgccctaaaatcaccgctctcgaatgtacctcttaacactggcatcctctcatttagacattccccctccctacgtaccatttacaccttgcttctcttacactacgacaaattgttcttgactaatatcatataattcacactagctattaattgaatacacacaccccctcgacaaaccccatcactttttgtcatctttcctcgccatgct

SEQ ID NO: 19337 - DNA, 750 bp, Homo sapiens
aggctgaagaatgtcaacaattgggagttttgaaggattccgggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaaaacggatccattaagccagcaccaaggagaacatcttgacactttatggaatttcaaaaagtatgatatgatggcaataaagtggctcttcagcagaatgtacttgaggtgtctttgtctacaatggttaaagagacaggaggagacagcatcttccctccacacacgttagtgtgaagtggtggtgggcgattgttgttcttaattcttctaacccccattaggagttcttgcctaggtttttcaaaactgggagttgttgtgcttcatgtcttttaaacatcttataatatggccgattttttccccacctacaactggagtgtaattagaggcttacagagaatttataggggaaccctgacggccatgggaatattttatcggtgaaataatgtagggtggagagttcacttagtcattcaaataagtcggatt

SEQ ID NO: 19338 - DNA, 327 bp, Homo sapiens
agggcgcgcgattccgaggggtctgggagcagcaaacacgggatgtctgggacgaatcatcgcggctgtagcgaactagaaggcgcatgatacggccgcagcgactgaaatagagccgccgcaacactaattaacatggcaaagcgcgccgaccgccaaatcaaagcgcgcacactcctccccccggccatgagataagaaaagcgagcgcaggaagcgaatgccgcagaaaggttgatgaacggggccgatgcgccccatcgccgatggttagacccagaaatttttttgtccataagaggcatatcaccagctaattgggtacac

SEQ ID NO: 19339 - DNA, 524 bp, Homo sapiens
tcgtgttttatttatactttaaggtaacaagtccacttgtacacattgatttcacaacatcaataaatttgtacactttgagatttgtttctgggttataattcttcctctgggtctcgtgaccgtttccgggtgctcaaggaaccttctgtttgcaatgaacatgcagaagtaacaacagtatctctaaatccctgaggtttgatttgaaacagtactgtgcattccttctggctgggtgacttgtacaatgttgccaacctttgctttcggtcccaatgaaagattagccgtattgtagcagcatgtccccaactttcccctaatgcaggaacaagcaaggcctgatttctatcaatctttgttgtcatctgattggttaaaattacagctaatctgtgattatttgcaaggctgatcatttgctgggctaggccatttaataaccgagtacgaagagacaggtcatctaggtcatgacgaaatggaaaagcaataccatccactatcactagtcgaacctg

SEQ ID NO: 19340 - DNA, 1290 bp, Homo sapiens
attatttatgaggatggcctgtgcaaaaagacacccagagatttcatgctgttgattcacagaaagcctgttcctcttcactccgtagagtcctcagagtctggatcatcccttacagaagatccttgataatatttctgatatacctccaaggttccgtttgtcaaatgtgtgcgacccttctgataagtcaccagaggtgatgagggagagagagaaagaaagcaaattacaactgtaaagagtctctgaacagtgaaagatcaaaacagacagtctctggctttactggatgagtcaccattgcagcccgaccgcaaaaacaagcgtggcttctgtacttagcagcagtcttcctgtctggaaaggaaacattgctcagattggagatactggccattttatagacttcaaagcaacttaggccactgaactgtcaggcgggaaaacaggatgtcttccatttggaagcccctttgcttctaagaagttccagagaccatcccaaggcccacagagttattaaggatttcatctggggccctgaagacatttgggaacctcagtgaagtttctccgaggccagatggtcacattgattttctggaatcattttgaataaaaatgagcgaggtggtgaacacaatgcaaggctctccacgtactgtctgggattgttcaaccagcttcccgactccctgagggcagagatgagcagatgttaatggataaagccaggctgaagaaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaacacaccaaggcagggaaaggcaaaaacaacaacaatgagaacacaaaaacaaaaatcccaactcccccaacagcaaccacaaaacaaaaaaactaaagaaaataaacaaacatgcaggcccagaaagaacggatccattaagccagcaccaaggagaacatcttgacactttatggaatttcaaaaagtatgatatgatggcaataaagtggctcttcagcagaaaaaagaaaaaaaaaaa

SEQ ID NO: 19341 - DNA, 816 bp, Homo sapiens
tcctttatttagaataactgtgttattttgttgttgtgaggtctaggtattaatacattccggcttacccagcaagaacatttttgtggtgacaaggtaaagagtaggatgacaattggatgacccaaaacttagacctcactttccttcccagaatgcagatgctatcctagagggcgagctgcccaaatgggatgtggaggcagcagcatgacgacaaaagatgcaatctgaagctggtggagccacaggacgggagctggacagtgagggtttcatggaggccgtgcacaggactgcccccatctgcagggacactgtggtcattcagtcttgctgtgcacctaagggcagttgccaagcggtggcagctacaaagctggggaggggctctgtaaaccagggcctcctatggctcctgttgggtttgggccaatgggaggctccaagatacacctcagcctcgcgctcttgacttccattcttggtgggtacaggttccccccgccttgtgtctgcaggcctagcactgggaacgacttccttctgagctactttctgagtgcttccaccccttgctggctttcttaatcctacctgcgcctctccaaggagaccttcattcaattatgttcggattaaccctttgacttgccatccctttgctgcgctacttgtacaggtggttacttgttcccatgccgaaccatacaaatgtgactggggtgctacgtgttcggatttgaaaaacaaaaaacttcatctggctcagcgccgggataataattactagactctattcattacttcctgcgg

SEQ ID NO: 19342 - DNA, 516 bp, Homo sapiens
aattcgagatcttgctactctccatcactaggcaaagtctatcttcctttcttttgaatctgggaagacacttgtgactgcctcaatgaataggaagaatacagtggaagtgatgctgcgtggctgctaagaacaggctggaaaaggccatgcagcctctgttcgtctccctcttggaacacttgtctttggaaccctgagttgccaagtaggacatccagggctgccgtgctgtggggaagcccaaaactagcccacacagagagaccacatgaaaaaacactgacattgcatgaagagagggtgatgtgctccagctgcctaaggcttcatctcctgcctgttccagctccagaaaacctgaaggcaacagcatgagacaccctgagctaaaaccatctagctgagctgtttctgaacttctgaccaatttcttatttctgaccaataaaaaataattttattatctgtgattgataataaatttattattgtttcaagctaaaaaaaaaaaaa

SEQ ID NO: 19343 - DNA, 774 bp, Homo sapiens
ctacatttcccaggacctcatatggtgccaccaagacagagctgactgtatcacccaatgcctagccctcagcgtcactgtcaagtcacattggttacctgagccaataatctcatggaactcaatttctgagaactgaagatggaaatgtgaaggcaatccagctcttaggaggagaatatctgccttctctgcaaagagaaattgtcattttattttttaagggtgattttgtcactgggaatggctgcccacccagtgacattttcctatgtaccttgcatccaactgtggccttgcgacatattttcatgaagggaatatgagcaaaagtgaagtaacttccaggtctgtgccttaagaaacagttccctggtctggatacctatctgtagactcctccaatcaacacatcatatgagactctgacttcagagctgatgacgtaaaatgcagggcctaatctatcttggcaatgtggcagtggtggcagtagctccatccaatttcccatggtagcaattccagccacagattcaatgccctgcattgttggcatcacaagcacaacagtttatgtgtgcctagcaagggtgggagtgcatcttcacaggaccacatttgggcatgattctggatggtggtcctcactgggagaatttcaaacatggctttctactctggtctggaggaaaagattcttgggcgcacataatatcctttaatctactgcttttatgcctacactagcaggagctgctccctaatattgag

SEQ ID NO: 19344 - DNA, 795 bp, Homo sapiens
ttaggcaatgttgggacgaaacacggggagtcctccaggaagaaggatgaagaggaagttcagagcaagcaccggttaatccccctcggcagagaaatctatgaattctacaatgcacccatcgtgaagttctggttctacacactggcgtatatcggatacctgatgctcttcaaccatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgacggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacaacttctacatgccctatggatgatttatggggagggtttggggaccatatagaccgttggtttgtgagcatgttttaggctgatcgatctatattcgccggacccacagccttcccaggtctccaatccatcctgtgggtgaccccgggcgg

SEQ ID NO: 19345 - DNA, 645 bp, Homo sapiens
ctaggaattacgctttaacttgtttctgcttgtggtgcatactacagaatgaaattaacagctctaaatactctgaagtccaaagaagttgtatgttgggtgggctcccttcaactttaacatggaagtgctttctgtgactttaaaagatctggacttacctcaattgcttttgctgcttgttcttttgtttcaaattccacaaacgcaaatccctttggatctccagtagacttataatgtggtatacttatataaacaacattgccacatttcccaaatactctttcaatccagctgtgattaacatttttgggaagtaactcctattataaattaaaagcaatattagagtttttcacaatcagaatgtcaataaatttttaacttaattatattgtttctgcgccagtttctgactggggacccgggttcttaagcttaccacacacactgtgcgttcatcctcatcctttggtctttcccccagaggtttttttcctccggattctggtgccttccaaatcaagctttaaaatagtatattacattaataaaactaatattatttataattgtaagctataatcatataataatcattacgctaacattcttttatattataaactattaatataatac

SEQ ID NO: 19346 - DNA, 792 bp, Homo sapiens
cctgatcttctataaggaatgactcagatgattatataaatctacacttaattttcattagaattgtccttgtagtgcttgaactttaaatcctgtagagtagaagcaaactgtgtttgcaatagaaattgccagaagaaagaacaaggaatacatttagataatttcatctgggtgtgcaaagtcatcacaagatccatctttccattatctggaagttgggagccatctgtttttcatgacggtctgacggttggaatgagaagctcactgacagcaccaggggcctcctagaactggcttccagtaatcctatttctgcaccatggagcaacacagaacaagttcttctccacatatgtgctataactctctaagaagttgaagacagcacaattatatcgattcgtcctagctgttccagaacgaaagaaccccatattcccatatgatgcttcccctgggcgcggtccccaccctctcacaatcctgggcggtcctccgactgctcacgtgctcattaacataaggtcccgaacccagaactgagtttttagcgctcggccgcgtccttccataacatgagcggctaacggatgatcctcttcacctcaccgctgccccaaacaccacatacacctgtctttgcgccgggtgtacgcttgacactctcccgcgccgcattgcactccgtcacacgttaccccgccgcggtggacacctcaagaaactcgccatcgtgcccccctcgccaatccaacacgaatcacaaccactcctcccatccgtacc

SEQ ID NO: 19347 - DNA, 781 bp, Homo sapiens
catgataggagccatggctttcgttacagaccagtcaacagattattattatgaggaaaatgaaatgaatggcttttatgactacagtcaatatgaactgatctgtatcaaagaagatgtcagagaatttgcaaaagttttcctccctgtattcctcacaatagttttcgtcattggacttgcaggcaattccatggtagtggcaatttatgcctattacaagaaacagagaaccaaaacagatgtgtacatcctgaatttggctgtagcagatttattccttctattcactccgcctttttgggctgttaatgcagttcatgggtgggttttagggaaaataatgtgcaaaataacttgggccttgcacacactaaactttgtctctggaatgcagattctggcttgcatcagcatagacagatatgcggcactaactaaagtccccagtcaatcacgagggggaaaaccatgctggatcatctgccccctgcgtgtgaacggatgacatcttgctgacagtaccatacctgcaactcaatcccgcccccgacaccgcttcgcgccaacccatttttccggtatacctccacgcctctatgagcctccccccctcgaccaccagacccccatcgtaccgccctaaccccaccccctacagagaacgcaaacacgaatcccccccacaccccaacgaccaagcgcccctccaaactgggcacttcacaatataccctcccaagccggcaaattatttcaaccctcgcccaccataccgacg

SEQ ID NO: 19348 - DNA, 636 bp, Homo sapiens
aggtgactggcagccacctgtccatcccccaagaccggagaggcagcaatagcccccgggagcccagggctgtcctcgggtaatgttttgtgtggctcctagaaatccaggtccacactagatggtgggatctgtgtctaggttaaactgatagctgcataccccccgacccccgccgcctccaccttctgcaccccagggagagagggtgcctcctttccattgaggattctgtgccaacccacctcgccactgggctgcaggctatgggggctactaagggttgggggagacagggaggacagggagagaggaggccagaattgactaaccatttatcttcctctggtgtctcctggactagtgcatccggctgcagagggaaattgaggaccttagagaccaactagcggccatgcagttcctcactgacaagttccaggacctttgaagttggagccagcatcttcctacaagatgaacagctgccacctttggagctccggagctgcagccaagcgggttcccctccatatcctgttcagccagggcttcctctcttcctctgcatttgcacacttcccaacgcagttcaaagcaatttgaaataaagtcgttctcatattctgtgaaaag

SEQ ID NO: 19349 - DNA, 780 bp, Homo sapiens
cttgaagtgactctccaggggagctaaaatccatgtatttgggcacacacttgaacaatattgctagagaaatttaagcaagaacacaaaggttaatgacatctcttgtggggaccactgtgagaataaaacaaggcactacgttgtctgggatgatggaaggagctaaagtcttcagtgaatgaaggagcaggaccaggagctcaaaatacttctttgaagacaaagaagaaatgatattaccaaatggttggctcaaaagaacagggattttgcaacagagagagtatgtcatggtcttgaacaagcaatgttttgccaggacgattaaatatcattgatgcttctggtctacaattagtcagagaagagattaaaaaaatgatgagtattctagaaggaaagtgtttgctttaacatatgaagaaaaggagcttcagagtggtgattaaccccagaattgtgtggaacggatatggaaacaagaccacaggagcatcgagaactgagcagaactgaaggtgacatgaaaatcagctgcaagattcacctcagggtgataatgggctgcaggtggctgcaggaatcccgggacattctaggcactgccatattttcttaggggccagtaaggctggctatcatcagatgtacctgatgatacaacatgggctggcttgccttctagtattcatttctgatgattgatccagagctgactctggaggtgcagatcaactcttcttcaagctcatacatgcgacttgagtgggctctcat

SEQ ID NO: 19350 - DNA, 814 bp, Homo sapiens
acaatgcgtgggacgactctcttaatactccaccgctacaactgcaaatgaaagaagtcctgctactctaaagaatatttaaaccagactggagtcactgaaactgatggaagaacatctcaggcggtgagtgccatggtgacgtcatcagctccgttcacgaccactcaccatgaggccattgctcctgcggaggacactggcttaggactcatgaagtagtacctcaggaaggtgctcctgtgagtgttccttccaccagctccaagacacaatgagatggagagaactggaacaattccctatgattgcagctggatattttcacatgaactatctagtaatgaaggcaatggcatgtggtgtggcaaacactggccccagattacatttccagtcctttttgactgaagagggggcttgggaccaaaacagtgggagtgaggggccaggttccacattttatatttttttagttttctgggggtattctggcgactgcttgtaaaaatggagggaaaaaagatgggaggggcctggttcccgaatggcttcgtggggaaaaccttaccttcccccaacccaagttagacgggggggggaggaccctccaccttttttgtggtaggcgctcgatttttgacccccgaattgaagcgtgaaagggtgtatactgttccgcccccttcccgtggtgggggaaaacttggtcgatttgtttttgtgcaaaatgggggcggaagttgaacatatggcgtccggacggggtgttgttccaggccttccctaataaagaactcgcgcccggcccttc

SEQ ID NO: 19351 - DNA, 1523 bp, Homo sapiens
  misc_feature (1)...(1523): n = A,T,C or G
gttattaaaggtaaatgagtggttgttnntagaggtgtcagtgtgcacagcgnatgtgtacaaattacggtcaataggaaaatactcaaacaaagttgattttttaaagatgaaatgccactgcgctgaccgtgctctacactcaccctanccctgccattccttgtctattgtgcagcgacgagtatagtgaaatgtcagataagcacattcggtnncactgagtggtatagtacacagagccaccacaaacaactgtatatagcctaagacnnnaaacagatantatttatgtagggctgtatctactctagagccagagaccctgaggtggcatccgtcggtctcacctacgcgcgaagacaatgattactctacagcgacacgtccaatatcacctctcgtccgcgtcgacacgtgtccgccgttcctttccggcgtngctgtgcctatgtnattttagtgcgtcatatatacatgctatagtgtagcgaaatagtaagtgcaggcagacaggaggagctgtggacaagagtgtgcgatgagtcagttggacgctcnagagtgtatagtgtctatcgnctagngactgaggtnnctgtattagtgtcgtgtgtggttgttgagcgtggtaagtggagcgngcagagcgagagacgtgtncncgagcgncnacgtctgtcatagcggtacgtactacatgacgacgtaatgatcgacgtatataccncagtccggtgagcncagcgcggcttcacacgagcacgcacaacactctacatgncnacgtctcacacacactagaagcacagtntacgctatatgatngcacgagtaancactnncgatnatactgnagaacgcgtggaaggacgaatagagatncncgtcacagagtatgagtncgcnacgtactgtgtgatagctgntcnggttcggtgccggcgnctgggcgagtgcacggtgtgtcagtcggtgtgactgatgttcgngtntcactgtaacgtgtcgcgcgtcagcctcgacatntacgtatcctatatatgatagatatatgcncancgatatatgcattctagtatctntacgcctagtaaagtgacgttgtatntcaatagtttatagttcagacagtggtctacgagtgtttcgtcgctcagtatagcgtagcgtctgagtagtaactagtcgccatgacgtcgctatctcatcatcgattccacatgtgtagcgcatcagttgtcatacactgagtcatcgccctcgacgctcttagcgcgtgtctcncgtagtaatatatggtgtgcgtgtgtgtctacanacgacagttgaagaacagtagcgcaccgacagcgcacatcgagcgagcgacagacgcttcncgcgcagtgagtcaggttaatagcgtatcatgaggaagtatcgattccnagtgtcgatgtatgtatgatnagtatgtgacatagagtnnntcggagttagaatagtcgcggtctcacattatatacgctcatagtgacgtc

SEQ ID NO: 19352 - DNA, 1015 bp, Homo sapiens
  misc_feature (1)...(1015): n = A,T,C or G
tcagttatgaagaagggaaagctttggcatgatcttggagtgcaagttttttggaatcttctgctaaagaaaatcagactgctgtggatgtttttcgaaggataatttgtggaggcatgaaaaaatgtgactggggcatgttggacaaggcgtggtctgtgatgctgcggggatgcgatgagtgcgggggaagggctggttggcacctgggtatgtgtgtgtacgctgaatgaaggcgtgctgcgcgcggggggcttggaaaatgaagctgtggctggggtggtcagtacggtagatgcgcctagattgtgttcgtcgcgtggtgtaggaagccgtcgcttgaggttgggattgtgtttgctgggtgtggagcaagaacgccgtgtgatttgttcagctattttgcagtgtcgactgggttgttgtaactgttggtgcaacgcggatacaacgggctattgtcacacggggatgcttcgcttggagacaccagagtggtgatggtctggcgtgatctgtggacgggcaatgagtggtaggcgctggatgtgggcgcgcgggcatagagacggtgcaatggagactacgggtcgtgtatactgtagtgtttcgttggtcgctcaactattgcccttgggacgtgtgtttctgctgatctgtcgtaggaacagcatggtctaacactggtgtgggttcttttattagacggtgaggtgtacgtcgtcgctgcgttctgcacaggccattacgctggcgctacaccctatatagtcgtacatcgtgctagtggcgtatgctcgagagtcgtgttgacgagtagtatgagcaatcgagtaatgcgagatagaacgttgttggtgtactagtaactctcacgaatcagtagctgtgacgctcgtgcgtcagtgtacataagtacaatcacgttggatgggcatgatttccagagcagtgtggcgcgcacacgtcgcgnaggtgtactacagtgtctacatatcggaatatgacataaaag

SEQ ID NO: 19353 - DNA, 792 bp, Homo sapiens
gggtagatacaatataagacatgctctcagacctcaaagaatatatcagtttaataaaaaaaaaatgtcagtaatagttccttcttacaaacaactaaattaacatataattctaaaaaactgtaagttttattgaatatattctgttcaatttttctgtaagcctaagactgctgcaaaaaatgaagtttgttagaaaaatcatctcaactcaccctgatgtcaccctggcacaggctgtggcagctcttcagagttccctgtccggcctctctctgccttccagtgcgatctagagatgttctcagctccatgccaaagcagcctccttgtctcacagttcactccaaggactggtctgtcatgtgaccgggccagcgtgttattgagccgccctcctgatcttcgatcccatgcctgaacaacactgtctccctggaattcctacggtctcaaatgagcctcggtgttgggcttttaagttaatacgctgtctccatgctcatctcttattcaacatggccctgcccataagaccatttttaccaccactgatgccccaaacagaccccacccctgccatttccaatcacagatgagaaagattgaaaggagagattcacaactggcagcaaaaggaggagggggccctgagtttctcacctggcgccttgggcagctggacactcacccagcttaaggtgggaccttctattttaataaggggctaaaagcaatggccgagggacaacctcttgctttccaactgaaaggaaagcttgggctctccct

SEQ ID NO: 19354 - DNA, 1105 bp, Homo sapiens
ggtcggccgattctagtttagaatagaaggggttggggaactagctgcacggctctctgattttccaccgctacagatagcaagacaaatctctcctctgccttctccttatcagactactcaacattgaaggcaatatagaatgacagacctattattgtatatataatttcgagcttagtatcttcactcagatgcgcttgaactagatagtatagagcacatagcctgattccaccttacatatatatcccccgagacgaattccatcatcgcactaatacatgttttcattctattctgtttgtcatatttatcatgcgaacgcgtgataatgattggcctcgttatgaccctaatatagcacttattatatagagtatttcagcaatgtgtcgtcccgcctcactggatagtgagtgttgatacaaatatgccggcgttgaccaccgagtgcgccctacgtgatgagataagtaaactaacgggtcacttggccactctctttccagatctgcctcgacgatctatgccgcgattggaagatacatacgtcagtgcgaatccgttgactctcgcccgctgctcgatcattcatatacagtataagctagttcggtctactctagagtcgttcactcctcagtctgccgcggtattttatttactagtgtcgtaccaccgcatgtgtagtctagtagaatgacgatacacctctatactcattatctcttacgccgaccacacattatatttagactcctcagtttcacgtcgcgagaattataatatttgacaccttgacacgcgctcgctattcaatacaatattatgtctctatacaccataagtacaagattgtgatagttatatagccagtatcgcagcgtgtataatttatgtcctgcgcacctacagcccgcgctgtattcgcccttatatattgtttgcgccatatataatggcaggcgaagatataaagctgatcgccaaatacactgtgttaccggacgtgctccgctatgtaataatgcgcatgatcgtatctgagcccgtatcttatttgctcacaggcgccatttatcatcaccacatagtatacatg

SEQ ID NO: 19355 - DNA, 936 bp, Homo sapiens
  misc_feature (1)...(936): n = A,T,C or G
tctcttaatattccacccgctacagccagatagcagcactgaagaaaatgatgctagatgggagacaaaattagatgaagtcagctacatcggagggaaatactaatcccctcataccagagcatctcccctatctatagtagaaaaaactctagaatcttccgccacgcaatgcccttcccccgagagagatggaccacgtctccttctttcactgtgcatagcgctttctgtccgcggttctagcagtcgtcgatgtcgcatggcttctcattcagatcctgtcgatcccgcagatagtgtgccacggagtagtttataattccccgcacgcccagtaacccagcgcccgcgcaacattatgatgtatgatgcgcgctcacacctccccacatccacattcccgtctcgtagctcgcgcatgttctaaaaatactatataacctaccatccaactccgccaacgcctctgattctattatgagtacgattccgccctccaaatcgccaccctcccgcctcccttcatttagatatgtagacccgcctgatctcgtaagacatacccaattgccaaacatcccatttctccagcctctgccacgtatacactcccccccaaagtcgtcccgctagattcttattatcactactgccccatcccatccatactctgatatagtgctcgccccactaagagtaatgtgctcacctatacgcattaccaagattcgtgttatgacgtgcccgtaaccggccgccgccatgacacgcattgaggtgaagccgcacaacctgaagacaccacagaataaaagtcgtagagcagtcacgtataaatcaaccacatcgcncgagttcatttgggcgccgcagcgttgttgacggcgtggatagaacgccaccacccactaatactgcccgcctgtaccacca

SEQ ID NO: 19356 - DNA, 327 bp, Homo sapiens
caaaaggattccccctcaaagttggccactttttccccattcaccgcgattcgggttccgccccgtcctttgggaggtttattcaacccgcgttcccccgaccaaagggagttcctttttcccccctttggcaaaaaagggggaggcccctgggccccccgttattttaaaaaataaattggccccacggttttccctctgggttaaggcacgccgcgcaaaattttttttctgccacgcccccccgaaaaaggtttttttggggcgggggaggaccccccccaccccttttggaaaaagtgtatgcggccccccaaattttttttt

SEQ ID NO: 19357 - DNA, 448 bp, Homo sapiens
ccccccccctctatccctgttcattgctccccgagggccgctgaaaactctcgtatccttatgtctcccccctctctgacgagtcggacatgcgtgcctcgggttggccgcttatgcgttgggggcagcgatgatagttctttttccgcctcacccacccctaattaagtgtgtccgcgcctcgttgttccctcccccacgcacctgaagcagaaaggcgtgccccgtcctccactctcctactcctggtcctcccgtgggagtttacccgcccccccaacccacctctttaaatccgccccatcttggttaaaggtttttgcggcgcgcaccccccacaggctcttactccccggaccgccccttcccttgtttcctctcttggcccccccctgcgttttccgcattttttttccttcccccacttttttgggggtgtcaaaccgga

SEQ ID NO: 19358 - DNA, 1122 bp, Homo sapiens
  misc_feature (1)...(1122): n = A,T,C or G
tatcgtcttttcttccttttctgcgtcccatctcctcgatttacgagaancggtggtggactctctttcgggggaatattgtcgtcaatctgtgttcctcttctttgtatgggttacactaccatgggggaatcaataacataactcatgggtcaacaaatcacaacctgcgtggtctacactgtcgtgtgggggggaccacatggtgggggacaccaggtgggggtaccaattctctgtttctctaacttttcgattgttgttcacctccctgtcacggcttggtcgcgtactggtgggcgtaaattgtcagtctggtgcacgtgtcaacactgtttacctacacagaccggttgcatgtactcacttctcctcgtacttgtcacttgctgtggggtcatctgtaccacaggtgacctgtggcgcgtggaacacggcacaacagctggggtggcntgtgtgaacaaaacatatctagaaaaactatgtgtgcaatatgtgggctcggtgtgttggtaaattaaacccgatcgcgcgggcgtcttgtccattatcgtgtgcgcttctattgtgtagaacacctctactctgctatagttcttgtgtactcacctatggcctctntgcactatcaactaatgtgcgcggacaccaacagggttggccacttcaatgcaccggtctgggttgtcggccgacctcatcccacttcttgtgttgtattttggtcaatcaacagttatacatggttggtaacggggctgcacggaacaccctcttttgttgttggttcggtcttgtgaccgcttcatttctcggttgcttcgtctcatactgggtgactcttttggtgttggtgggacacccaacccacatgggtcctgcgacaatcgtttgtgtatngtgcgggtggctgtcacatttactgttctactccatcccatactgggtggtgtaacctacacaactgttggtaccaatatcttcacgggggcgaacacggtgcggtgtggttgtcaccacacaatcacgtgtggcggggtattggcccttccttttctctcccttggtatcctggttgtgtcccacggtggtgcacaccctaccaaaaccaactgggca

SEQ ID NO: 19359 - DNA, 781 bp, Homo sapiens
tcattgcatgatgacgtgaactcaacataaaatgtggggagtgggagtttcttctgagaacagttcctgtgatgtctggcaataggagcgttgactggaacatgtggatataccttttccaccatgaaacatttgaaaaactccaaagtttggactcaggcaagtgcaagtccaaaatgtgtgttacagtccactctggttttggaggtagttgtggagtgccccacagacctctagggagtaaaacatactggattttactccagtggaccacttggagctcctgagccagctgagaagcctgttcatccccagcagaggcaaagccagtttgggaggcctcaggattgtcatttctcctgttcacagcatggctctgggcagcgccactcagtgccatcaaggaaccatgcacctgaagtttgaacccatctgagtatgcaatacagaggaggagaagacttgcagggggttttgtaaggtgctcccagcacaacgtgcatccgtttcttaactctgtaaagcacatggggaaaccactcacaggtttctagactccttaccctttattccacttccctaagggctgaagcctaattgctgaccccttctggcctcgggcctgattacaatgagatattggccagtggggggataggccagatttagttcttccaaataacaatcatcctggtattttttggtatcaaagaagtagaaaatgtgtctttcgcaggttaattaaaacatacggagagaggaattcaggcttagatgtttt

SEQ ID NO: 19360 - DNA, 878 bp, Homo sapiens
aatactaagcaaatcttcgaaattactgaacctataccgtaggagatgcggtcgtatgataaatattgtatattaatacagattgtgcggatgacgggttatttgaatccagtggagtattaatatcgttcagattattaactgaaagagggaataataatttataaaatcaccgggataggtgtagaaatagtcatgtgggtctgctattggccaataatctccacagggggagagagattaaaaggccccaaccggacaagatcgaaagaataagctggtcaaaagatataattatataagtaaacagggaaccaaaagtacatacagaagagaccaaagaaccgggtaaaatataacggagaaataggcaaggcattagttgaatgtgaagtggagtgttaagcgcaggcgaaatattggatgttgtaatgaagtatatgaatgcgcataaagaagaaggacatactaaaacaaggatggatgagattctgtgtgcaaaagtaagggagtaagggtgcttgattataaacaagtaagccaaattgtcgggtttatgacctttttgaccaagtatgctactttaattgttcggatgtccaataaagaacagcattggttctacttctatgctttttaagaggaatttcaggaaggatgatcattccagttagtttggcgttttgtgtcgattgtgcacataacttggtgttatcgttatgtcatcagattcctcctagggaagagtttttgttttaattacaaaattaaattctacatattgaccaagaaatttgtggtgatacaaatgaaaatataagatcgtttgccggccagcgtgtttgttgcgtgtctatatgataaaaattaataagaaa

SEQ ID NO: 19361 - DNA, 824 bp, Homo sapiens
tctcttaattttccccgctacagctaaggaatctgaagatgaaaaagatgaggggacattcccaaagtcgcacagccctcaagccagtgcgaaaatgtggaccccgctgccttgtctggtgcccatttctggagagagaaaagcaccgctgggtcgtgggggagactggccggtggcagcttctggcatctcacctgtctctgcacgggttaagaatctcccttgttgtggatttcagaccttgagtgtacagctccccatctggactctcgtgaaggtcgtggtaaacaacacacagagcatctctttgtcacgggctcatctgacacgtctccctccctcaccactgccccgccagcctccagcagcacatctgcgggggacaatgagtcttatttcacattgtggctctgcgggaggcattctcatggggacagaattcacaccacatgataattaacaggggactgttcaagaacaaatttcataatagagacaaaagggatgaatgaataaaaaaaattaacaccataaacaaaaatataccgccttataaagataatgatccatagattttgttgctggcccctccccttttagtggagggtacgtcttttgttctttcgccactgactcgcttggcctggggatcctcgccccggagcagtggatctccgtctcttcacggcgtgtaatactgttttcaccaaatctcgggctatctctttaaataaatctcttggccccagggtcccttattgcgctccgccaccacgaaagggttcctttgtttgtttcttcaccttttcactcccccctccctc

SEQ ID NO: 19362 - DNA, 778 bp, Homo sapiens
ctagattcaacatcctttcattggtgctgtgaacagaaagtccttgatttcctcaattttcggaggcatggcgacaaggcacgcagggagcaggcgcggaccgggacagcgtgcggcgaccgggaaaaacaggacagaaaaagacagacagcttttaaagctcctggattaaccctagaggctacccctaaatggagataagccatttatacagagaggtgttcctgctcgcttcagcaggtttgagaagctctggactaaccaccaaaagactaggaaaaatttgccagggctagtattttgggcatccctgtttaacccttctcaggagattcccaggcctgggatcatatcatacacaagtcgccatgactcaggaggtggatgttactgggaagacctgcaaaggaggatgacactggcacccttcaagagttcagaatgcctagaaaacactgaggacgcatttcactgaccaacctaatgtgaacctgtaggtgactctactcgtatgtggtatagatcatgctgatagaggacctaaacggtctctgtccactcaggattatcatccaccctgccaggtgttgttatatgcacaacaccatgtcgtatcagattttatttaattccatcaattattatttaatcttgatatctctatcttcactgtctatacgaagctacttaggtcccgcttataattgccctaaattattatagcctctatatgatcttattaacccgtttaataaacaaattcccatttatattaatt

SEQ ID NO: 19363 - DNA, 662 bp, Homo sapiens
atgggcgactggccgtgaggcaacaaattagtgatcagggacgggttgttttttgtgccctgtgctagtttgagaacgaagagacctcccctgcctcggctctggtttgttgagacgtaaaccggggagcgggatggcacgtggctcagaaggtggccttcaatctgtagccgcctgcttcccgtcttttgagcggggcgggggaacttatagggccgtatgcacatagctactgatcgccttgggaaggggtggggataaaagggccaacggccccgttacctgtggtggcataagccttaaaggggggccgtactacatagcgtgtatatggacgttaaaagaaaaaagaccttggctccggggattatcctttttgagggaaacacttgtgaggcatattggtcggtgtaaaagcccttttgtcatattttacaagaacaattcgatagcggtgggtcgggcactctctttttttaatagctcttgtttgaaatagtgttgtataggttgtccggtataattggtgtgatccccgacatatcttaaccctccaaagatttgtcacttttccccactctcccaatacttttttgcgattgttttgccttggagtgcggggaggggaggttgtatgtttctttatggcgtatttacgaaag

SEQ ID NO: 19364 - DNA, 789 bp, Homo sapiens; identical to SEQ ID NO: 13483
  misc_feature (1)...(789): n = A,T,C or G

SEQ ID NO: 19365 - DNA, 966 bp, Homo sapiens
  misc_feature (1)...(966): n = A,T,C or G
ataaggaatgcacgcaatgtacgttgananntaagctacacccangaannnaggnggcatatcttgtggtccatgagcagtgcctatttcagcttaaatccgctaaccgcacagcacgagcactccgacaccacagtagtcaaacgaacgctgatcatgactctctccctcaccacacgcggtaccggacgcttcgaggcaatgttccccaaaacttcggagcgaactgcagtttgacccaacacttccgaggttccaggagccacaagatccagagatgaacgagcccgccttgaagggaatcatacgtctaacacaccttctggaggtgcactagatgccctttacaaagtaaccttgtgtctagccacaaactgggtggagaacaacatcactgccctcagggtgtctttttaggtttacaactactggagcaatcgaaacataccggtgctttaacacatcgataagaatcataaaaaaaaggaatgcgaccatgaagatcccatgaaccggctgtaacctcacggcgatacctcatcataccaacggacaccctctaatgagttgtaccctctcagagctatagcacgactttcagacgaatctgtcaaaggagggcctaagatgtccccacggggttcaagaggatatctgcagtcccaccctaggccccctcaagatactcgaactgaacgagagtggctaccgggttagatatttaaagattagtgtacagcgccgggttttccacaaccctaagttattgtcttcgtcactataaccgccaccgtataataacccacctgtctacgcttaaaactcacaaactaaggaccgaacaattgagaagacatgagcacctacaacccacaagatacactgtcttatactgcaccacttaatcttagaagcacaaatacccaatgtctaattgtcaatgagtacacgagtaacgttgaaaag

SEQ ID NO: 19366 - DNA, 1468 bp, Homo sapiens
  misc_feature (1)...(1468): n = A,T,C or G
tagttggtatattggtgagtgtgtgggggggagcgcgagatgagaaggggagaacggctaggctggggggacaaaggcagcgggaatgtttccacaggcgccaaaaacanaaacgataaaancgagggcggaaaggacgaaacgaaagacgaagtttagcggagagagcggagcgacgaacgcgacggagaggccacatgaagcgagtgacacgagagaagaatatgattgtgccgcggtctgcgagccgcgataattttatatattgttagatggcataattactgttacggaggcatttatgaagcgtataacgagagtcagatncatagagagcagtggacgaagtgtctgagtcagatcaatatatgatggaggtgtttaagtgctgcaaggaataagaacatctgatgatggcgacgtgacatagtctattattatgtcggacacgaagnaagtaggctgatanaaagcgtacgcatccgattacgagagagtgtatacagcggtatagtagtgtgcgtgcagtagtgaaggcgagtgctacatatatacacaagacgtatggctgtggataagcgcgagtatcatcgcctatnatgaatnaggagngcgacggcgagccggatgagntatcattacgcngctatatatantgctgttcaacgacactagccggcgacgcgcagaagtcgtcgttaagatgtacgactgcacgcgcgcgatgtatatctactagtcacaggcgagatgaggagccgccagtgttattgtattatcacgaataggtgtcagtcggagggtaggtataggtcgggtcgatcgtgcgcgcgggtagagtcgttatattagaatatcgcgcgagtgtcattcgcatagtagtatattacgaatacgcatctatcggacagtatatctgagagccagagtacgccatgtatagtatacggtatagatgacagcgacgagacagngaagtagtgcacgcgaatcatgttcagtcaacgtgcttttaggtttgattcgacgcatcacgcgtcagtgatatgtatttgcgggtccgcataccgtacgacgataggatgagcacgttaaccgcgcagatcgcacctgaatatatttaactcaacagcggttcggacagtaggatggaaagtgatagaaaggcgcagatgtgttgtggacggtgtatatatcccgctatcatctgcgcatcagttgttgttaataatcttcgcgttccgcagccataagccagccggtgttgtaacctgcgatgcgggtataactgaggcggtaagccgagttatacatgatatgggtaatgatgatgagagcttggtagcgctgtgcagatagtgagggaatctagtgtcgtgactccgcgggacactgaataactgtgtggggctgggagagtgcgtataatatagtacggcgcgatattgtaacatatataatataacca

SEQ ID NO: 19367 - DNA, 757 bp, Homo sapiens
ccggccgatccgccttgcccgcctgtgtcgtgtagcttcagtcgaggtagtgcttgtgggtgtaacgcaaaacgtgtttgtgcagttgtctgattaatggcttctcgtcgtggttcacaggtccgcgtttccgtggtcgcgttcgtagctgacgtgccatacggtctccgtgtctggaagcccgcgggtgtccccctacggcggcggtcttgttggtaacctacatggacggctggccgccctttctcgttatgaatattgttgtagttgaccgtgcgccagcctgggtttcgcagacagctgtccctaccgcgtttgtgatatttccaacaggtgcctacacatgtttagcgcggctgtactccgcgcctcctcctgggttcgtgttttggcttccggtctagtccttactcttcctactcccagtctttctgttcgcccagctgttgtggggcggcttggctattatcacgggcgtcttcctctaggggtctcgggcccggtttttccccgttgtcattcctcggcgttacataccaccgcgcgcaatgaggggcgtcaccgattggtccatgtgtgattgctcacttaagcgtatccggatattggtaatcgcggagggacggcgctgcgatatattaattttctttgcagcctggcgctgctccgcgagcgttattcgatctatgttgcatgagtctcgggcgggccaaacgcgctaaatgggggttttcttcttttctttattaagacacgc

SEQ ID NO: 19368 - DNA, 975 bp, Homo sapiens
  misc_feature (1)...(975): n = A,T,C or G
gatgaagtagaaagtggaagaaagaggtttttaggggggagaagcgagagaagtcatttattagatagatagatgaggttagtgaaaaagagagtgttgggtaggtatgaagtatagttggaagtgtaaaaaagagaatgattatataaaattgggtgagggaagagagtatataagaaatataattgatatataaagataataggggngggtagtagatagtgaatgaaaaagaaaggaagagtgtgaggggtgaagattcggttgtcatatgattaacagtataaaattgagatagggagatgagaagggaggggaggaaaaaagggaggtagatataaagtgtagcgtagaggaaaaatggggagtataaggtgtgtagtatagaaatatgattgggagagggagatagtgagtgttgaagacagtttctttttaataaggagaagatgcaatatatgataatagtacgagtttgtaagtgagagaaaggttgtgtggcagaggaaggagtaggggggagaggaagggaatgttaaaatgaaaaaggttaggtggaatgggtgggtatggtgataaggagtgaggtgatagaggaaaagagaagtgagaagaagaggaaatattgtttttttaggtagtagaggaggttggggaggcccccccccacgaatggagaggggggaggtgtgagaaggggggtgttataataagaaaatttgaagggtgagggttttgggaggatgtgtatttagggggaagaatgggagggtgctgggagggttacgtagggaggggcgatagattagaatgatgggatttgtattgaaaagccccaccccctaaaaatgaaagtggaaagaaagaaaggagtaaaaaaaanncatgggtctggttggcttaaagaggtggagttgtgggggcggaaacaatnccgtggtgtgatgatttgtaatataattaaatgaaaggagg

SEQ ID NO: 19369 - DNA, 1171 bp, Homo sapiens
  misc_feature (1)...(1171): n = A,T,C or G
cgtgttgcgttgtgtttcttcttgccggcggtctaacgggagctataacgtgagctagtggcaacaataaatgagatattgggtatgtcgagctcgggtctcgcgatagtaggtagtggctgttcagacgccaacatatcatgcaatgttattacctaagtctcccgataatgaccctcttctcaatgtttatgaatatgaagagagcgaaggaacgttattattggacgtcnttaagagtgcaacaatgtagagcaaatatagggggtgcgcgtccagagaaggggagtgaggagcacgagtccaagcgtgccggtgtatgtacacgtgtagagggctgttttgtcgacacgctgtggagtatattaatatacgtggaggagagtaggggaatcagtattaattaatatggcgtgagtagaacgggtatgaaacaccattatagaacataaacgactaagcgcaacaacatcccatagaagatgagttcaagagcacgttttaattggaggtaataggcgcgacaacgctgtagaagaatagcagtctagcgctaatgttgtagagggggtgatcgatgggatatggacgtactctgttgcacggaagcaagaatgcttggttagtccgacgagagaaagacgaaccacaaggggcaggttgaggtctaggaggaagcggagtgatttcgataggaagtaaaagcacctatctaactgaatagataataagcagcagactgtgagcatggtgcgctatcgagtgtggtagggcccagatctagttgcccaccgtgatgtttgttgatagtatgagtaggttgctcaaaggaggtatacgaagtgcgagatcagagtataagttactaatagtgattgcgatgcgcggctatacaaaagttgtgtcttgtggtaaatgtaccagcgttagcacccaagaagatcagatcgcgctagacgcagattgcgacaaagatcgcgagcgtgtgagtgcaaagatctatcaaagaccaccgttgaagttgagcaagtcgctttcgaaataactgctccactcagctgtctagtttagtagtctctgggaagaaattgtataaaggctgaatgcccaggtcccctgccagagagcgccctacccgatttcttgctatcaaaacataaaatataatcag

SEQ ID NO: 19370 - DNA, 1110 bp, Homo sapiens
  misc_feature (1)...(1110): n = A,T,C or G
ttatggtatcttgtaaatagtnnnnnttcaccnannnnnncnagcaggggttttgcccaaagaaacaccgggtgataaagtctagcttgggtgtttgtgtttccgtgtgtatcttttggagacagtcccacataaacacaggagagcaccaccgcgccgcgtgggtgtggtctctctctactatctatagtgggcgaaccccacaaagacgccgggtttcttcacgcagagccgctntggtgtatttctttcttgtcctntgtgggctgccccaaaataaaagtccgagaggtcccagggcgtgcgggggtggtgtgtaaagatgtctcatttggggggcacccaacaaaaaagaaagcgccaaccttcttttcgccggcgggggttgggccctctagcatcccatagaagcaggacagagagaaagtatcgcaatatgccccggggttgaggttttgtgctcctcctccctcgcctaatagaacacaaagaaaagataaaaacccagcccccccttgcatttttaaaaaagataaacattattcggttaacataatgggacagaacaaagagtgaagggcattggtaaattatatgtaggcaacataacacggctatacggataggtagtacacagcgtaaagcgcgcaggggcgcgcccttacaataggagtagtaagctgttttacccagctaagtagagtagaattgacatttgtccccaggtatgttttgaataaataacaaggtatgatccggagagaacttagggggggagcggtgcccgcctccttccaaacagtagaatttaagcgatcatcacgtagcccgcggttggcttctgtgttctgtggggaagttcataagaactcctgagacaaacccggcgggggtagtttttctaggctctgggcggcctcccaaaaactggtgtaacacccgctgcgccggttactctcgagttcataagtgctcccacatgatacagcggaagaacacgggctagtggtggttctgtcctatgagctagctaacaactagtaatgatcaacgatacgcgctcgtgacttatgatagtgtggctctgacgatacagactgcgataaagcg

SEQ ID NO: 19371 - DNA, 882 bp, Homo sapiens
cggggagaatgtagtgaataaatataaagaagaaaaggggcttgatggcgaccgcgcatacgatgtagcagctcgaacctcacctgcatgagagaagaatgaagagattcagagtggacgaagaattccaaaccccctttgcgagtcaaagtcgaggatattttttattcaggccagggaatggaataaagataataggggtaattaagaatggatgccaggtaatggacgacgagaagagaggtatgagaaacaactagtgctgtaatggggtttattttatgagagaagacgtgaatagaaggtccttgtgtgtatgaaagcggggagtgataaggcaagcagggtgtggcagaggggagggaggtaagagagagtggtagctataaatagtcatgcgtaagagggtgagtaaaggtgaccccggggagacgatcttgtggtaagtgtggtggtaagtagaaggataagtattgtttaagcgtgaaggatgggcgaatattttatttatgtccgcgtaggttgatgagttcaatggtgcgagatggacatagcgatataagtatctgtttgatgttaacggctagatatagattgaaaccgacaaaagaagttagttcggatgcagtaagagatgggttggggggagtggaaagaagagggaggcgttgagctgcgcgagtgcatttttatcgcgaataggatttatatgagttgataagctatgatgtgattgcgtatcagatagaatacggtgacgaatgcgggagagagtgggatgagtggatggggagaatattatgatgttgcgcggtatgctggagataatgtgcgtgtaatttgcgtcgcagtgatatatttgatataatgataagaagaagg

SEQ ID NO: 19372 - DNA, 1492 bp, Homo sapiens
  misc_feature (1)...(1492): n = A,T,C or G
agaggggnnaagaagggagaggnnnagagagaggagagagggngaagaagaggggaaagaggaaatgggnngaagaagaatagaggagaggggggagagaggagggannnnagnnnnnaggagagagaggagatgagatgtnnaagagagaggnaaggagagaggnnagagaagannnaagagaaggaggnnnaaagaagatnaaaggnaagaatgganaagagaagtgaacgaagaagagnnaaaagagaagaagaannaaagaggaagagaacatgnannaacagacgggagctaattaacgatactngcgccannaaagaaggtacataaagagnnacgaaggcgagatgnnacaacgtctatggaagctgtgtgtacagnactnannnnagattaggnggagacgagaagaggagaggaatgagcaagagnnaggaagaggagagagatataatgagaaagtgagnnangaagaacaggggaaggggagtaggnnacataaagagatgtgtagaggacaagggtcaagtcctagagaaggaccgagaaacaaagacggaacagtaagagantcgcacagtataccactaatcactaactctcctagaagaagacgcggagcncgaccgagagagtacgcgagagatcgaccaaatcgatcataaactacattttcactagtctacactatgtccccacactcacagcaccctccgtcggagcgtattaggatatatttcagtgttaattatctgatgtctacttcatccctgcttctcattactcggcgattttatgacatattncgttaaatgatatgccccagcccactgtttatctcatatcntntattatatctcagagatctctattctacttttatttcaactcaccctccttcatcccnactcacatctcaacacctccacaccaatctgacatcccaacagtcnncaatgtacttgcacatgtgtattcgcgtacagtgtcgatctgcccacaccgaaccactagtgagtgcactctccagtagcccacntagatgncnaccacacaaccacctgacagagtgtaggtaatatggtgnnnncntaggcgacgagcaccacgttcncncgcgcagcatcgncgagtgcgtctccagatcgagttttnnatgcgaagtacaagtatgaggtcaagatgtgtggatgttantnaactacactccccattgaccatatatctcccgcatcgatgcnnctgccctagcagtatagtgaattagtatcacatcaggtgcnncacggtcactnatgcntggagcgatgtnccgantcgagcnctctgctgagatgcaatagcgactaagaagagacgataaaagtgagagcgacagaggtaangcgcnnnnagatagtcatactcnagagtgtatgagtcncntgagtgtcnactaccatgtgttcacatcaccntacaatcagattcacatcgtaatagtcncncg

SEQ ID NO: 19373 - DNA, 905 bp, Homo sapiens
gccgagcacttcagttctataatgtatataccccacgaaagacgggtcctaggcgaaaactttagatctacactagctgatgaggcgacatggactttggaggacagaaaaatggttcgtattgttcttacaaagacaaagagagatgcagcgaattgttggacttctctactataatctgaatatgcatcggatccttgggtgcaggaccaactgctgagaaagctcgcttcattacaaataccaagaagataattctggtgtcggagttagagagcatctgatttctcaggaaattgcaccaatttgatgtaccagactgtcaaaacatagatccaatatctgagacataagacggagtaggggagagaagctgcaagatgattggacgtatgggtaactaagttcacgagtgtacatattttccgagcgctcttgtacacgttattttaatattatataacgattccaccatcccgatatcccgaggacgcaataggcttattggcgctatttaaaatgtggggggaaacataggccacatacaagccaccctataacaagattgaatttcagaacgcgtgagttattgtccccccgtaagaagcatccgtagctcccaactgagtgattgtaggttaagagatagatatcgactttttttatatgccagagacagtttacactacgttaacatcaataatcccgccacatttcgttaggacggcgttgtgatacggagagatgtcagtgagaggatagggttgatgaactagatgtggactgtagtacggatttaccaagtatttgaaaacacagttatgtgttggcgtaaaacctgatgcgcagtggtgaatttttacatcgagacatcagtcgtagagtgctcgctagacgagacatat

SEQ ID NO: 19374 - DNA, 1011 bp, Homo sapiens
  misc_feature (1)...(1011): n = A,T,C or G
ttttgnaaaaggaaagnnaagaatgtaaggaagaagtaatnaaaagtagtnnagagtattgagaaagggaatttattgnnnannnnaaaataatttatttaagatnntattttnnttaaaattaaatattanataaagaagnnnaataataaaannaggannaaatttatattaatattnnaataatagaaannnagaatttagaggttntctatatttaagtataagtntttttatatattctgtagtgtnacgtagtatgttgtgaggaatgagaatttatatggaattgntcaattagtgaaatgaaaagaattgattttttattnnatgtatatgtaattgtatgttagttaananaaatagataatagatatgtnatgtcgtagattatagaggagagtaaacaccaatacacaaatacacgncatgaaaatagcgtnaaaccgaacctccaccgtcatacattctctacttataaggtaagtgtattttttcgattcagttacaccgcgtcagctccgaacgcctggccctccgcnaatcccgcctacgcccgcgcacccaacctagcctatccctaccacgcatcccccacctccccaccctccattagactccctacctttgcacctatctctctctcttccatgtgtttctcaggtctacatcattgnagaatatctctataatcctcagattaacttttgcgtgctatagtcgtgccataccagttatcccctagcaagaacgttatacgggataagatgacacgtctctnccgaccgaccaccgccccctccgcctgccgcactnctctatcgctccatgcgtcctatncgccccccccctatcccctcccgcnccccctcaaccacttgcgaagcnctataaggtatgatacaatactccaagtatggctcccgcgtcgccgatctccatctcatggcctcgccgcccctacttccccactcccctcccacttcctctcccctatttctccaaggccaa

SEQ ID NO: 19375 - DNA, 112 bp, Homo sapiens
atgacagggtctccaaggctgccgggtgtcttgaaaaacgtctcacgatgtgtgcgttggatgctcttgggggtcactggaactggtgactgaaaaaagaaaaaaaaaaaaa

SEQ ID NO: 19376 - DNA, 1527 bp, Homo sapiens
  misc_feature (1)...(1527): n = A,T,C or G
taatatatcaaattgttaaaaaaaaaaaaaaaaaaaaaaacaaaaaacctgnctttttggagtcgaaaaaggcctttttagcacactactcgagagactagccatgcactcccctaggagcgactaatcaactattcgcacatagcatccagcccattggctcaccggcatgtaggctagctagattagcctaaaccgccactatgtagttactcacccacttaaccctagataactcgaaagccctactgatattctacaactagatacagcaaaataataataagcttacactgagcaaccaaacataacaaaatagaaagaaaatacaccaccaatggaaacgcatcgtgttgtggcgagcgcgactcatccttgagacagaagtagagaacactggcgtagaaacgcaagagccgaacatccacgatatctcacgtacaatataaacaagtaaacacacgcacaccaataaggagataacagaaacagaacgaatagacaacacctaacatacaatctgacaacacgacaactatagaataagatacaatattaacaaacacactaccagtccgaggatagacacagaccaacagactgaatacgattacacacaatagaagacacaagaaagaacccgaataagataaccagcaagacgaaacatacataagcnaacacaatataggacgtctgacaagataaaaagagaaagagaatcagtctaacaagcaatacatagagcacgaacaccaagcngacacacccganccattcacaaatatactcacctctagcatnagaatgtagacctacgnacatagcacnagaaataaactacactacttntatcagtactacaganatgacacatacatatatanatatactaagacatcacgccgacagacaatatgataattagacgcagcaagtaatcagcataagagcatgctgaccactccgtacgtaatgtacantacataaaacgtgatcgacagacacgnagcagtcatagacagcagtgcncgatcntacatactagcagctnactagatatacacnatcacacntcgatgctatataacgtggtactgaacaanacatcgantgactgcagctaatcagcatgaatctagcatctaacgatcacccnatctcacacgatcatcaatnncgatcaatacgacaantntgntaagtgacaacngatcatagacacgcatgtngatcgtgntcgtacagacgacaatagcatgactagacgaaanatatgtagagtagagtacacagatantaanagatcaggagtagcananagatagcatacacgcaacagcatcatagtaaagacaaccatacntaacgnantacgacgatcgacgtagcacagcgtagatacagacacnatcactgatacgagncagtgatcgacgatgtatcaanantaatcagacatataatgatacanacnaagactacacacacacnagacgacntangatnataacgtcagcacacgct

SEQ ID NO: 19377 - DNA, 1094 bp, Homo sapiens
  misc_feature (1)...(1094): n = A,T,C or G
ttttattcacttcctttactttaaattttcatctctttcaggcgattcttaccttattgcgaaattgacaaattatgctggaaaagttactgaggacacaaagcagccgatctgcttctcctccgatcgccctggagttggtcggtcggctcacgactcatgtccaatgctcttgcnagcactgccggtcatgctagcaagcgctcattgtaatatcttagttgtcgcactcgacatgccatcgtaaaattgcaataatatcagttatgcacatgacttggngaaaaacctcggatatctgttgaaaactctcgtcgcactcgatcaatgcatggatcacacaagttaggaagaaaggtggatcctgattctatggatgctgtgaatgacaggattgcataactcttatcagtacatcacaccaattataatctactccattatgtccttgatagcctgttctacaacacataatatgtatttcatatgccattctatcacacgttacactacacctcttgttagcctattctattcttaattaacagtcacgcctcaatcataactccctaacaaacagatcgaaacgcatccatcattattactaggccaaacataattcaacttaatttgtgtaacttttctcatttttcattttacactcgctttcgttttcgtactgaactattgttactctcatgtctagtcatccatcctcccatagtctatcgcatcattcaataaacataattatcaactcgatgtcatcttggtcatctcacatatcttctacaacatcacctttcgtcgcctcactcttgaaccattcacagcgatggaacctacttgctttgacacatttactcttttattgcctgctctatatccaattactctcttctgtttacattatcattatatcgaactttagttactatacgatattacttatttaaatgagaatacaatacacattataaatcaccagataaattaagaaattccagcaccatacaggaagaaatattcactactctactcactcttcatctacacatccatatattaatctgcaaattanatcttttagactg

SEQ ID NO: 19378 - DNA, 1172 bp, Homo sapiens; identical to SEQ ID NO: 5941
  misc_feature (1)...(1172): n = A,T,C or G

SEQ ID NO: 19379 - DNA, 972 bp, Homo sapiens
accacacggaatgttttttttgttggaggaagagggaggaggggcttataccagacgctcataagcaattttgagtgagtgaagagccatgcccagcaacagaggggagcctgcccacttggagcaaaaggagccggacaccagattcacccacggcgcgatcccggtgacggaggcagtgtgagcaggcaggcgggtggcactctggggaagggagaaggattgaaggtgaaaggggcacaaatggcctccagggtaacagtcctattagtgcctctttttctggggggggggaacttcttatcaaatctttcttgcattcccgtgataaaatgttttttaacgtgagctaccataaaaaaagcgagtaagaactaaaggaaataatatttcccccggctggtgtgtcctatacgtgtacggcctctcattagacgtcatacttgatcatcggggtttgtaccgaccgctctgttctacttctttattctggcatgcagagattggcacaccagttttactatatcacccgcgtcccccaactatatgtgagtctgcacgactttaatataggtcaatattaccgtacataatactcgatacctacattatacgatatatgtcacttcccgccccgacgccgcccttgatattcatctatgactattgttgcagtcttacatttataacaatccaccagatacagcttgctacacggcagtacatgttataacgttgttacgtagtatattgatccgagataggatattccaacgataatttgtggggcgcgcgagactgtgtttataccccgcgagtttagatatgagggttgtgtcgctaacacgagtcaacacaaggagttagatgcgtagattgtgtctgctattttatgatgtcagtactgcggtatcggaatcggtgtgcattattagtaagagatcaggacgctagcatggacgacgttacgag

SEQ ID NO: 19380 - DNA, 1170 bp, Homo sapiens
  misc_feature (1)...(1170): n = A,T,C or G
aggtagggggntggagtgtagttaattatggtaatataaaatnatataaatattaattataaagtaatagaaaaggatgagttttagggaaattacatgagtaagtaggnatttatattgttgaagaccnnaaagtaaaaaagagaatggatgagagaatagaatagataagagaaaatagtaaagatgtanatggagagtttaagntattcagnnncatcgacagcagtggagagcacactncnncccaagtcttaccgccaagtcctccccacttttccggagatagnnncgacaaagcagaatataataggatcaatatgtcacacatatattaatcaatatnatatttcatataccttatattcatgagcatgtatttacatgtgtcgatacgtggcananatcagtnnaaaaagaatagataacgtgcagtagagaccgtgcactagcaccgacgacncaaacctcagacgccaccacacagcaagtcacacgctcattgagtttatttaatatgtcctacatcccacgacaagatgattaccatcacagacataccatagagantanccgccacgataagaatggtgacgagagtactaaacggcttgttaaattccatcgaaacactcagttatcacgaatgaagtnaagttgaagtatgggtagatgtnnaatatttaaagtggtngtgagttatttgaaaaacaaatcagaaggnncatatgtatttantaagtttataaatattttntattccgaatacgcactcagattccctcgtctattagagtgtagttntatagtagataagacacaaatcaacaaatagaaaagttnatagaataggagganaatatacgtgnccgggataagaaatagcaaggtcgccaccacttcttctacctctatcgtacgatanccagccaacgaacaactcaacactaccgaatgaaccaatcgtaccgagtgtcctcaccccactatcatcccctcttctagcatacaccatacgacactgctctcgatcaccccactaccactatcccgcagagcctagcattcccccacatatatctaaatgactgtgccacaaccagtcctaaacacaccaacgcacgccacaatccccaccacagcacgcaatcaggtaagagggcaatagcc

SEQ ID NO: 19381 - DNA, 909 bp, Homo sapiens
ataggaccaatatcggtggaatataattatgaaagagaagaccttcatagctgacgctcataagcaattggagtgaatgaagtgccatgcccagcaacagagtgggagcctgcccacatggagcaaaaggaggcggacaccatattcacccacggtgcaatcccagtgacagaagcagtgtgagcatgcatgcagtggtcactctggggaagggagaaagaatgatggtaaaaggggcacatagggcctccagggagacggtgctatctggcctcttagttatgggtggatggacactgaatggaacgtgtgagaaaacttaactgaatatcatttttattacatgaatatttatgaacatattttgaatgcttatagtataaaaaaaacgttggtaagaataaatatttttgtgatattatacttggtggcttctttttataaaggttaatatgtgatcataaaacactgacatattagtcataagtggataatatggtgtcatctctgctatatttatttgcgttcggattttcggttcacaataagtataaagttgttaatacaacttaagattttatgttttaaataataattaccacgcttatttgtacttatatatgtatatcctaatttcagttcccagtaaattatattacatattatgtgactagcaatatatttttttatatatagtgactgtaagatgaactttgctaattaggaatagaaatttatagtaaccgattggttatagatggtgcagaactatattaactcactaccatatattattaaatgatggttatgtcccttgatgccaattttcagtcctgtgtcaatataatattatgaactctaataggattggtcggataaaaatttatatacgtatattttataagtttg

SEQ ID NO: 19382 - DNA, 867 bp, Homo sapiens
  misc_feature (1)...(867): n = A,T,C or G
gagattctggacgcaaagacaagggagaagctgtgtttcttggacaaggtggagccccacgccaccatgtgcggagatcaagaacctcttcactaaaacccatccgcagaggtaccccgcccgccagtccctccacctggaccccaagggcaagtaccttgaangatgaggatgttttgcataagctgcccgtgggcaccacagacacactgtacttccgggacctgggggcccaaatcattttggtgagggttttccttacagagaacagcggggcccctgtacatctaccgtgttaggtactttgcaagtgcccctagatctatngccatcaatattgacttagcggtccaagagtgctatactacgggttcgcaatcggactagacctggcgctgtcgatccagtaccgatagagtcgactcggtgggagacgcaattntaagctactcggtcagtcaggggatctatgccgtttgagcacacctcctcataaagcagcacgctgactagttggagctactgcgcgcgaagtgggatctataaatataatgtttcgctgtttcaactttgtgcctgtgccgaaggggaggtgggataggtgatgcttgccgcactagatatattgtggcgcaggacttgttcggcaccgcggtactgagaatgggcctatacgggaatagaggctccgatgtagacttctagagaaaatagtagncgtcgtaaagtcctgtcacaggtaataaatctactacactgctagctagttacagacataagccntacacgctacacggtacagtagagagacactatagtgctatggcacggatcacagagggataactctgttaggaagtgacggag

SEQ ID NO: 19383 - DNA, 848 bp, Homo sapiens
  misc_feature (1)...(848): n = A,T,C or G
tgcaactgaggaacatggctcaagaaactaatcacagccaagtgcctatgctttgatccactggctgaggattttatggaaaccctcgtacaaatggcatgtgttcattatgctataaataacatcttcaaagacacaatactagtgattgggagaataaacccacctgcagcctctgccagcaacctgaattactctttcccactctattgctcaaacggctctgagcgtaaagccaaatcagatataaattctacacacttctacactacaaaccatacaatgtattaaagtgaaaaccaataaacatcaaaaatcaataccatgtcaacatatacctcacaaactacctgccgacactcataaacctttacactctatataagtccatcatagaattaacactactcaaattactcttgcctctagttaaaaccaaaatccatatttacataccctaatactaaaaatagtacgggaccctatgatcaccagttaagagatataatcctaataatcaaatcaaacatgtattaataataacacgacaatgactcaaatctatattatcccatcacctacaccgactatacccacaataagacttttatattattataataaccatactttcactctaatttatgctatatctattataataccataccaacgaataataaaataacgccatataaccttacgtttcacaaatcatcactttactgtatgacccactcaaattgacaaatacgaccgcagctacttctccattctcaacgaacgatacactttttaactgatcacantacattaaatactttagatactacatatacgtactctag

SEQ ID NO: 19384 - DNA, 937 bp, Homo sapiens
  misc_feature (1)...(937): n = A,T,C or G
atactttaatcaagctaatttaatatataaaaancttacctgaaacgatctcttattttcaccgctacagtgcatagtatgggactgggactccagtggcaagcttgacttcattggacaattcacctcgacattcaaggatatgagaggagcattgcaaggtaaacaggtgcagcgggagtgcctaattccaaaacaatgtcaagaaaaagaattacaagaccttaggcactgtgattgtagatttgtgcttgaattccattatgcttatttatttagaactacttatttgataggttctcaaatccaatgttcttaatttgttaaattctccttatctggagcgttgtcttcaattatcagatagatattttatctactttaaatctatacttttttattttattaatattatttttacagtatattatacgtaatatatattacaatctaaataagtattaattataattttatattgtttttttctacatctctatctatctcaaatttgttccttctgtaacgtagtttttattagatattattcttattcgtgttctgatctagatatcttcttaacataatttatataatgtaatataaattatattaaatatataaaataaaagtcttactaacataatatcgctttcacctattagattaacataatttattaaatgctatacaaactcttcgtattacgattgtgtaccggctgttatgcagctgttaatatttcttcaccatgcgacctgacactagacaaatcaccgtattcgtatgtagattttgataatcttctatcaacctccttctaagttagtagtattttaagaatttctcactaggagccagttcaatactttctgtttttatttggtgtttagattttgtatactattatatcggttaccatcaaaaaactataaag

SEQ ID NO: 19385 - DNA, 357 bp, Homo sapiens
taagctttagaaatgcgtacgtctgagtcgtagtgtttactccggtcaggctatacaggtgcctcggctgttcaccttggtatttccttcattctctctcgtgtttggacctttgaaataaacgtacaccttgtccgctttctccctagggtcatgggggggctgtcgatatgtcccttagtcccttttatgtgggtgtgatttatctgatttaccctttaaatgtctactacctatggtggagccgaacttttgtctaaatggagcttgtggtgatttgcccgagattgtcactattttggcctgtatgcctccttttaactttgttatatgctgttttctctaaccttgcgtctg

SEQ ID NO: 19386 - DNA, 932 bp, Homo sapiens
  misc_feature (1)...(932): n = A,T,C or G
gtgggggacgtgttctgggcacgaggggggggggaagaggaaccctagtgggcgatgactctcttgagtttccaccgctacacataagaccatgatcatgtggaaactgaccagggatgacaccaagggggggaggtccacagcgtgctctggggggtcactcccactttgttagtgatgtgcgtatctcctcagatggccaggttgccctctcaggctcctgggatggaaccctgcgcctctgggatctcacaacgggcaccaccactaggcgagttttttggccatacgagggatggagctgactggagccttgtgctctggcaaccggggggagtgggctgtgggatctcgggatagaaccattcaggcgtatagaataccctcgaggagtgggcaaatgcgctgtgcgaggatgagaccacgtcggactgaggggatttcaaggcacttgtcgacgagcaggaggagggggggttggggaggcgagcggggcggagcaagcttgtgaagggagtgggacgctgggtgaacgcgggccacgagggccaccgcggttaggtcgaccggggttgtgggcgcggggggctgtgggtcccnaccgtcccctgaagcgtggagaggagcagaggatggccgcacttgccgaagggatggcactggagggcaggggccttgtcgcgtttggtgcgggggaggttggtgacggggcgtggtccaagggggagaaccgctcaacggacgtagggttcagagaggtccacgggttgagtagcgcgggttggggggaggcggcctccgcccagaggcacgtggagcaggttgtcccgtgtgcttagcgagggggtatctcgccctggaatggcctgtggtagtgcctgctcgcggtatgtgggtgtggcatctgggtagcgccctcgggacacaggaag

SEQ ID NO: 19387 - DNA, 950 bp, Homo sapiens
gtagggtgacttatcagtgcgtgctcgggtgagggggaggaagacctattctgaactgatctcttatttaccaccggtaccgataataagtcatgattgatcaagatgtgttcagctcctgagccgggacattcaaaaaggaaccacccaaagaaaaagagtttcaaagcccatggctcagaggggtgcgcacaacaaccttattttggggctgggaatccagagctgtttattagacctaacggacctgtgtggggtgggcggatgggtaactctttcactggtgggggggatgcgtggcttctccctttcgctatcggccgagcaattcgcaggaccgtgtatgagagggtgggatcggtgaggggtacagttgattttgctggagaggacattctcacgcctcagtcacattggggcggcatagtgggggaagtgggtgtgatttgtgtttggggagctctcttcgcgttgtttgatggagggtggagcgtcgcgcgggtgcgcgtggccgtgatacacggtcctagtgggggagtacgtgaacgctgggctgacctggtattagttgtatcttgtacgcgagaccgtgacaggtcggattcggggttcccagggtctgaggtgtgggggcggatttaatggagtggctatgtcagtgcgaggtatggcgtgatcggatgggaggtagggtgtggttgagtattctttaggatattggtgtgagttgtaaccgtgcgtgtccgtggagaaaggcctgtgtcgatgtagagatcgggtgcgaggcgctgaccttgttctgctatgccttgttctcgttgcgctgcactcattgattggtgctggacggaatttgtgatcgggaggcgcgtcgtcggtgagcgcgcactcactacgctttctcttgtaaggggtgtgctactgggcagttcgggcgctgttgctcgcac

SEQ ID NO: 19388 - DNA, 1091 bp, Homo sapiens
  misc_feature (1)...(1091): n = A,T,C or G
aagggaagtcgtcagcatatgaccagcgtatactttatgaaatcacatgtgagacattcttttaggcgattgtatcgactaatcgattccaactgtatactctctagcctacatgtaatatatgtctgcactgttcagatcgtcgttgtagctgtcggcttatagtgctcgtcatcatactgtactgacttaccctacgtgtccggcgacnaatcatcaatacgattactgcgtgactaggacacatccatcactgtgatgaaagcgcgcagagatattctcacatgatcaattcaaattaatctcaaacaagagcaagactgtgaaaagaacaattattcaggtctgtcttcatttaatagtctgatgagcggactatattatanattcattcgcacattctntatcatataaacaccgcgcgatgtttgactgacgagcaagagtgacgactgtcgaagctgcgttttactcacctcagtccccatttgtactatctttaactatattgataaacgtatcattgaatcggtactggctgattacgctaattgcgattatatggacggttcactagaagtgtccaatgaggatagttacaaagatggtaagtcatttgtttcatatcacagcagattatgatatcgtgccggaagattacattacttgaaaggagatattgcctcctatacgcagttgcttctcgtcatcatacattatttattagagatgtgctaaggtagctgcaacgaaaatgtattgatagcctctcgtctgcacttatgacgagttttatacaggggttacctatcaaagtcctgataactagtgtgtgtcatgggctgtgaagaactactagttagtgttgtgaatcccctctacatagctgcgagtttcatatatatatgtattcagctcagcatgcagaacatactgccacctgtccttctatcttagcgcgcgacactcgttagctatgactttttagcttttccaataattctatcagctaacatgtcagtcttctactataatatcaaacccggtgtcgcccgaaaattgttctggatttcggattggaagttatggct

SEQ ID NO: 19389 - DNA, 2701 bp, Homo sapiens; identical to SEQ ID NO: 10099
  misc_feature (1)...(2701): n = A,T,C or G

SEQ ID NO: 19390 - DNA, 1489 bp, Homo sapiens
  misc_feature (1)...(1489): n = A,T,C or G
ttaaatatatatataatgagggaagtgtatgaagagaatttttttgaggatnnggaaatagagggaacgatttttaagctagtgccgtgtgtcggataggtgaggtggcgcaacggaacaactcattactcgtgcaaagcatctaatattaaacaagagatgagacgaggggaggagagtntcgatcatatgatcacgcattatttttactctccgttactctcgttatttgatgcgatcaagacttggttagagagagggcgtcttgaggtggccgagcgatattccgatggaatcactatccacaccaatctatatcgtacagttggcgcgacgttagtgagttctgtctccgctctcgacctatctgatagtgggcgtgcgtctcncgtcggccgccagcctacacggtaccgttctttcattcgttggagcgccgagctaaccgaaagaccccacgtaacattaccaataatgcctgaaacccgtctcactcgacgaattacctagagagtgctccgcaaccccccgacaccgaacggcccgcgagcgttgcctcgggtcgggccggctgcgcgggtcgctccccgcccgctacgcggggccgtctgttcgccggtgtgccacgctcagcgccgtccagatctccggcccatgcgcgcactcgctgcggtcacggcgcgtcaacgcaccgttccgtcccacgctgcccccccagtgcagcttggtcgttcgacccgattcggttgccgcgatgcgagcgacgtccccgtgcccacacgactccctgccgcccggcctcctaccgatacgcgaactcctacgcgcctcctcccgacgggttatcgccagccgacgccccccacccgacataatgatccgtataccttcccgtccggttgccgaccacgcggtcgcccgcgtgtcgccgacgggcagcgcgctcgcttccggcccacacggcactccacgttttcccccgcgcccgcgccccacccattacccatgttcacgtcgacatcaccacacacattccacccacgcgccgctatcacgcattcgatgttggccttcgccatacaggtccggttccgtaacgtgacgaccaattgcccacgctctatcgccgcgccagcacgccatgccacacggtcatcgacacacgcgcgccgatcatgatcgctcgcagatttctcccatacacgctccgccgtgtgcacgattctcgtcctccctctggagaatttacccgacccgtaatctaccctctatcccgcatatattcacctactctgcattcgccgcgcccacctggataatctcaccacgcacgcgcgatcctgatgaccccgactcccaggctaacacatgtagtccctctcgcacggacgtcacgttcaccccgatgtcaacgctccgnatgtgccgtcgagcgcattgccagcgcgtactatatgcacatctgcctctcagagcacatacgtcttct

SEQ ID NO: 19391 - DNA, 1132 bp, Homo sapiens
  misc_feature (1)...(1132): n = A,T,C or G
gtcgcgataaatgtggaacgtaggatgccgtcgcgctcagtctagtagatacttcgtgatagcaactgtgaataacgttataagtnnatcgacatgttctcataatactgtatgagagtaatatgtggagnggatacgtggcgcatagatgcacgtattgaggtggtggatgnggttgatgtgtgttgtcgaggagttaccatacatctcactgacgcggcccgagagtagagagtgggtgaagacggataagagtgaaacgatttacactagcanagaaagcgtagctggaaagattcttanagtatgtataggtggaacaattgtaagagatagcggcggcgtatagcgagggaggacgagaaagcggcacaagtaatagggcnagatcgtaagtaatgaggcgggccattgagcggagtgctgggtggttatatcttaagtacgggctagacagtcgagcggcagctgcaccgaatgtgtgttatcttgtgtgtttgtggcggtgtgggttcagcactcgttggatgagcggtgggaacgagactggcgtctcagaggaggcgaagttgaggagtggggagtggggggaagggggtttacagtgggagagcgcgacatcacgcgatcgccataattgctataacgcaggattatgtgtacagacctttactaaaataaactcctggagtgcgcaggtgtgcaagctgtagaggataaagttatcaaatgtctctcgaaaatgtccaacgtcccgcgggggggaggtggggggtggggcgcggaggaaaggagtgatatagtgaaaagtgtatccatttttgtcagtgtaatagataggagcatcctattttatattttcagtctcagttcgctgctttctgcctccttattcacacctcccctcacaccctccaagtggcttcttcacttaaatgatttagtacaaggtgaggttgtttttttagtttatggccgaccgtgcgccgaggcaatggcgcgggggatcatggctcgcgtacctccagagccccgccccccctggtccccngcctaaatctagaccaacacaacagaccccgatcgagacacctaaaaagtcccatccaacgaaaacatatatacagaatat

SEQ ID NO: 19392 - DNA, 1059 bp, Homo sapiens
  misc_feature (1)...(1059): n = A,T,C or G
gatcgccgcgaacgcaaagcaaccccccgcaacgaccccggaacccctccccgggtaacacccgggggaggacttacccgcccaaaacccgccccccccccaataagaaaactgcccctccccccgatcaccagagatataaacgccttgggggcgaaaacaactgagtacgagaagaccccctgtatgcacccgaattatcgatcgcggcgcgcagatcacacgcatggtaattcttttgacacttgacacacgagataagcgaagcggaagggacatcaaacgcaggacctgcggtggtgcgggcgcattttctttgcgcaagcggtgaaccgggctatgccaagttccgcgggcgccccgccttacgtacatgcttggctcgtgccgcggtagccgcccccctttattcaccccgtctctcccccccaccccccgtaattaatctcgaagaatatgctaccacacacgccactcccaccggtttgattagatgagctctataccccccgcaccgcgatcccaatgacatacaatacttaccagataacagaacataaacaccgagacgattcgccgtagtgcgagggtaaagagcgtcgcaaaaaggctccggaagtgggagcacgccagatgaatacgaacggcagtatgcccaccacgtcgccaccgcggcgagttctatctgagcactgggatgccctttagtccgccggtccgcgcgaatagcaccacatcgaccacaactcaaaagactagcacctccgcccgtgtatggtgccatgacctacgagtccccctgctgccanacgtaagtcatcgcaggcgccccagcccctccctgtaccgtctcgatgatccaccgacattaacgctccgacgagcgagccgaccaagaaaagagccgcggcccaccacgccacacggccacgttctatattgaagagtttgtacgcggcacgcgcatgcccggtatgaagagccgcgtactaagacaatcgtagatgacacagccgaggagccgcggggaggacgggaaccatcacacgcgagcatgag

SEQ ID NO: 19393 - DNA, 643 bp, Homo sapiens
  misc_feature (1)...(643): n = A,T,C or G
atatatcataacgangccgaacaatccgtcaccctccgcttgtcatcgcttcatatacactacctcctcgcgctcanccagctgccgctgggggtgtctttttatatacttcatcgctctacccccagccgccttccccgattcacgcctagcttcctaccaaacaccagtctccgataccgatccattcctacagcacatgatccacgtgcgaatctgcctcaccctggcgcaaattaacggtattaatgcgtgactgatgactaaaatacagtagcttacaacggcgggtgtctaacaaataaaaataaaaaattcatccactgcgaaacagtaatgagcgatggtgccaacgatcagacatacaacaaaataatttgcaattcgttattcaattcataactcccctacaacgccccagcaagaacaatgatagaataagataagtcaaggctctcactctctcacaagctcctcttcgtcactagacctctacgataacaatattaataatgacacacactccattacgtcaaactcgtcatcaacaggggcctaatcaatgtaacagggatgatgcgtggaaacactacaataaccgcacctgtcacctcatcccaactctttaaaacnncancncant

SEQ ID NO: 19394 - DNA, 420 bp, Homo sapiens
agtgctgaaagagtgagccaggacagcctttcgacattgaacaaggcaattcccaatctcttgagccctggctgtgttcactgaatggatctagtctctgaaaattcaccgacatttttggcttggcgctgtggctcatgcctgtaatcccagcactttgggaggttgagacgggaagattacgaggtcaagagatcaagactatcctgggcaacatgatgaaatgctgtctctactaaaaacacaaaaaattagctgggtgtggtggtgcgagcctgtagtcccagctactcaggaggctgaagcaggagaattgcttgaacccaggaggcggcggttgcagtgagccaaggtggcgccaccgctctccagcctggcaacagaacgtgactccgtctcaaaaaaagaaaaaaaaaaaaa

SEQ ID NO: 19395 - DNA, 814 bp, Homo sapiens
  misc_feature (1)...(814): n = A,T,C or G
agtacgaaagaagaagagggggggggatgggaggtgagggcaggggctgagaggcaaggggcggggcaacaaaagcccctccaccagaacggcgcgggcccggaggcgctaaagcacagcacaaagaaaggcagccccttcgactcgacaactccccaggcggtgcgggacaggggcacgagcgggcgctactgcccacggtgctcgggcccgtgccaaggtacccaccccggacctacccccccaccctacaaccccacgccacgacccgcgtganaagaggcgaaaaacgagcggagagctgggcccgtctaattatatccggagcccccacacccccagcgggcaccaaaggatgcgcgccccagggatccgcacagaaaacacccacgacccgccgacgggccgcggacgcagggggacaggcaaaacacagcactcgacttagggagtgcagggtcctgagaggcgcgtgcgcgccttgttcggggccgagactccgcccgaagaataaaggcgtactacgtcggagagaccagaggaaaatgaggttcggtgtcgagaacgaggggggggggagggagcgtcaggggaccaacccccacaaccggcgttttacccccaagtgaaaaagtcacgagtccaaccccccctaagcgcccgaaaggccgccgcaggtagaacggcggggcgggaggagcgtaccctggacccatgtggtataacccccagatgatcaagcggaagacagaagcccgccggagagacaccgcccgaagacccgcaggccgcagtccagcgaggcccgtgaagc

SEQ ID NO: 19396 - DNA, 1137 bp, Homo sapiens
  misc_feature (1)...(1137): n = A,T,C or G
aataatattagatattaagtgagagagagagatgatatcgtattaataggtatgtattaatacaataaattatatacgatatgattagatanattgagtataagaagtattgaaatagaagtactagagtattgtgtatgagtgatgtgtagtatatcgttgaagtttgtgtgagtgagtagtgataatgttatatatgggtctatatatatactagtgagatggtgagttggatgtatattatataagtgttggagtgatattagttaattgtacgaganatatctatattattagtgtggtgtatagtagaggagatttatttcgatgaatatagataattagataagagaggngaatatgaatatttatttgaatgagtaatgtagagtgtaggagtggggtgagtagattaatattaagagatgagtttgatgtagtatgggttgagatttgtataattgttggtggatatattagagtttatttaatttgtaattttttttgtatttatatatagaaatagagttggataatgagagattagtattagtgagtaatactataaatatattggtatagtaaggaagaaaagtatagataaatatggagtataataagagaattatgtggtattttgggatantgatgtggattgaaaataagtgtgggtgaagagttaatgtattggtatatataagagatgagagatgaagtaagagatatgatattatataaaaattgttttgttgtatgtagatgattaggtggaaaggggtaaaccgcaaaaggaggtggtgtaggataagagaaatggaggaaggattggggtgttaaaagttagtgtggaaacgagaaaagtggaaataaatgtgagggaggtggaagggaaggggaggggaaaaagaggggaggatgaggtgagatggtaatggatatggggataggggttggtatttggaaatggaattgcccccatatttaggatggggggggaataagagggagtatgagaggatatataaaggtttgggatgagatgaaggtaagtggagatagtaaataataaaggttgtatgattgatatggtttgtgttagtatgtggcggtgggaatatatgatgagagataacgaag

SEQ ID NO: 19397 - DNA, 216 bp, Homo sapiens
cctccgtgtcgcctctccgttccccctccccgacccacccacttagtcttcgtccggactcctttgcattatccctcgacctcccatccggcccagttcacgggcgaatgcgacttcctataggacctattggggccgcggccccccctcaagcgccgcgtactggtctagcctcttttgcccccagccccagtacccgcgggtaattccactccc

SEQ ID NO: 19398 - DNA, 1125 bp, Homo sapiens
  misc_feature (1)...(1125): n = A,T,C or G
ggctgatacagcgccacgcatacacggccgcgcgataactcaaggctcttactcccgtagtctcccnttcatgataatgtctccgcgtatttctcgntnatcgctcgcaacatcatctatcgacgtcccgaacgaccatcataacgcgccctctccgttttttcacccactatcccttccaactctccatacccttcccccattcctatgtacatttcctcacacaccacacataaaccacgccggtcccgtatcaccccacacacaatttattcacgattgacgcgttccgccgccgtacttatacacaacacagcatatacatcatataacaacagcagtcacaaacgcacttaatacatagatccacaataccaccaatacacacataaaataggactgtcacaaggtaagatgtgccataaaggtaatgaggaagacgctgagcgagccatcatagcatatggctgagagattgaatagatcatcaaagagattcaaagtatcacaaacgcgaaagcagtaaggggagaaatgtagtgcatagtagagataaagagagaagagaaagtatactgtatcagtagttagtagtagggaggatagatagtagaagaagaagaggagagcaagatgaatgaaaacaaggagacgaaggcagatggaagagaatagataagcaataaaggtgagagtgcatatatgtaaacggacaaaatgaagtgtggacgaaaaagtagaaaagaaatagacaaaggaggtgtcacagactagtcgaggtacagataaaagagagggtgtaagcaactagtatgaagtacgggtggaacgatatcgagacagtaatagagatgggcgggtatgagttcagtctctgagatgcgagtagaggcagatagaaaaattattcacggataggtcgaccagtgagtagagatntgcagatagagatagaggtgagggtgtaggatatatagtgaggcataatatnacacatgaactgaagtacccaacacacgatatagatatgtccagaagacacgagctctcgaagacgcgtactatacgatgatgagagagaccggaataggcgaaggagtagagtcggcgagatagagacgagag

SEQ ID NO: 19399 - DNA, 716 bp, Homo sapiens
  misc_feature (1)...(716): n = A,T,C or G
gagtaaaaaaaaaaacagaaagcnccctaactggagacactctcttaattttcaccgctacaacttgcttatgcatgatagtttgcgcagcgtatgcacaccaactgccaaaatatggtgtgaaggttggcctgacaaattatgctgcagcatattggcccgcaggcttctcaataggtttggcatggacaagatctatgaaggccaagtggaggtgactggtgatttattacaatgtggacaggtgccttcacctgctatttggatgcaggccttgccagaactaccactggcaataaagtttttggtgccctgaagggagcttgggctcacagtccaaacgattcgctgcttatgattctcaaagcaggaatttaatgcaaaagacatcggaagcccattatggccaacaatgtcgaacgaaacaagaacaaaaaggctcaccaaaaacaggttttctaatacataaaagacattctgatcttcaaaaatgattggaggacatgctctaaaaaccttctactctttcaaagaacccgcgagaataactttatagtacagagggacccggcccaacttcccgttactaaaaaatagaagtaaagcgcaacaagacggagggccttgaaggaagcccacagaagtggagtgtttgtcgctagggaccagaggggcgccacccgcgggccttcgcgaggaggacagatccaccccca

SEQ ID NO: 19400 - DNA, 719 bp, Homo sapiens
  misc_feature (1)...(719): n = A,T,C or G
attgtttatgcccgtatagagggggatatgatagtgtgtgcagnggatgcacactatttgtcaaatatggggngaaggttggggggacaaattattggtgtaggatatagatatgggactgtgatggccggtaggttttttagaaggtttggggaggacaagatctatgaagggctaggggaggtgaatgttgatgaatataatgtggtataaaatggtggtgaggtagggtgatttagaatgttatttagataggggggttaggagaaataagtatggggataaaattgttggtgttttgaaaggatattgaagtgtgggagatgagtgtttctggaatatagaaaaagattgttggtattgatttgggaagagggagaattgaggatgaagatagattagaggatgttagttgagtctatatgtgtagaaaaaaatgaggtattttagttttagaagatagaagggctgttgggataaattgtgtttgagaagacagtagggaagtgtgattagtggtttgggtggaggggagtgtgaagtagaattagagtgttatggtacagataaatagcagtgtggttaagaggagtatgcgggggaggaggtcgtagagaataaatgggtagtagtaagaataatggcgatatatgtttgatagatatagaatagattgaagagagagggcgacgtagtccgacgctcgagtacccacccct

SEQ ID NO: 19401 - DNA, 1018 bp, Homo sapiens
  misc_feature (1)...(1018): n = A,T,C or G
tgcttttcgaccgtcctcttccaccaaccttacataatgcacctctcatctactccctatctattaacttcaatttttatactcctctccaatcattctttcatcgacccaatatacaacaattctcctccgtttcctcatatcggggtcagtgcggtcacaacccctattccattactctttcctttttcttctccctctcctcccccttattccgtcccacccctttccccatctcccttttctccctattcctttcccacccaccttttaccacactttcattctaattatctctcatcatcaccccctccttttgggtttcgacatagctccatcccccatcactacatcaaataatttctatcccatactctattttatttcattcccatactaatatatacaccactactacatcgtcccacataaattccattcttatatattcatcatctatccaaatttctcttactttcatctcaaatatcaaacaatcaatgatttaaaatgtaaatgattatatatatctatcaccagtgaaaatatattattattgagtaaacttaactaaacgacgacaagactagcttctaacagcatccgaacacacatcaccaatatacatattattataattnaaatttaataggcgttctcaaatacaattacnattggatgagtgcaacacaatatatacaataagcttaataaccaattggcggataacgttataaactaatatacccccgagatttcataataaagtagaaacagttaattatatgtgcacttcctatatgacagcactacactaaacgtatcatatacacccacgtctctatctctatcatatccttctttcttctctcatcctcctagctcttccatcctatcttctactcattatctctatcgcaaccccctattatatttccaatgacatattatcatactatatgttatttattgtttacctcaacaatttatctttcgttaatcccactatacctttttt

SEQ ID NO: 19402 - DNA, 407 bp, Homo sapiens
atgcaggaacatgacctttctgtccagcaaggcctcatcacaggtcaacgtggaggggcagtctcggctcaacgagaagatcctggaagatccagaaactccaggaccagatctttaatctcatgaagtacgacagctacagccgcttcttaaagtctgacttgtttttaaaaagaggaagaagatttgcctgatgctcaaactgcagctaaaagagcttccagaatttataacacatgagcccccaaaaagccgggactaggaatttcctctcaggaccgggccgggtttatcattgctttgttatttgtaaggactgaaatgtacaaaacccttcaatgggatgtgtgtttaaatttttgcatgatgggccagctaacataaaaaaagattattattaagatggg

SEQ ID NO: 19403 - DNA, 1547 bp, Homo sapiens
  misc_feature (1)...(1547): n = A,T,C or G
catcatatcgtctcatccgtttccatcccccgtccacaacaccaacaaaattttcacctcgacaactaaggatatatttttaccgcttaaaacactaccctgaataaatattagccatacaaacaaacaatcttcgcccacttctccaaatattgggggggtcgaggccaacccacttcaaacccattcccccttatcctttctccttctcaccataatccacccaccgcgacatttcctttccacctctcctattccattcgcatccatctctcttatatgaccgacgattttttgaacagttaccaccataccgtaacgcattttatcatcgcgccnatccgcattccttcatccgattccatattagtcactcntatcgttagcctacctcccagccactaaccaatagtgagaggagtgaggaccgcaaatatcatacccatctttcccatcatatactctactcatttcacatattactagtatatatatatatatcccacattaccacataatagtcctgtatatagtctacacgcaccactacactatgctcttaatactgacgatcntaccaccacacacagatacatattctccgcactcagccacattaacactctntgctctcctcgctcactatacatgagctagtatacatacatgcacctcactgaagtagtttcgcagttgtatcagtctatctacacttatacagtctcacatggcgtacgatcaatacattacaccacgcgcaacacccctctcctatatanacataagagagacaactatcagagagagtgagatactaaaaatatatcatgatgtatagtatgctgtgtctaccgtatgcnagcgtagagcgtgctgcngtagtgntagctagcatcgcagagcaatgtatttactagattgtgtatntatcacgacatatcacatcacagacaatctctcatatctgtatntctacagtntcactacaactatacagcaattgacanacagcatattattacacattactaatataanacagatggaaacantgctacgcaaagacaatctatagttactaataagactatactcctnattgcnacngattatactcaatattatatcatgtatagattctccagtgtatatcgcctcagatacacagatgtagatattagcanatgtagagaactaccancacaactataacatatcattcactagaatctacacatatcaactcgacctcctcgcgagtcactcatagtgtcgatgttatacntgatnttacactcatccttgagtataatncntgtatgcactgtactntcgagctctgtgacatatactcgntcgcgatgatactactcacttcacacacactgctcgcgacagtatcaccgttgtcatgcaatactatgcatatcagacgcacacactatcagcttctgactatattgtgtactcaacacacactacaactcgantntagangatacgatatgtnatcagntacatctcatgagtnanagtagatattatgt

SEQ ID NO: 19404 - DNA, 1674 bp, Homo sapiens
  misc_feature (1)...(1674): n = A,T,C or G
ccagtctagtatatccgatgctccggtacacgctgaantacagcaatggcagccatcngtgaacatgacaaatatgtccagtagtagccaacacgtatttagcgcgccgcgcgacgactacgatacagtananctcgcgaaccattttgagcgaaacaccggancgagacaagacagccgtcagagtcatagagaggtaccgacatcgntcaccnacctagaattacactccgccgccgcatatcncagaagatactgtcaggcgcgcgatggagtgtgacgcagtctccacaagccgtcggacaaatgtaacacaatgtgcacccacaatttccgcatgtcattcccnaatcagctccccgacaatcgccgtcagcccgtcgattantattccctcatcaccgccatccccncgtatacctcgctcaatcgtcctgcgcatatattcatccctcgtattatttcatacaatataccacggatctgtacgcatatgatcttccccgcgtcgcatccagtatcattccactaattcgcaatatcaacacgacacacagcgcgtccantaaacgcgggggggtgggcagtatacctgcgcataatagctactataccacgcagaacgttatatcacatgatacatatatagctagataccaacgagtgagttgagcggagcgtagcataaacagaactcatataagtacagtagcaagtcaatataggaagatcgtgttacacctgaacacgaatagtagtgcgaagaatgtcagatcacagatgaagngatgtgacatatcacagttaaggtatggcaataagagacactgatatatatacgagacttacatagtacggacagaggcaatacaatagggagcacactggagtgatgcgatggagatagatagagatgagacaangcatgcagatcaagagatggagcgagtgaaaggacacggcaagtgtagaacaactacgagcgattcaagagacgaccgaagaagagaacaataatgacactgagagaccgactaatagattagaactacttacatattgacgatctccatgatacgtgatatgacagacaacatctacaccatagatataataagatacgaaacagccctctactacagatgacacgtgaagaacgagtgagatgtgatgtgtatagtgaatatactatatagtggtaagaacgcttgtgcgttaagatcgagtatgagagtggactcgagataagacagcagctgcatatgatagacacagcagncgtgacgancaaacacgagaagcattgatcagatgcagatgatgactactgtacaattaccgtacgnnatgagacgagtgagagacatcgccagatcgcatccgcgcctggcagacaaggatgagtgtagcgcgatactgcgaagagtaggtgtacgcgaggacatgacacgacgatgatcacgcagtacgctatatcatagtcgagatctgagcgaagtantatcgcgacatgcatcacgattaatcacacgntntncgcgacgcatgcgcgacantatgagctcatcgaccagctcattcacagaattatattagtacgacgatgtacagagncacacatatgacgcagacggatactacatcgggtctagcatgtagcagcactgtatatct

SEQ ID NO: 19405 - DNA, 1334 bp, Homo sapiens
  misc_feature (1)...(1334): n = A,T,C or G
cagtcgataggccagtgcnatcaactcagatcgtgtacgggagcatgagagacagttaatgcttgtaccaactgtctgttntaactgtacgatatgattcgattacgcgctaacagtctggcaattaccggtacgcgcgatagcgcgaaggagacgaacggagccgcaatcagtaccgatcgagtagtgctcgccggtctatccgtgtaatacagccgggtcaatagcccatattccaaacgtcgccnttcaccctgtcccgccttttcccgttcntacaatgtgaccgtcaatcccgcccaccgcgtagtttcccggtcgcgttcgcgcgatgccacacatcgacacagtatatcttccacgttattgcagcgttgacacgggagagacacgtttgtcaagacaggcgatgcgttcggtccattatgcgcaagagacccagtaaatgagggcgtccaaatattgcattcgttcggctcgtntgctacccgtggcgcggggaaacgtcagcatgatactgcaaaagtggatggagccaaagcacagagtgatgacaaggggcgagatcatagaatgagacaagaatgctgtggaggagtgaagaagtgtgcgtagggcgttcaaggatgatgaggcgcggtggcgtgagtcgaccgtacaggtattgaagaggcgagcatgataagcgtacagtagagagaacggaagacgagagagatatcnatacgnatgagagaaggtagctgttaggcgcaacctagacacattggtaggaggatatgtgcgaggacgagatcacaggcacgatggtagatgcggaacttagttcgtgatgatgagagagaganaggtaaaggtgagaagaggaaaaggatggatagaagagagagatagagagagtcttgatttgagtgaaaagcgctagagtgagtgagagaatgacgatgatagtagagggtggaaagagactgaccacgagaatgagttataatacagaaagcaagtgatgcgacgcttggccgctggttgcgcgtcgatctagatggaggcagtagacgagcaacttaagatagagagaactaaggttagactgtgccggagagtgaatgaagagtcgatcgagatacaggcgcgcgagggagcggcgattgtttagttgatctacagatattagttgcggtagaactcagagcagtagagagggtcagtgaagaaatgactgatggccgagattcgtatagaagggacagataaaatatgaaagcatacaatacaaatagataagagcggcatataggcangctgattagagcgaggcgtagtacacggtattc

SEQ ID NO: 19406 - DNA, 1038 bp, Homo sapiens; identical to SEQ ID NO: 8361
  misc_feature (1)...(1038): n = A,T,C or G

SEQ ID NO: 19407 - DNA, 1393 bp, Homo sapiens
  misc_feature (1)...(1393): n = A,T,C or G
atattatactttatctgtgtgactactatctgtgtcattatgtctatggtctattatcaattgattctggctgcgtttctctgttttgcgtattcgtttatttctgagttacgattactaacatcaatgtcattataccttacagaattacgcgccatacattagttgtattgtgtcattacatttcaccacctgtggcagagtagtaatactcctctcgctaataccttcgtttcacacgtgctacaaatcattctactgttactcttcgtcttagtctactgctgactatacaggtatgtaatanaacactaataaacctntaatntcgcaacattcagtagcaacatcctnttccaccctctctctttctacctcatatcctcaactagctttatatcgtcacactctcgtatctactcctccttcattcaggcggtggtctgactacaacatgaccaacgattcttcatctcactatacacatacttctacctctccctccgtaacatttcgccgtcgctgacatatgccctccatgcatttagcatgtgctccattcatatctatcggtctctgcnttcttacttatatctccactccttcntactcctttttatctaatcatatccacacttctctctttttcgcatctttacttacactaactactttatatatcgcatcaagtaatgtagtcttatatgaatataantacacacactactatcgcctcactacttctgtgcgctcgccaccactatactatcctagccgtcctttcttcgatatcgtacttgtggcacctactccaactacgacaactattgtctacgccttcaattcatacttgctattcgtattggtagttttcgacgagttaatcggtccgtatacggccgcatctctccgccataacggcacggtatgcgaggacggatcggaacgtcgataantaagacgctaaacgcatatgtcgtgaggcgctatacatggatcgtatttggtcgaataacgttgtatatatcggggacttataataatcgccgacgcacgtgcgagtgaacgagcgagaaggcggtacgcgtgaatatcaaccggcgggggctgtgggattgatagtctaatgaantgaatgaaacgagatcataatgcgtgtatatgtggtgtaatggatcgcgtttgtgaatatctgtaacttgaacgcgcatgatattcattgcggatnaacgcggggcgatatttcgtctggttatatgtgcgcgtgcgtcttttcgtctggatctaggtggtcgtgtagtggagctgtatgcggtaacgttattatcacgtccatatcttttttatgtctttttattatgctcggttcgatattgtttagtctgtaatgttg

SEQ ID NO: 19408 - DNA, 899 bp, Homo sapiens
ccctccccccgcgcactcccccgctacgccccccgacccgctagctacgccggtgtgacccgccgcctatcgctctgttcctcctcgttcccgccactgtcggtcctgccccctgtcttctcccccccccctaacgccctccgggcccctcgcgccagctccaactcctccccggctcactcctcgctggcgccaggtccgccatttcccccccggctacagcatgcactgaatttccacccctccctccccgacccccttttcctttcccccttatcccataatgtcccttcggccgattttatttattcgctcctggaaaaaatcccccaataccctcagatgtcccaatattttctcgcggctcgcgcctccaatttctcttgtgtatatacccaccgggggccagccgaccgactatacggtaactctaatcccccattctctgacaaagcccccatctatattcttcccagtggatgcttctcccagccagaactgcccaaagggttccactttcccccataccacccaatatttggtaccttctgttttttcaaaacatcatggccctctcgcacgatgtaaggtggtactccccccccccccctgattaaaagatttcctgctacattgcagaaaatgggaggtcagaaaattgcaatttatttaagattatataactgttacatgacagagctgagacgtgaatccaaatctgactcagtctagtagttttcatttatatggttctccccccccccccatataaatatgattatgtcactttcccatttaaaccctcccttgtgattctccttgcacaaatacaagggtgttcccgatccgaggcttttttccttctccttcctccctcttccgcgcgtcccacctgtgcg

SEQ ID NO: 19409 - DNA, 1111 bp, Homo sapiens
  misc_feature (1)...(1111): n = A,T,C or G
aatgctgactgcgtgtgaaatatgataaaggtgatactggtaatgcggcgtggacacgtaaatgtaccaggtaatttaagagtgtgacgtatgggcataccggggtctagaaggatgatgttgtcgatggtaaatggggggaataggagcaaataggagaatgtggggataggggaaatgggcacggtgggtggcgtgatcaacacaaacacgagaatgggggaaggttttggtgggaattgagagggtaaacggaaacgggccacggcggggaattactactggatataggaactatgtgatggccgataacgaattgatttctatggatatagcaggaatactatacagaaagtggggatagaagtcaggttgggtgcttacgatgtgtggtaaaagaggagagaggatggtgggaagatgagagtgggggaaatggtatcgagaaatagtgatagatattcgcgtcggcagataacggagtggggtagagataatagtgtttgttggtatgcatagtaggggcctacggggtgagcttttaggttatacgactctggaggcacgaaaatatatgatagtatccagggtaagatgcggatatggcgttgatacctgtgtttgattagatttgtatatcaactgttgagcggggtctgatagggacgtccacaacccacgggtttacttagaaattgagtagtttgatgggtatagtcatcgatagacggtgagatagctgggggccgggggagaaatctctagtgttaatgtatattatagggaggagctgagcgggtgagaggatcactattcacgaatatatataatggtgagagtgttatggatgtgccggccatcttgcacgtactgcatactgtgactgtggatatataattatggtgtgacggtgangaaacaacacagaccgccgggttacgtaaaacggggcgatgtcggcgctgatatactatatgcaggctctacctcggcacagntgaatatacaataatataaaaaacatataacggacgagtagaccactaatggagagttctgggcctctgttggtatagcagatacttacgacataagatacgaataaataaat

SEQ ID NO: 19410 - DNA, 842 bp, Homo sapiens
  misc_feature (1)...(842): n = A,T,C or G
ctcaactagccaatttgagtttgggggaataacacgtgccagggtaggaattaacagaagccttccagcaagttcaagtgtaaagccaagaggaaagggggaattattttagggaagggtaggaggaaagaagaaaagttgagtttcttgaggaggcacattttaggaaaaaggaaacaggctttgtgtaaaggagggaggaccaattttaagtttagggtggggaattagaaaagcggtggagatgggggcagtggataagggtgtaaaaggtggcagggggtccacttatgtagggggatgtatgttatgccgaaaagaccagactttgattgcaacaatatttttaatttaaattcttatggttataatccaacaaggtagagatattttaaaatgaaaaggttacaatgattgtcaattttaagtttcagttgtcttgaatattaaacctgaaatcattagntacctgtttttttggantaaaagctgcatgaaggcaggaattatttcctcaccaaagcacctactngaattcatccaatagaggacccactagagacagttgatgttctcantggattcnaacatttnttatccagtaattaatttcccacagtgctngantagatantgcatcaccaacactaaatagatgttttatctgatctctacaagcttgtaatttaagacataacagttgttatttttaattttgagaattaaaatgtnattgntntgtgttttagattgagaaaccccantaataataaaaatttttaggccataaaagntaataantaaagacagtaagtataataaaataaattaagatgcggaag

SEQ ID NO: 19411 - DNA, 1893 bp, Homo sapiens
  misc_feature (1)...(1893): n = A,T,C or G
cgaatgctcgagatgatatgctngcgtcgacnnnagtctacgctgacgtngtatncacgncagctgngatcagacncaanctagantagtcacgatcatggatcaatcagatcntcatattacaccgcgcatactntacgcaccntgtacgcactaganaangtatacangtngaatgaccgtcagtcnactctaatcactgcacgattntacaaaggcgtgngcncgcttaatacgatgtcgaattgcgatgacanatgcaccgtatcgcatagacttcagnatagcgnagnatcgatactantnctagcgcgctgcgtctgatctcgcngtattatntatatccnatccggcaggtcgagttgctggcagtgagtcccatcnacgaccgtcaantatacaccncnatgatccacacatctatcatccacanattctatctctatatcatcgatcctacanatctgcacatgcacccacaccatatgtattgatccctnntncngnacgttacactgcntngatcacagacgcgacagtgacgatacanctcagtatatatagtagtacgccgnattntgtagcgangtacgatgtatccgacgagnctatctagntcgcaatatntatatatcgaatcgaccgacagtactcgccgtatatcganntacaagatagtatagcacgggntatacgtatcncgntgtcngtctcnangacacgantcgcgtgtgaatgtgtcagttgtgatgaggcgctgtacgantntntagcatatcgccattcatactaaatactatanatcnantnatacntngcgatantgagcgacgatgntatatgattgtagcaacgaggtgagagcagagtgatcgnatagtataagacngatgcgatagacataagcgacgcagtacggagctaantgatacgcatgantcgngaatagacagagntagctgagacgtctaccagatgagatgaagttaacacangtacgcagaagcgtcggaagcagatctatacgttntacgctcagcacgaaactagaggttataccgtcgacatgtagagacacgacacatcatagatacacacgacgtataagtgataggatgaagagtaacangtaggaganagaatacgagtgatatgtgagagagatgacgcnatacgcgtcgcgtgactacaacatagatgctaccatagtcacggttgaangacacanagatatacacantgagtaccgtacagancataacaagcagcacgagacagccgatagtgatagctaacgtctcgaactactgcatnanaggcagaacatagaacagacatagacacgagtagacgtcgatcaccacgatgaagctgaaggncgacgctgcacacatatcgagatgtcagtcgaacacagtgacgcatattgcatgactcatgagacagagcnanagagattgtctagatgcatgcattaaggagaaagagcgtggaaaaganngacagcgacgtcgcgactgcatcacatagtatgganagagcnncatgaatctcggtcaactatagagatagagagagaagcnataagaggaggtataagacgagacagtgagagagaagtccngcgatacagcgacaatatgacgagagagagcgcgcgctgatacggacatggagagngaagatactcatcgagacggttctcagatgtgngtttgtatgaggagtgctatgtcacaatagataagtataggagaacaacatcatcacaatggtcnataatgcngactgtacctaattatatcacatctgtaacataggagatatattagaggccgagacgcgcataggagcgacgtagattgagcgctcagtgtgatcaaacgtataata

SEQ ID NO: 19412 - DNA, 1074 bp, Homo sapiens
  misc_feature (1)...(1074): n = A,T,C or G
ctcgcgaaccaccgagtcggtagaagaatcgtggcagggccgctggtgggaggagatggacgaagatggcagaggagagaaacggtataagggcgcaactagcgacgattgccgcgcgcgaccgagaataacgcgacgatggcggtatcgacgcgcgtacgccatatcccaatgtccatcatccatatgcctcatgctccacccgtgtgtcacgacgccatcacggatcccgccgcgcgccaattgttcccaattctcacgattcgcgggcagttcagtttgcgcgggggttcgcgtgcgacggatgcgggtcggcgataacagtgcaccggaagaggagagggcggagtaggggcgtgcgaagaaggggaggacgtcggcgtgggtagttgccggaaacagtgagaggggggggtacgcaggggaggagagaacgggagtatagggtcgaggcgccactgtaagagtgtggatgagaaggggggaaggtgggcgtgaggggaggtggaggaaggagatgatggaatgggagagggagagagagagaagcaatggaagagagaggcgggagagaggcaaaaagagaggagggagagtgggagagaataaggaataaaatagaagagtatctaggatgaagagggggagtagaggaaggctgaagatgtgttataggacggcgggcggagcggagggggagtcgaaccagggacggagagcagtaagtgcggaggatggcaggaaaccttagaaatggaagaaatatgaaagtatagagaactgtgtatgaacctaagagaaggaaggagtgagagagtgaatacgcggcagaaatgaaggtgtgagtaggagacggagaggaggagagcaagcgcgataaactggtggaacttacctgatgtaggcgaatggtggcgnatagggcattccaagggtaaggagagagaacgtngaggaggatggacggcgtacatgaggggaatgagagatgcggagtgcgaacactagagagcaagcgtatgtcgcgcgccgccggtatgcgtcaggatgcgcgccgagaggtgcacaggaacg

SEQ ID NO: 19413 - DNA, 1052 bp, Homo sapiens
cactttacactctccctacccaccaccaatcaaattcataattatatttacttataaaaatacacacaatgataccatctcaaagtattatcccagctaacgtccattaatcccccccatccatttataggggctcgatgccaatccaaccaccatccacttcccctttccttcatcctctcccctaatccctcccccgctatatttcctatcctctcctctcttcccccactcaccctctttttctcccattttcacctttcccaccttaactatttacccaccccatccttcttcattttcactcatcctccccccctccatagggaaaaccgtcttatgacaatattctcaactttctaatacactaatcttactttccttcaaaaatgcttgagtcctatccaaaatcatcgttaaatttttcaacattattacagaacctacaagaattaacacatctgattataataatctactcactctaatatctatatatattaaaataaccaccacaaaattccctcaattaaaaacattagtattaaatgttcaacaatttatagcgaaaaccatttatcatttactttatatctaatatatatttaattaataatacataattattttattgtcacaaagaaataaatatcgtatttcaaatcccaaaatatatttgttaatgttatgtacttctatctaccattatcgttttacaaacacaatacataattattaaatatctaaatctcttatattccaatatttaaaataatctaattacttctatctatataattacacatcatatattatatattaatttctccatcatcaccaatccctatcacaaacacacacacacacatctaataattccatttaaccccatttacgttatagatgactaatcatctattagtttctataattctaatccctaacctcaatatgacgaatccattatacaataacgcagcaccaaattatctttcatattctacgacacacccttatgaatagatttactgctatctttaattcgttatttt

SEQ ID NO: 19414 - DNA, 729 bp, Homo sapiens
tcgtctgggacactctcttaattctccaccgctacaactgccagagtatagtcacctgtatctgaggaagaaggctcagcctgtgggtttccttactgttgatttacatgtttggccagatttccatggcaccatctgacactaaagggcatggtcaccggattgaaactgtctcaggaccttgatgatcttgccattctctacctggccacgagtggactcgcttcattatagaagccatggaggcagcagggcactcaatcagtactcttttcctatgtggaggcctcagcaagaatcccccggacattactggaagcaatggcaaaaatgagcaaagttgggaaaaggtgggttcgcgaaactacaggataaaaaatactatgataagaaatacgggaacacccagaagggaggattagggggatcattaattgatgacctgaaccggggctggaaggaggcctgatgcgcgaaagcttagtgagccctggcggttgagaccgaaagacgcctgggaggagttcaggggagtgctttaggctagtcggcgaggacccaagagaacaagtccgcgatgccgcgcggtagctcttgagcgagggagagcagagagagtcccccagagagggaggcgaacggaacggagcctgcggccagaggcacagaggagtccggggactacgagaagagggagctgcagggcgaggaaggtagagtctcaaagag

SEQ ID NO: 19415 - DNA, 1299 bp, Homo sapiens
  misc_feature (1)...(1299): n = A,T,C or G
aatatcagcaacacgctcacccgaaaaggacgcataactcgtgcatcccatcataaatcccacgcccgttgctaacactgtatcctacaacgtcatccgccattgcgccttagtcacacgcanctcctcatctgcccatcaatctcgcgctccctcattctcgactcnccaccactctccacgctactctctctttattctctccattcattcttttcttctcaattctcgctttcttcatatctcccctcccaccactagccgtcccataagcctctctactcctatcattctctttacttatcccactgcccctcttctcctccctccacctacactgcgccatctctcgtatctcttcactcccactcgctctcctcctctctcctccctcaactctcccaccccccctacttcctcgtatcatcacctccaccgatacacacttgcgttaacttcacncgcttctcaccactcacctcccctctagtcctctattctattctactcctcatattctccccttctccctaccaccctctcnacctctactgttccgcacaccctccactncgtcgtctatccatagacctccttaacctctctcgcctctgatacacacaatcctcctctccgctctaatggctattacttctttccgtctgccgcacaccaccatatctcttctctctgcaattgccctcacatccattatctatcatcctccacaccgcaactggcgctcatgatctaatactttcgcatctgcgatcctcctgcttactgcggaccttgtggtgtctaacgcgctgcatctctctcaaacattggacgacaccgcggccggaccaacgcgataaactgcacgtcaatggatacgccgcgcgctcataatagtgactattccgctgtacatcgatgattatancgcgatacaataactcgacgtcgacgagcgacaatacaggaatgcngngtcgggaaataacgctgctggtcgtgatcgacggcattcattgaacatacgcgcaacaggcgacaaccgcggancgtgcgcangattggatatgggacatcgtgccgctcctatattatggatacacggcccccgtatatgatccgactgctaggcgcccctcgtctccatccgcagttgcgcgttccttcnacgcctataacatacgcgcgaactctattcacgcgtcacccgcttcacctagctnnctctctaccggcctcatcgttattcatacgtcgtggattgctgaacatcccagtcggcagacgcagaactgactg

SEQ ID NO: 19416 - DNA, 1594 bp, Homo sapiens
  misc_feature (1)...(1594): n = A,T,C or G
gcgcggtgtgatcgagngtgtactaccagcgtacggagagagcgagggaganagagaaggaggggcgctcnatgcgtgcaaaacagnacangnggcgagagagncttaancacggcggcgaaaccganggaggccatgtccaaacaacgcgcggggatgcgtatcacagaactaatagtgtttatgtgcgaatgagagtgtggagcggagggtcttcattggngtcatgccgctgtcggtaaggtgtgtgcatggtagcggagacgagtgtgtgcatatgtgtgtgctataatatgtaaatcactcatcgcgtgcggacgtgacgtgcgggtgtcagatgcgtggccgnggtangatggcgtcgtcncgcggagatgacacgtggaggcgtgacgattnggggtagcgtagaggatcgagaggagtgctgtgtgctgtcaactgtgagagtgtgtgtgaggangaggctgatgctacgtcgactatttcgtgtacgacgtgttgaggcgcagggtaggggcaccaacgcgtctcgcggtggccagagggagaaccgggcggacctgcgcaatctaagacgcgtgagcggagcgaatgaactgcatagaaactgttgcagactgtgaccttatctcgttgtctactgattgaggactgagcaacggaaatacgtagacgtgcacgaaatttaccgagcgtgtggcatgacaggtattacgcgtttactacttcatcaatgggcgcgtgtcgnttcgcgcgtgatgtgtgtcgatagacgcagtgactgccatcaggagctcgcgagaagactgtagcacacacagtgacactgtgtcatgagacgagacaggtaatantactcgacgatcagtagatacgtgtgctagaagagcgtacngtaagnatgtgtgcgcgagcggcgcgccgtgcgcgcgggcaggcgcgcgtacatgacgcgtcgtgattctccgcgantgacgcgcgatgatgcagatatgtgttaagtaacgtgcgaatagtctctgactgttgtatatgtggtgccgtataatacactcagtgtcgctgtgtcggtagctgcggattagttgtgtattgtcgtgagtgtacagcgggctcggcgcgcgcgctcgggaccacatcgcgtaggactagtgagcagagcatgacgcagaacggagaacggcgagtatcgcgngagatatatgctgttgggagctgtanagaacgcgtgcnacgagtgcacgcacgtcgagtgcgcgcacgtgcggggatcgtgcgtcactactcgtgtgtgatgtttntgggtgcgcctatcancagctccaacgtggtgtggaggngcngtattgttgtgtggcggcggtgtgcgcgatagatctgtagatattgtgaatgagcgcgtgggtgaggtagtgatggtgtgggaacatcttcgatggatatgactcatggtagatctgcggctcgtgctcactgtgcgcacgtgaccacattcactgngctggcacatgggcgcgagtcgcgcacggggtacgagctgtgttatcagtcgcgcgaactgaatgggatcgctagctcagtgctgtggtgt

SEQ ID NO: 19417 - DNA, 1357 bp, Homo sapiens
  misc_feature (1)...(1357): n = A,T,C or G
ccgcgcgctctcgtngtgcgttcgtatgcgctgtcgcgctgatattatnctattatgctcgcgctgcaggctatcgtctcggcgatcgtatcgcgtgcgcgntgtttgtgcgtctgcgcgtctctctgtgtgactaccctctncttccgtgcgtcgtctcgacgttcgtctgtgtgtctctctctctcgtgtctgtnctctcgtgctctgtgtcccgctgtgtctngtgggtggtcgtgcgcgtttctgtggctgcgtctgtctctgcttatgntgttgttgctcatctactgtgtctctcctcgcgctcctctcggctgcgcggtgctgctttgtcactctcgcgtcgcgtctgtccttccactcgctgcgtctcgcgtcgtgtcggctcgtgtgngccggtctcctcctctcgtgcggcgcgctctagcnacagcgccgtcctcgccgtcgcgtggtgctgcgtctcgcctcgtctgtcgtccttcgggcgttcagccggcctcgcgtctcgcgtctgtccttcgccggtactacgcacgcgcgtgcgcgctcccgcctcggttcgatgcggagcgcgtgcgtgcgctgtcgcgtcgcgtgcgctcgctcgcgcggccgttanatatagggcctcgcgcgggctcgtgtcgcgattcatacgttctgctgtccctggctctctctgcgagtgctcccacctgctgtccctactgcctgcttgccgacgtacttgtcgacgcgcggcggtcctcggctcctcccgtgtttcgcgcgcgctcgcggtgggcgcggctcggctacttgttctggtactgctgctccactccgcgctgctgtgtgcgtcgcgcgctgggccttgcccaccgcgtggcccgcctctcgggngccgctcttgcacaccgccccgctngcccgctgccacgcgctgtttgcgcttgcggccgcgtggccctcccctgccgcggccgttcgcgcgcccggcgcctggcctcggctgcggtggttggcgtgcgcgggcctcgttgctaaaaaaaaatttgctgctgctcccgccgcgtgccgccgcccgccgccccgccgtctcgccgcgggcgggtgcgtctgtctgtcgcgggtcgttctgcgttgtggcgctcgggccggtggtgtctgccgcgtctgntcggcctcgctcggcctcccttgtcttgtgttccggcccttttgcgtgctccgtcgtgccccctaaaaactcgccgccggctggcccctcgcncnccctcgccctntgattgcggcctcctgaggcctcgttgcgccnattnatctaaccagggttcctttttttttttggtggttgtgcgtcgagccgttt

SEQ ID NO: 19418 - DNA, 1258 bp, Homo sapiens
  misc_feature (1)...(1258): n = A,T,C or G
ctctnctcaggggcgttgcctatgtcgctgctgctcgtttgttcatgtcgcttcgcctcgtccgcgctcccgctcatntaccctgcgttcttgtnctcgtggnctcgctccgtctgttttgtntgtactctgtctcgcngcttcccgnacgccgtcgtgtgatgtgtcgcgctgcttccctngctcgcgcgntcatgcttcttgcgtcctggggctccgtgcgtcgntgcgtcgtgctctcgtgcgctcggctctgtgcgcgctgtcgnctcggcgtgctcttgcgtcgcgcgcgtctgcgcctcgcgcgtcntcgntctgccgcgtgcttctcnttctccgtgctccgtgntgctcttgattccttccttcctgtgtcgctgtcggtcgtctctcgnggcggcgcgtgnntgcgcgtcctgcattcctttggcgggtcgcgccctccttgcgtggtcgggcgttctgccgtgctgttctctgtgggtgttctctgatcttgtcgtgctctgtcgcgggcgtcgcgttgtgntctgtctcgcggcgtggtgccgttctgggcgtcctctgctttgcgcgtccgccttcccgcgtgctctgccgcctctcgtcgggttctttttctgccgtgtccgccttcgttgttcctgttctcgtgcctttgtttcttgtcgcgngtctgcttgttcttgcggttgttttctggggttgctcttctcggggggtgtggggtggcgcggttctgtgctttggtggggggtggtcttggcgcgttttttcggccgccgttcggggtcccgccgctccggcgccctcgtgtggcctccggctgtggcctgtgtgccctgctctcgcctgctgccgctggtgctctttgtgctgcttgtttgcgctcttcttttcggggtttcttngtgttgcgtctcttcgctttcgtgctggtgggtggggggggggccgccccgcgccccttgcgtcttctctctcttctccctccgctctcgccgccgcgtccgtctcgtgtcggtggctccgcgcgtgccgtctgcctctcggcttggtggttctgctcgctttcgcgccttcggcccggcgtcgccccccgccgcgcgggccggctcgttcccgcctcccgctcgcggccgcccgggcgcgtttggtccccgctgaggtggcttcgtttgtttctctccttgaggggtcttttctctccttctttcccgcccgttctcgtctgctgtctttgccttccggcccg

SEQ ID NO: 19419 - DNA, 1205 bp, Homo sapiens
  misc_feature (1)...(1205): n = A,T,C or G
ctttctattttctcttccatttccattttccgctctcgctcccattatttatatcttctcgcaatttctctcttcccccctctgcctttttattattttatctctatccactcctttncccatccccctctccctcttttctctctcctccttccatccatcttatcttcacccgcctccctttatttcccgggtcatttccttttcctcaaaccaatcccctttcccactttccattatcagtcttcctcttccctcccctctttttcctttcccttccccttttctcccctctctctcttttctcccatttttctcatttcctctccatctcttttcgtccccccccttcccttccttcctttttccctccttcccttccccttccctccaacattcgagtattacccctcttatattctcattttcacttctttcttctcatcaataacacttattttttttccgcattccataattctccttccagctccctgtcgccgcttccctccatattctcttcctcgtctnctatttcagtttctcctcctcccttctttcttcttcctccttattcctaatttcttctactatacccattatctattcaatctctctaacttatcttttatatattatcttcttttttcgtctcttttgttcacatccactcntctttgattgtgttcactcttcattctcctctacccatattatctcaatacctcaatctcgtttttatacaatgcttattgtgatattttttatagttttatatatataagtatatgccctaacagcaatcccattctttgtatcctcccattttttagtcctttccttttttctatattattatcatatgtcaacttccaattcgattcattattataccattctccattttccccccctttattatttacttttcttctccattttaccctctgttcactctcactccactacctttctccttcacgtatgattctcttacactaatgttatattttacccatctcctctcactatttgttctcacttattttcttctttttctgcttcctgttatccttctttcccttcctttttctttttctcctacacctatatcatttcgttttttcaattcactcccctcttttctatatctatcacaccacgccttataacacatgtttctcccctcattatcctctatattt

SEQ ID NO: 19420 - DNA, 1256 bp, Homo sapiens
  misc_feature (1)...(1256): n = A,T,C or G
catcatatacaacacaatccactttcagcaccagcggatatgacatgaacaacaaccattatataatctcgatgatatatacgccgaacatacggggaccatccacaaaacgtatatacaacgacacaatcacacatctaataccccgccatccataataattatgcgatcagccgtaatcaacgctccgtccacgttcccccatttcccttcatccatcataccttcatccatccccatcgtgatatcccattcggctgtccgtgtgagcgccactcgcgctacatttacgtcacgattattcgcggtgactcgaacagtaactatattccccgcccgatcgcgtgcatccaaaattcgcgacagaacatacacatacccgtccatggaggcgggtggtgccacgctaagcatccaaatagacaaaattagaacaatcgtgaggaatgagagataaatcncaaaaccagtagacgtgagaggggtatgctaaaaaccaggtataaccagaaagacaagatatgaatctataactatccgcaataaaacatacaaaatacgttatcaaacaacgaaattgaaattcccgtggataatagtaacaataaagttgagcataaaaacgagctaagcaaaactcctgagcagcagaaaggcatatatgcagaggtcggaggagtatctgagtcagacgaaacgatagggagtaacatagaattgcaaggaaatgacgcgcgagaacgggtgcacaggaaaaggaaacaaaatatagaagatgatatatagaaataatagagtatatgagagatcttagatgaatatagttaanacagcagaaataatgattaatacagtcaggcgagagagggcgacaggagacggaggaacggaggaggacggatgcataataatatgagacgataacgcgtgaaagtagtgcaagtagcgaaagaaggaaagagagaaagtagagaaatatatattcgcataatataatagcaaacgagtcgcagatataacatactaagaccgcacgccggagcgggggnatcgagccagancgaatatactgagaggttagcagcatcgagctaatcatgagatacaataggttacatatcgcgcatctcacacaacaacaagtacagtaagtcgacataccaatatatacctacacaatcataacatatctttattctacgagcacgccagaagtaggtcacatgataccacgacggagcgtatgcatagataat

SEQ ID NO: 19421 - DNA, 1608 bp, Homo sapiens
  misc_feature (1)...(1608): n = A,T,C or G
catctcatatctcactctacattctctgcttttcaccacacaccgcntattaattntataaactaccacattacacaaataatacatcatcaggtcacatattatgatcaaataagctcaaaacaataacacacaaactcaattacataaacctatcattattacactcctcaattataccatcttatattccccgcctattccctttattggagggccatgattgcctatatcacaaacttactaaatcaccattatccccctattatcncattcatctcaatcactcccacaatcaccacacaacccgtattatccactattcgtcatcaccattatcctacgcccatcgacctcacgtagttatatcatccaatttatacgtcgattcacatacgcactatatacctatattcacaccacacacaacatccctttccactccatatattgcacagtcatacacatcacaaccacacncatcaccatagtgtacacatatatacctaacatatataattcgcaaatatcccatacattatcgtgcacattcatataatcagagtattttatagtatcgcattatcctagtattaacaatatattatatatgaattcataactacacatatanataacacccaacatagacaacaaacatatacatttacgtacctgactccataaaattataatcacctcactnatatatcatcaaatatacatataaccatgcaccctgaaacatatccagatcaataataaatgatatacacactcagaacagatgananagacatgtcacgaatgatataatcatgtataataagtatatataagtaatatactacaactctataatacctananctctaaatcgtatcgtaatatatgtatatcactacgtagatcacactgatttacagataaacatgtatcttatcctatctcatcnatagcaatcagagtattnatgaacataacgagtcaangtgtatgctaagatagtanacgatatatnactatatactnacgacgtagatagtagagtatatggcgcactcagagtagagagagaacagnatnagacatgttgagtagcacgataacgtatatgtagaatgacatatactagtganagacanacacatatatcngacgaatgtagtanagtnacacatgaataatacatatantcatgatacataacagtctccancgtatctcactcncgtcatatntataattgattatatacaacttagactactataagtataatcattcaccgctatactaacaagacatatcatcacacacattcacacatagatactaccagtctctctcacatgtntcttacataacattatattcttctatctatactatacactaccacagccatatttatncgactgcaaatatagattgaaaacataccatctatagttatatatanantgactcacgctataagtcagtatacctctcatacactatantatacacactacactaataatatgtgctctattatactattaccaaacaccaacgtgtaatacatattattatacactcacaatatctaatatcatcttgtac

SEQ ID NO: 19422 - DNA, 731 bp, Homo sapiens
  misc_feature (1)...(731): n = A,T,C or G
tcgatatagaaaaaggggaagaanccttgctggagacgatctcttaattctcncaccgctacagctggacgagtgtcagccaaatttttaatgagtgctgtggtgcaaacagtgaaaatgtcttacattgcctcaaccaagatcatccgaatccagagtacccagttgtgatgtggagaatgaaggctcctgcaaaaaaacccttgattaaaagagagaagccagaggaatcgtgtggaggtgaagaaaaaaatccatccattgcaagtcatgagtgaatttaaaggaagacaaatctactgaaacccctattctacatatagggcctataccacactgctctattttacacttaagaaggtcgtgaattccactaaggtttggggggttaactcacaaataacataaaattttgggcgctaagtctgggatgcattaactgagattttctggtggggagcgcctaatagggaaggatatttgctttgcggaaggaaggaattgtggaggtgggactgacgggactttgggtggccagttagaagcggatgcgggcgcttgcctttagtgggggggaaggagatatgcctgagtcactggccggaaggacctagggggaagggcgtaggagaagatgaacggggacgagccaagagcggggatgtacgacgaaaaacatggtggcggatgctttgatagggggatcgcgggagaggcggcatcggtgcgat

SEQ ID NO: 19423 - DNA, 1456 bp, Homo sapiens
  misc_feature (1)...(1456): n = A,T,C or G
ccgcccacaggcgtnagttttgggtctttttgggnnggggngaaaataggatgtggtgncaaggccgcccttccctgcgggagtccgcacggtgtccagtataacctactcatggaacatagcaggcactatacacagtgtgaaattgcgtaagcgcagagcaggggcttagtagacacaacagggctgaagaacttgagagcatgaaaagaatctttggtataatataacgcagacggataacaggaggggagcagagtgatagcgtattacatggatcgtatacctgagtgtggcatggttcaagatgaacaccggttcaacgcatcactttataaagccaggagtacggcgccgcgataacatgcgttgtaaccgtaaaagacggatacgcagttcgacatgtcgaggaagggggtaaggaggaaggagaggctaaataataggaagatgtgaggagagagagggcgtgagaagttgatataggaggagatcgaggatacgtaagaggcagtagacgtggtgagcgacgaggagacagtggagtagtaatatatgtctggncgagggctgcgtactagcaagacctatcatatagaatacagagcgtgaggattagactgcagagagacacagattagaaaancatcaacatgaatcgagcgtatcaatgaagagacggagagtagttncaagcgaggtaggccgaacaagctagtggaggagctgctgagagtatgacgtcagattgtagtgtcagtaacggagcaccatgataagatgtgagaacgaacggnggggatacgacggagacgagagagaagccaggagtagacgagataggcagttatgntgcagagcaccagagaatgagaacgtacactagtatatattaagacgtgatgagagctgagccaacgacacgtgagaagttatctgtgcgtcagtcgattactgtgaacagcgatctagtcgcaatatatctccacacgcagttatgattgacgcacgaaagacatgaagagcgagtcanatcgagacgaggattagatatagtttggcgaacgcacgtgcagacacgcgagangacacgagtactagtgtacgatggtagttagatgtattgggtgggagnggaggaacgtgtggggcgaaagacataatataacgatgaattatcactntcgttgacagtattgacacgtacatttgacatctcagcgatagatgtggtctgtagcataatatatagtatcatagtgctgtgtagcgagagcgacccataanagagagagcaatgaanatacnagtatgtantagtatgcgtcggctggtgacgaatgtcgtgagactagttgagagtcgtcgatangcgttatgcgnacaagctntcacagactcgcgtgtagaacgctacgacgcacgatatcgaagntgagtactcatcacgaaagat

SEQ ID NO: 19424 - DNA, 1422 bp, Homo sapiens
  misc_feature (1)...(1422): n = A,T,C or G
cagcaggatgacgtctacgtacggcaggcagcaccagcgagatagagnagagagcagagtgacgaaaggtataggacgtgtatgtatgacgatacggcaaaatacgggtaacgcgacagcagatccagaagaagtaggtgacaagcagtacatcatatgagcgccgcgaactgagaattgtatgcgcacgatgccggtatcagcagtgtcaaacaccgatatgcaccatgactcaatcgtccagaatcacggcgatcccaccaccgcgtaggattatcgcgagcccgatgcccaaggtgcggcacacggtcgccacgcgaagatatgtcaccaaatagtttcatcgatattgcgacgcgcacatgacacatatggcacgacgcgcagcacatcagattcgcgtaccattattacgcgcgatgcgactgactcgacacttcgcgacgccgacagctcagtgagcgtgcgcgagttntcgaacccagtggtgagacgttatcatgcacttactgttcagcaggtgttngtcggagccngaatcgagnagtgagtgaaggggagcaagtggcaaagagagtgacatgacgagcgtgatgagtataagtgaaggtgaaggcgatggaaaagagaatgtagacagacacgagaacagtcaatcgcgcgggagcagggaggcgagtatgaaaggtggaaggacgagacgcgagacgacagatacgaaagaggttgcgtaggggagagagaatgctacgggcaggaagaagatgagtggatgacgagtaagagagagagtgcataagaagtngngaagagagggaagaaaggtgatgtggagaggacgtacgacgtacagtaaatagaagagtngatatagtgtggagtaaatagatgggaacaggagagagtgtgagggtagaaatcataaggagtggaagagaagagaacaaatgagtgaggcggaatcagaagacgacacggagggtagaggcaaaagatgaganagaagntgagaggaaggtagtcgagaatgggagantantnactgagaataaagacgttgagtaactcaacacgaggtgcgcgagcatagtgagaagatgagagacntgacgagaaatgctgattaaacgtcacggcgtataagtacacgatgaaacacctgagatcggtcgagtnattgagccgcgtcgcactgacgcgacataagaatatagtcatgatagttcatcacagatgttgcgcgactgcagntacagccgagagacggtaaacnagacagttaaagaganatgccgcgtgatatcaggatgatatatgtaggatggagagagtagagacgacgagtggaatagatgaagttagagaccgagacggagcgtatagcgaacatctatcgcacaagacggcanatcacacacagct

SEQ ID NO: 19425 - DNA, 1256 bp, Homo sapiens
  misc_feature (1)...(1256): n = A,T,C or G
cattcagctctccagcaacagtgatacgtccagcgacgcgacgctctagaaaagagaggacagggaggtaaagttgacggagagtagaacgaatgagtgataacgcgaaataacgcggncacgcatgacgaaaccatagaacgaagacgcaaatcgaaaaatcagagagggcacggacaaccatgatatatggggcacgagggccggattccaacgctccgacaccattcccccatgtcgcatctaccatatcccgacaacacgaccgcccaatttgtcccggttcccgtgaccaagatacatcgccgacgccgccatttataatcacgntttatcgtcgatttcacatcccaatacatgtgatgcgtcccacgaatcgtacctacaatattgccgtcggccgacagccaagcgacagagaggggggagaggaaccatattcaacacagagacgtgatgctgtccnacgatatacagaatgtatgatacagatcagaggtgcggagggggggaggtgcagagagagagcgaaagaggatgagaatacaagaacgggggaggcgtggcataaagaatgtgaataagggttgtagaagggtgtagcaagaatagtaaactagaataaagcagaaaagaagagaaaacgacaaagcggaagaagaggtgatagagagataataatgataaaaagtagtgtaaacaaagagagaatacaataaaagaggtaatgaggataaggggattaagaaagacagacgaagtcaatatagtagaatgtggtgtagaggagatgtaagacggatatagtaagttagagagtagtagaaaagagagagagaagagaagaaatatgagtagataaggagaaaagaagagaatagaggaaagagggtgagtgaagaataaaggaaaatgggaaggcaggagaagcaactaatattaaatgaggactatgaaatgacagcaagatatagagtaaggtcgacatataattggagtactaggaggaaaggaagtganagcaggaatgcgtatagatagacgcgagcggcaaacgtgaatattgtgtataactctgtatgataagagtgtgatggtgattataaggagatgagtatatgagatagtatgagatcaattgacacaactgaaagtataatattgaacatagacaatattaaaaacgatatataaatgtataagcggggcgcctgagtgagagcgcgccgtatgaacagacgtcgatcgcagagtct

SEQ ID NO: 19426 - DNA, 1864 bp, Homo sapiens
  misc_feature (1)...(1864): n = A,T,C or G
cgcagctcaaggatatagcagtacatagcagancacacacggaganctcgatcgcaccgcgatcagccagtatatatatnatagacagaagatcgacacgtgactgnatatatctgcaacacnctgaccctcgtagtgactagtaatngatatngntatacagcacgatagtatagtactcgcgagatgtntaagagcatattccntcgatcatagcactatatcgagancacagtcgcganacgcgccagtagcgnatcagcagaancagataatacgagncggccncgcgntcagagtcccagtctaatacaatatcgagcgcgcagtcgtattgtctcgtantattcacngnacaagtgtcaacaggacagaccaatgtacccaaccgagagtgtacctcatatcngntaccatgtatgtgcaaccgtcanatgagccatacacacgcctcanntgtaatgtacctcggantcgantcgttgaccgatgtgataccgaacgcgacnacactacgactcgcggtgtgtatatngtcgcccanggtgatcatgcggccgatttagtcaccgatccactgcacgaacatattattgctcagccagaaaccgctatcgcgtattacgttacgctgataattacacgatatcagatgcggaatcacacgcatcgccgagcgcgagatatgatcgtgaagatgagctcgcgtgctagtaatcactgacncgcatanaganaggtacananagactacagactagatacgtgngacagacagcagtgtatagtggncatctcnccgacgagacacagtcagggantgcaggaagggaagatcaatctatctgacggacgtcacagtagtgctgagaagaccgtcacagcagaagagacgagagtagtagtgatgaacgacgccggtcgngtaagatgangcgtgcatacgctcgttgatagagcacgacaaacgngacggataacgcgaatangtgngcgtagaanagagcganagtgagagganagcaacaagagagagagaccgaanatatagagagtaggatgccacatgaaacgcagtaggaaatgatagtatataatagaganaagtatgagaggagggaaatatgacgaaggttagagagacagagagagagatatggtagagatggagatngaagacgtagaaagagcgagtatgtgacgtgaatgaagaatgagatgagatanagtgaatangtatggatgtgtgagagacagaccgacaagagtagagcagatgcntcacgatagagagaggagtgcatagngcatcgtagatacagtaaggtatgtgactacacacaatggcgtccgaagagcatagcgtaacagaatacacgtgaatanactaggatcgatntgacgataatgtgcacgtgacagttaggtgcgtgatgaagagatatagcaggacatagcgtatatcagccagcactcagcaagatgtgaggagcgactgacaacngagatatagcagntcaagaacaatagggacagtataggtgagcacgcgaatagaagcgactgcgacgcacgagaccgcggagcgatgctnggatagagtggcatacggcaatcgataaacatgtgcggtacatacacagagcggcttcacacaggatgatgtcgttatcaatattgctcgtgggtacgtatactgaccagcatcgcgatcgataaaggaatacgtacagcgaatgtagagagtagtcatcncgactactgatgaatccgtagatacagaaagtaggaacacnanacatatagaggtgacgcatcagatgtctatacagcgcagccgtancatgagantccagtggtacat

SEQ ID NO: 19427 - DNA, 1156 bp, Homo sapiens
caccgtaccaacgcaaacacaaacgcccggcacaaaaaacaagaacagagagcgtgttcgcagcgagacacaaaaaaaacagccacctttccaggaacaaaaacaccccgacaaggaacacacccgaacaaaccgcgaagagcccaccgattttcggaaataaaacgcgcacagggcggatccaacacaccaaaaccatgcccccatacgcgacgtccatcacccgacatccctcccacccctaatacccatccccctcccccatccacaccacgacaccatataatacacgtatcaccctttacacaaacaaaacttagacccgcgccgtcgcgtacgtccattaacacaacgaccaccacgaccccaccatgaaacgagttgaggccgagaacaacacatgcacaacaaaacgaaattacaaagggaaaagataaacctcacacaccaaaaaagagtgacaagaaaaactcaacacacaaacgagacagccaaaaaatattgaacaggcgccctgaaaaaactgaaggacaaacaaagaacaaagaatgattacgccacgaagagaacgatgggaggaaaaaaaagaagcaacacgacgacggagcacaaaaaacggcgacggaaaaaatgataggcaacgtaagacgcacacaaaaactaaaaaaaagtgagaggagagggacagagaaggaagacaaaagacaagagctgcaaaagataaataacatacagaaaagagcacagatagaggaaggagaagaaaggaagaaagactgaagagaaggataacggagcagaaatagaaaacgacagaggggtagggaatgaaagagacggaagagcaacctggaacacacagaaaatacaacaaaagacccagaaaatagacgacacgacagacaagttagtatacacaaagagaaaggacgaagctagagaaagtaagaaagaaccacaagaaacaggagggaagtcggagtaagagaaggaacaccagacagccagaacagatgagaagagaacaagatatacgagaacgcagatacagagtggatatgacaacggcacggagacaacgacgcgcgtccgagcaatagagacagagcagaccatgttggtcgaaattacgcaccgacacgagaggacagaatag

SEQ ID NO: 19428 - DNA, 1328 bp, Homo sapiens
  misc_feature (1)...(1328): n = A,T,C or G
gcaggcaattctctaatcggcatctcgcacanacccaaccgcgcccataatacacaataaaccaattcaaaaactcatacgaacgagacataaacgatcantatacaccatagacatatgcctataactcgtccgacaatagcgaagaggatggctcgatgcgcatacagtagcatatatatacatctgcgcaacatacgcataaatgtcacaggggacgatagcgagtttccaacgcaccacaaccacgtgtcgccccattgtcctcattctcccatcttccccaacaattccatcccacgctcattaatttccccatccgcggcatctccgcatttccgacgccgctcggtacacctatattcatcgcctatatcttctcgatgtcccccatcatactcctttattacgcgcgctcgaaaccgtatcgatactaaatacgcgtacagaccgtccacccttcctaccatatatacatgtggtgcggtgggtgacggcccattacacatctatcctccacttcgttttaccagaaagaacttcactataccaatataagtagtgggatatgttcgatattgcctagtataacgttcaccgatgattatcatagcatcatcctcatattatatttcgtatcttcgagcacatcaagattgccttcactgttataatcagcataatataatactcaacatgtctagataatatagagtacgaaaaagaaaggatgagcaagctagagtagagtaaccagaatagaaagaggatataaattgagatatactgaggtaatagctacaaaatatattaatgacacgtatatcataaggttattgtgtattgagagatcggaaagcaatgaagatatagtatgtattatattattcatgtgataatagacattcacatggtattagtagataaatatattagataggaagtcgaacatatgatttcagataatatatactgacatactcttgagggctggatatgaacgaactagtattaagtatagcagttatcggcatcgtgtggatcagaatataatgtatatatagtgtagtgagtcagtagagtaataanttccgcatatcgaacattatatgcggcgaccataactacatatagcacagagaagatatataccgtagcgtatcgtagacgcgattatcacgtatgtagacatntaaatttacgaggatcgcaccctgcgaattacgtaataagaaatcaacatatcacntaccagcaatcatatattatctcttgccgccgcacgaatggcgtctcattgtacgcgatgcaaaatatacgaattgatg

SEQ ID NO: 19429 - DNA, 778 bp, Homo sapiens
ctctcggtgcaaatcggggcgaggtgttgaaatataactaccgcaaaagtatttattaaggcctaatggtaaaccacttgggagatctggtcgaaaaaaaacagggcgcaaggggataggactgtttgatagggtacataaagcgcaaatggagagattagatcctggttggaaaagcattctccaggggacccatggcgcctgaaggtccaccgtattgtacagggggggaaaggcgaaagtaaaaacaggacgttccagaatggtaaatgcaaaccaggttaagaacacctttcccctacccaacatgtggggggaattccaacaaggtggatcccaaaggccatcccaggaactttttggaagggagaaagcccagtgaaaacgttcaggcctttgagcacaagccaagccatcgcatcccctgtgacttgcacgtaatatgcccagatggcctgaagtaactgaagaatcacaaaagaagtgaaaaggccctgccccaccttaactgatgacattccaccattgtgatttgttcctgccccaccttcactgagtagattaaccctgtgaatttccttctcctggctcagaagctcccccactgggcaccttgtgacccccgcccctgcccaccagagaacaaccccctttgactgtaattttccattaccttcccaaatcctataaaacggccccacccctatctcccttcgctaactctcttttcggactcagcccgcctgcacccaggtgaaataaacagcgatcggcctga

SEQ ID NO: 19430 - DNA, 798 bp, Homo sapiens
  misc_feature (1)...(798): n = A,T,C or G
gcgctctgtgttgcgctgtgtcgtcattcaccgttgntcccgacgcaacgacgactctatgggggcacgcagtagcatgcgcgttgcgaccgtggagggtagtagctacaaagcataagtagaggtagtgactgcacggcgccgaggctccggttaagggctgtgaaaccgcggcgtgctaggcgcattgaaacgtgtatcctgacctaagacgatgggtcccacattatgtttttttatatctttatagtttaatatgaaccaagaatggcttcgggtgagatattcaccttcatatatatctgttggcagtccagtacgagtgatcagaaattaattagctcggtagcgggacggggcggcgaggggcccgccgcgccctgcccttccgctctcttcctctcataccctcgaaactgaggaaagactatgctcacgaggcgccaccggtctgttccgtatttgtgtctccttcctcgtatatggtctctagactgccgcggtccgccagagtatgaatcccacaggcacggtttgggctggtgcttataatcaattctacgtgggtgtcggggcgcggcgcgtcggcgcaacccgaagaaccacttctcacaagaataatagatgatagggaaagcatgagggcggcttaattattgctagcggtgggggttgcgggctctggtggcgcgggacgggtcgtnttctttgtgtcataatagtgaagtggtgggtttactatctattctaggttcccctccccaggacgcagcacacccgcccgcgtctatctataat

SEQ ID NO: 19431 - DNA, 1210 bp, Homo sapiens
  misc_feature (1)...(1210): n = A,T,C or G
cgaaagcgacgcgaaggaaaagaggaaggaggaaaagaggaagaaaagaaaagtccttccggagaacaccagcggaaaacccttccgaggcgaggagacagnggggaacaaaggggaacggcacccgagaaacccgggagcgccccacccgcccgggcgcggggccccccgccccaccaaaagagggaggacacgcacgacagcggcgagggcccagaacacagcagagagacggggaagagccggagagcacacgggaggccnagccaaagaacaagaaaacccacagagaacacacggcggcgcgcgggggcaggaagagagaagacaccgacagcaagaggagaggcccacaacaagaggagaaggaggcctcttctccgaacgaggggaggggaaggcgccaaggagcgagcacggagacacacacagagagaggccgagaggacggggagcgggaaggcgcgggaggcccaaagccccctcacacaaggaaaagcccgcaggaaggccgcgcgcacacccagcaacgcagacggagcaacggggagacgcggcggagaaacggacggggagggaagaacacaaggcggccgccaagggagaacgcgggcgcgagaaagaggaggcgagcaggcaggcccgaggtcacggaacaccaccgcgccgccaaggaacagacccgcgcgacgaggcgaaagaagaggagaggagccgcccaataccaaccacgacagacacgacaaggcagcccgacggagacgcagagtcgggcgcgcagagcgaggagaaacagacagagagagccgccgagggaggcgggccgccacggcaccacaggacaagaagagcagcggagcgcaacggcgcgccgagaagcgacgacgcacgcgggggaacaaagcgngcggccacggaacaaccccggccgcggaggaggcaaccgacaacgaccggcggagaagcgaacagacgacgcgacgagaagaggagcagggcagcgccggcagcggccgcgaagaggaggggncgcgagcacgacaagacgcacgacggaagcaggagcagaagagacgaggacgacgcaacggaccgcgaccaactgagggagcgcagaacggaacacaagagaagagggggagagagcgagcggcgaacgccgcagagaggacaggggaggagcacaagccgacaggagagagggcaggcc

SEQ ID NO: 19432 - DNA, 798 bp, Homo sapiens
cgaattaaatcaacaactagaaaaaagaaaagaaatggaagaacgtgagaagagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaagggggggaggaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacaggggaaattcctaatccagaaccaggcttttataatccaattccgggggaaccaattcatatgccaccttccaaaaaagctaatgatctatcagggaggagaagtaaagacctgggataagcgagcacacagtgatcatctgtgtaattcataaagccggaacaatgtttggttgggaatttgggcgaatacaaaatagggtatgggaaaataacatggtttatctggggcttttaattaaaaatcgaaatgggtgttaactgcgatccagaagcggcacttgagggatatgggcaaatggtgtttttgattggttatgaggccttaagtgagaaaaaatttcgtggtttgcggttttataatgttgagcgggggatg

SEQ ID NO: 19433 - DNA, 1037 bp, Homo sapiens
atacaatatgtgcgcactctctatagagggccaacgcgggcggcaggtcacgcgatgaataacacacatcatatcggttgaccgctctggcttcgtgtcaggtcggtccatataaatatatattacctgtatttccaagaccaacggcgttgcgctcgtggtgttgtactatgcccaacataacaacgcctagctgagggtggttattgatgaacctcggtaaaattatagaaacctgcgatcaacggattacgcagaggagagcgcatatgacaccactcgagatggcgcgcgcgccagcatttcaacagcgcataaaggaagatctggtgttcgacacaacaataaaataaatataatatctgacctcgctcgacacagcgatatagcggcgccgtaagacacgcgggtgaggacagcacagtaacatagtttcctctcctgcggctcggggttggatatagtacaacctcaagggcgagacagccaaaagaaacattctttgaaggggaacaattggtgtctcggggtgagtaaaagggatgtatcattctgctcacgcttcacagcacgaatttatgtttaaaaacgccacgtcaaaagctaacaagtggccagacaaagacttgtgagcttgtgttggaaaaaaaaagtggaagagtcacaaagagaaatttgtattaagatgtccaatatctaaaaatgtttttgaaagttcttagattttggggaaattgaaccccctctggggggcatattacagaagccaaaggaaaagaaaattttaagaaggagaaggtttaggaaaatcatagcacaaagcagagtaatacattaaaatgatgatgatttatgcaacagaaagaataatttttatatgaaacaaagtaacataaattggaaaaatatttccaaatacatgctgactagtctatagatactagatttctctcagatatatgagcatttaaaagtcaataaaacccgatgcggccggttttaaattatttagttaatatgacacatgggacaacaga

SEQ ID NO: 19434 - DNA, 1228 bp, Homo sapiens
  misc_feature (1)...(1228): n = A,T,C or G
accgcgacggggagcgcgggggtcaaacaaaccccgaggcggccgaggaccaaccgcgcccccagcgcacgccaacacccttccccgcgcagacaacngacgaccaactttgtnggaggcgggagaaggaccccgaccgcgccgcccggcccaanacgcgaccccggttaaccgcgcgggacggaggaacagagacgcgcgggggacggcccagccagggcacacaataccccacgtccgcaacccccaaccaccgccaccaaacgcgggacaaagaaacacacctccgcccgcacaaggaggaacagctaagctaccccccccccacccccaccccccccccccctcccgcacccccacccccgccccccccgcccaccccacgcgagaatgagaacgaaaaacagacgcacggcgcaggacacacgacaaaaggagagggagtgggagaggaagagcagagggcggggccaccgcggcaggcggggcgcagcgagaaggaggcgcaccgcgagcgggcacggtggccagcggagggccacactcgcccaccaacactccccaccacagaccaaagcacacgcacagccacgagcacccgccccggcgggcagccgcgcacctgctcgcgccgctgcgcagccgggctccacgccgacgccgcgaagcacgcgacacgacgcgccgcgtcagatgactcgcgcgggagcgaggcacgaacacacgagaacgccaacgcaccacgcgacggcacacgcgcgcggcgncgatgangagatagcaccgtcagagcacgagagcagagcgaggtcagagcagccgcagcgccgcggtcagcgccggtcgcgaccagaacagacacccacgcataagcgcacatggcgcacaaggcgcagacgacggcgccggcgcaggccaaggtgcgcacacgggcacaggacgccacccaacaccaagatagctacagcacacgaacgagcgcactcagagcagcacgcccagagagacgagacaagcaggacagacgatgaagacgccgcgacacacactcagtaccacgctaccgggagcgcgcggcaaggagcgagtagccggaacgcgcgcagctacaagaccacgaagatagtaatagacgcacgctcgcagtagtcgaccaccgcgagacgaanaacaaacgccatacgacggacgaggacaggagagacatgcgtgcacgccgcagagatag

SEQ ID NO: 19435 - DNA, 352 bp, Homo sapiens
aagcggaagcgggggatttaaatggagcgagcagggtccgacggtgaatgccggcttgacaactataccctactagataaatagtagatgtttaaatatgttactcggtccacgcgagtaaagaatctcgggcagacaactatacgaggcaacatcagccagacacaccagctagcgagaacaaatcataatatacaaatatatggataaggccgagtcgaagaagaaaaaaggctaaacgaaaaggaagcactgggggacagggacccccaatcgagagatacaggcgtcggagaagatttagaagcctaaaaaggcggatcacaagtaagaaggacaaccccagactaga

SEQ ID NO: 19436 - DNA, 563 bp, Homo sapiens
  misc_feature (1)...(563): n = A,T,C or G
tgcagtgcctgctatgaagcacacacaatgcttatctgctgctccattggaaagccaatagcaaagaagggaaaggaccttctgattggagagtggaggagtgagttagaagatggttttatgtttactgcaatgccctttgtcctcatcagaactgtgaagtggaatttgattttgatgcactctttaacaaggatgctttgtgttatccatgcaatcccctactactctgaaccataacatacacatgctacatcccaaaagccagaacccccaaaaatgggttgttcctggtttcagcttctaagatctagctttctttctctcagagtctcatttatccttttctcccaaggcaaagctggttttatctgattacttgatttctatgaaaattttagtgcattttaatgactttgtagtttatctgacccagataacatgcactttaataggaaacttttacagagacagtgtcttacccaanagaatgacttantgacgaaatttcaggtagatgtttgttcacattgagggaggctaactaaccaagtcgagtaaag

SEQ ID NO: 19437 - DNA, 868 bp, Homo sapiens; identical to SEQ ID NO: 10234
  misc_feature (1)...(868): n = A,T,C or G

SEQ ID NO: 19438 - DNA, 1391 bp, Homo sapiens
  misc_feature (1)...(1391): n = A,T,C or G
atatagctcgcaggatcgacctccttctctaactttaacacacccagcctaccagcggctgctnctctcgctagttcatnccgagaagacaggtagaacgctgatgatgcatgtcatattctgaaacccacgcctcgtagcgcactctcgaacgcatcactnagaagcctcacgagatctatgctacgactatggcctctcttgtnctgactacgagatagcgcagnagcgtagagaaactattctaatacaagacaagatactgccgctcgtctataatagnattctcgctgattntcttattcttagnaatcttatttattgggagnattaacgtatatntgataattccgnatncgatctctgacctacctntgtctctctcttctncgttagnactatctgtgcgcggcgaggaatgttaaatatanannnatcaaccnatcgnctctaacggnncgtacccacaatgatacctnctataaataatnanactgggctcctcattttnntcttcgtgacctncctcgccctcagactatgaacttgcaagacggacctctctcggattctatttactcgcgcccgaacccccgaaacgccacctgaaccatcctcngcatgacgaagtaataacgccatatgcgtgtctcgctcatcttctcacngtagtcctgcgctcgcccaccgacccgatgcgagagccatgttatatacgacagcatacgcgctcgcaatataactcccgcacattatgtcgccgcggctccgctcagccncaccatgaatctacgcgcgtaagtatattcaagcgatcgcgcgtcgcgcacgctccatatgcccacaactcaacaatgaccatccgcctccgcatcaatgcactatcatcgccgccccatattctaatttcagcattgcgcacattcctcatatccgccacataaatatagtacgaccgcgcataccacacgctcacagcagcagagtagtcgcgctgaatcgcacattcctcgtccgcagaccgcgtcactccgtatgnctgatgactccaagcgcctcacgagtgaatcactctctggctcgttgntatacaccatagctaccactgctacagcgagacagccggttgtggctatatctctcgcttgtctcaccgcgcccgatagcgaccgccacgatacaatatcaggcgcataaaatatcatcacaaacatgctcccgacactacacatatagtaatattagtacgcatataacacatcattatctacacatcacgcgctcgctcgttatacacacacgatgacacgtgcagttgctgacgcgctaanagacacaacccgctcttatgtatctctatacatagtcatagcaaacacatataatatcct

SEQ ID NO: 19439 - DNA, 347 bp, Homo sapiens
cgaccagggcgcgcgcattagctcaatagaaagactggggtgccacgagcgccatagacgcaatagcacgatcgcaccaaccaacggagaacaataggcggtgacactggaagacaacgcccaccacttaatcggcaagtcctcggctccgactgcgaatatcgagtagcgcagcaaagaagcatggcgagcgggagaatgcccacggcaaaagagaacaaagcgacaggttagcaaaaccaaaagacacagacgaacggcggggtcccacaacccgaccacgacgcgcagcgcaacgtagaacgcccgggaccccgcaccctgtaaaacacggccagggaacgcgc

SEQ ID NO: 19440 - DNA, 1345 bp, Homo sapiens
  misc_feature (1)...(1345): n = A,T,C or G
ggcggtaatgttaaccgcgataaagggtatcatcactcgtacacacgcgtttctaaatcacatgaccgctgtctggttctcaccttatgcggcccccgtttcgacctataagaataaaaaggtatataatgttcatcgtacggcagtaagtatatatgttgttctaggtggaacagcactaaatagcagctacccgaagatgagtanactccacacctcacgacaccatctgttatcgtttgtacgcgcactatgtgacatgtggatagctgatattgtcatgctcagacgngtgtggtntattcgagacgaaatctcgaacatcagatatgcacgcgtgaacgaacaacgtaccaataatatgatcacgtaatcgtatgctgcagtcaangactcgctgatgagacaccagatggctatcactcttattcacaatatccatagntgtgcaagccataacgtatgcgatactgatatgatcgacacgcgtatgtatataaatgcggtacatgaggcacatactagtgaggacaacaacgagctagtacctaggcaggcggtcggctagcgcgtatatgtttttacgacctctatatcagccgcaccctatactattgacgagagcacttcttctccacctctacgttactcctcgcgtagccgatcatatgaatcgagtaatttagtcgttggctcgtgctcactacgtgtgaagactacaaacgcgctctaatggacgttagcaactcacctcaatgaatggtgttacagattgatctcatagcggcgtagtgcgaaccatctacttgtatgatacaaagtccagaagtagtattcggttcataagatgtagacgaaccagatacaatatgaatgatgatatgacgtggaggcggaaatatgcgtcaaatgccggcagctgcacatgataaatagagtccatctacagcgatagatcacacgctgaatgaaatgaaactctaactaactactggtagcagcgacgacaatcgcgatgtgcctggtacaacgacacgcgatgatccaccgatatttatagtctcatcagtatctgaattacatacttacttcgctcgcgacacagtagaatgaagactagaatgtgatgagagaagcatgtttagtgtggggagctgtagagcaanacaccgtactagatcgctcgactgtatgctgcgacagacagtgtaaagtatactgacgctaatccagttctgacgggtgatacgtgagagttggtcagtgctatctctgtagtaacgtgcgcacgtcgtaagcataatccgaatagatcgtcacgcgagtcgctgtgatggagacactc

SEQ ID NO: 19441 - DNA, 1207 bp, Homo sapiens
  misc_feature (1)...(1207): n = A,T,C or G
gcgatgtcgttgcgtctccgcagctcctgcgtggcctcgtacccgctctcctgcgtcctcttgcgttcatccgctcaggcgcccacgcaccacgtagttctctgacgctgctcttccgagcgcgtttctctactgcacttacttcactctaatgcagcctcacatacccctgtcactcactgccccgtctctctcatgctcacgcgcgccatgcggctctgcgtttagtcggcgtgcgcctcgtcgcatgtctgcgtgctctcgtntatngcctctcgtcnctgtagcgttcgcttcgcgtttacgacaccttctccgtactntctaaggcgtgctcgtgncgcgtcctctcgcgctcgtcttcaccacttatgcgtttctatgcgcgctctctctcacacatctctgtaaatcctcttcccactctcatgtctgtttcctttgcgcgttttcaaccgtgcgacattctctcncgctctgagacacggggtccacgatccggcgtatgttcatactaccagtcctcacggatccgtatatggacgttcctcgatttgctctatttttgtaagccggcgctgtatgcccttcgcccgtcgcccgccctgcgtgctctcctgcgcgttctagtgcgttttagacctgtctcacatctcctcgccggtcccgcactctcggcccggcccttctactccaattctctcactcgcatcttcttaccctcgctgcgctctacacaacacatatacanacatcgcgtgcctagttgtcataccactacttctgatgtttcctctcgatactgtcttctatttctctctctctctattatcgcatttccgctctcgcgtcgtgtgtgtctgtgcccgctctgtcgcgcgcgccgcgcggctcacgtggtgtgttctgtgttggtctaaatggttggtcttcacagtttgggggctgagtaaatttggcgcgcttcctccacccccttcttggntgttcttatcgctctcgcgcgtggggcttaccgctcgcgctaacggcacccggccgctttttcctgtcactaccagacgttgtcgcttgtcatgttgtcatgtcncttgtttggccgcccacaaccgttttcttttatgttancccccaaacctccctctttctcttctccctttctcctctctcgctcacccactctcctccctcactttatccttttcca

SEQ ID NO: 19442 - DNA, 1062 bp, Homo sapiens
  misc_feature (1)...(1062): n = A,T,C or G
agaaggnnnnnaaaggnnagagngaaaanaaggagatnaaagaagaaagagaaaggagagcacaaaggaaggagacaaagtgatcgaggaaacacggagacacccaccctnctcaggatcggcacgagtacacccgcatccagccacgcaccatggcgcgcgaccaggagngcgcacagactcatgtacggacagcgttanatccagccgcgccgcggngatggcacagagtgaacacacgcccacacagcaagacaggagcgaggagccacacggacgagacgtagcaaactntgtagacgagggcaggcgcgagcaacgcggcaaagagggccgancagagagggaagggaagagtaggaggnaagagagagagagagcgagagtaagagcaaggaaggagagaaagacaggnccggagacagacaacggaccaccacccctaccaccagggccaaacgcaaccaaggacaggcagagnnaaagagaacccagggaaactcagcggcgnacgagcagcaagaagaaaggagaacacaaaccccacccgcccgcacacgaacgacacaaagccccaaccggacgcggtccagggaggaccgcgggagggaaacggccagcagcacccacgcaggcacagccgaccgacnaagacgccaaggacggacaagcggctcaccaagcacaggcccccagcncaaacacaaggacaaacccaagagcncacgcaaaaagggaggacaaaggacacgagagcggcgaggccctggcggcacgcgccccgccggggcccaccagaccccacccgcacacccacgaccccaccagaagcaaacagaaggccaccgcgcgaggccccacgagagcgccgccagcacggaaacagtaccgcgggcgggaggngaaggccggaanctaaggcgccgagggcgacgcgacccagggcccgcgcccacgcccgcaaaaacgctccgcacaggagagaaggcccagagcggcccgaagcggcgaccgagacaccggcccacaccaaccgcgcaccccgcccccatcagacccaag

SEQ ID NO: 19443 - DNA, 1034 bp, Homo sapiens
  misc_feature (1)...(1034): n = A,T,C or G
gcggggtgggggggtggtggggtcgtggttcctccacgccccgccgcttcgtctcttccctgggccgcttgctctgttcgttggtctgtcggggcgtgtgtcgctttctgttgtcgggtgcctggcctgtgcgcgtcgttcactgtccccgggcgctgggttctggtgtttggcgggccgtgtgtttgcggtctgtggggctcgtgccgcctgtggtgcggggcgctctcccctcgccggtgggctggtggggnttgtctccactgggacgccgtcttggcgtcctgcggggctcgtcgtcccgcgctctctcatccttgcgcgctcgtctcggcgggcgtgtccgtgggatctgtttttcggtgtgtctggcagccgctgcttgcggtgtgagtccttcggcctcgggcgcgtcgtggaggcctgttcgcggtccctctctggtgcctcggtttttgctctcggccccctgccgggccgtccgctcggtggtgaagggtgcgctgctggttcgcgtgttctgtgtctgcgcggggcctgggtgtgcgcggcgcgggggtcgcgcgctccctccgtccgttgggtccctgcttccctcccccttgtggtcgttggggcacccccgtccgcggggaggttttccgccgggtgctggtttttcttaccggcgggtggcggtgggggggctcggggtgtggcgtggggggggggcgggttggggggcgggggggttcgcgggcgggctcgcccccctcttcctcttctccgcgctttttttgtccgcttggtttcttgcgtctccgcgttccctctgcggggtcccgcgggggggtgctcgctctcctctggggcccgctcgccgcgcggccttgtggcgtggcgtggtggtggtgtcgcggggcggggggggggggtcgtggcggctgagttttttttttttgtttttttttttaaggctgtctgtttctcttgctgcccgtacctgcccgactgcgcccgtggctccccccnccgtcacccatttnccttaaatt

SEQ ID NO: 19444 - DNA, 827 bp, Homo sapiens
ccccaccgcacaaccacccaaccaaccgccgcggggtcgcatcaataacaataaaaacgctaaatagcttctatcgttcctgcaattgccaccacttgtataccgaggcacaatatctacgaacactcctagaacaccaccgtcactaaaactacattctcaaaatctccgcgatacggcggttttttattcttccaatacggaaaacacagaaaagaagagaaaaaataaataaccctcagcaggccgcgggacaaaactaggccggaccggccacgcccactacctcaataatacaggattaaaataattagcaagcgatatagatcacccaacaccatcttcttgtacccgccctgacgaataaaaatttacccttactgataactaaacacataacctaaaaaatcccccacaactagaccccacaatatcggtcgatcgaaatgctcacaggtggcactgaagtcgatttacattgccggttctatttaacccgtgaagggaaacgtagcgatcacgaaatgggtgtgcgatatctatacaaatacccacaacaaacacctccgtcggtgcctcccctttgctcggtggccaaatgttaatgctagacatggccatgcttctagaacctcccctttttacctgggcttaagacctttgtccccgtcactgccagcgcttgggatgaagaaagctccagactcaatgtgacccccaggtggcatcgccaacgcctgcctcgtgccacctcatgcttataataaacttagatgcggccgaaagcccgctttgctcaaagtctgaatagcctaccaacagccggc

SEQ ID NO: 19445 - DNA, 396 bp, Homo sapiens
ataaagatggaggaaaacagaagcgagaggatggataaatgtgggagattataatatgattaggaagttatagattggagcggatagggactaatttgctaggagactgaaaaacaatatcccacccccatcgaatgtggcgacgaagatgtcgggggaagaaaggcgagacgaagggaggtaaacgcgggacggtggggggcggaaggtagactagggcaagaacgaaactcggacggaggacattgttggtaaagaaagaaagagaggagtgggaagaagaagatatagagatcaaacccgaagaatcaggggagataagagcataaagaattaaggagagaagggagccgttgaagcgacggggcaaaagaacggggcgtcataagagttgaa

SEQ ID NO: 19446 - DNA, 457 bp, Homo sapiens
cgagttcctctccctagccgctctccgacgtgaacggcgacacggccgtgccatactgcgcgtctcaacacaacggcccgcgtaagccggtattagtggaatcagtatgaccgtgacaaacttaaacataccggatagcgcagcaatcgcataaccccggaccgacgcgtccaggcggagaaaatcaaaaaagggtggcggtgatgaacgagacgagacggcgcaggcgcgcggaggtaaaaaataaaaggggaacaaagacgcgcgagaatctaagggattcgtattaatacgggccacactcgaacacggacaaacaaggcggcgatgtggcgggcaaaaaatcgaattcataccgccgtactccacccggtcttaaaaccagcgaaaataggcactccaacataaacatcacgacgaccgcgctcccatcaaccgatcttcggcgcgcactgta

SEQ ID NO: 19447 - DNA, 1484 bp, Homo sapiens
  misc_feature (1)...(1484): n = A,T,C or G
ctgtgtcgctcgcagtgcgtggtctcagccgntgtcgcgtcgctntntgtgtctgcgtgctactgtacgtgcggtgtctgctctgcgtgtgatttgtctcctctgcgatgngtgtngtcgtgaacgcgcggcgcgtgtgttgtgtatgtcantcgcgtccgcgccacttctncatcgtctattcgtgcgtacgagtgcgtgcgcgctgtgcntgtgtgtgcggctctgtgcgccggtcgcgctgntgtcttcgcgcgcgagttgtggtgttcgtgtgtgtggtgtacgcggcgtttgtctgcttgcgtccgtcgtcgcgacggtgatcgcctcgtggcgctatccatcngtgcggcgaacngggcgcgctttgcgccgcgcacgccgtgcgcgtggcgcgctgacgcgcncgcgcgggccgcgggatgcgcggtcgtgtccgctattngngcgttgtctttgcttgtgnggtgtcgagtcgtccctgcaggtcgctctttctctcactatcctcgctngatgcgctcgttgttcgggtgcgtccgctgtcttttcgtgtgtggcgggtggtcgtgtcgcgcgcgtctctcggcgtgcggtcgtcagcctcctgtcggcgcgccgctcgtgttgtagcttcgctccttcgtttcttcatcggtggctcgcgtgctgttncggcgtcgttcgtgtggttgttgtgtgntcgtgctggtgtcttttcgtcgttgtgtcgtcggcggctgtgtcttcgctgtggcgtcggtgtcttgtatgggtngggcgggatggccgtntcggtgtgcctactgtgggctttgcgtccgcgtgggggcttcgcgtcttctaggtgggctgatgcggcgtcggtgggagttcgctggtgatgttcgttctgcgcgtgcgggtctcctcgttcgttcgttcgtgtgtctgttcgccgggtctggcgctgtgtctcgctgtactcgcctctccctgttgtttcgcgtctggtggtttgtccctgntctngtgtccctccgcgtctggggtggccggcgttggggtcctgggtgtcggcgcgttgttgtgtcggtgnggccgtggggcgcgtgtcgttcctcggtcgctcgcggttgctgctgtgtgtgctgtttccgtggcttcgtgtgtgtggtgcgtcgctccgtgctggctctgctcctcgtttcgtccgccgcctctccgtcgtcgcgcgtctccgtggtgccctcgccgcgctggtgtccgccggcggctgtgtgatcgctggtgcctgtgctcgcgtgttgccgcgcggtccttcgcttgtgctctcggttgcctgtgtcccgcgtctccttggcgctcgcgctctgcgtccggtgaaagcttttttcttcttttgtttctctcttctttacaagtgtgtttcttcccttttcggtgtctttcgtcccgtgttgtgtcgttgttttgtccgttgttgtcgctggtgtctgggt

SEQ ID NO: 19448 - DNA, 379 bp, Homo sapiens
ttgagtgctatggcaccaaaaggataaccgtaaagtacacttcgacacccataatcgatccaacacggctccaagctccactgcgaaaaaaaaaccaacaaatgtaaccgggccggaaaaaaataaacgggcgccccgataaaaaaaacacgcgcgcgggaacgacacaaccccaaaccacaccacacacccacccgacagagaagaaaatcataacatactcggaactaacgataacaagtccgtcggcccatccaaaaagtaacggataccaagaagcacactagcaacgccgtcccagcacaaccacacaaagacgccctgcaaaagaggaaccaaccgaatcataaacgtaccgacagagcaagcgggaaataac

SEQ ID NO: 19449 - DNA, 566 bp, Homo sapiens
ttctccctgatgtctttattggaaagcctggacccagcaggtgccacgacagccagcaggcctgtggaaatgcctcttcaaagctggcttggctctgcccagcaatgcaggctgagcccatccatcagctgtcctactgcctgccagcgagagtgtctgctgggcttgccccgccagccagattggaagtgtcaaatgcaggccgacagggctggggtttggaggaggccctcagaggagccgtctgtgccacagtgatggatgacaccaacagggacgacattccggggattttgattctgttccacacatctggcaagctccttaaccagagcagctgcaaagctcccatcgcaggaactctgagcattttctgagagaccccaaacatggactgagttaatcctggtcaagggacctggagcatgtgcttaagaaggtttcccaatgcatgctacttcctgaaagctaaaacccaaggactttcatgaaacccaaacctataagagattccaggatcgtaaaaaggcaaataaaacttggagttaggtaaaaaaaaaaaaaaa

SEQ ID NO: 19450 - DNA, 337 bp, Homo sapiens
aacacgaaatctgaaataccggcgaaccggctcgcggaagaccttttcaacagcctgtactgttaatccccatagggtactgcgggcgcgacacctcgccacaacgcaccgcgctaacattctttctcgcactacctcccccaacccactgcggtacctgtggcgcgtcgcgacaattggcctcatatgcgaaagagcgcaacttatgtaaacaagtggccagtgatcgcgcggcataacatcaactataaaaaaaaatcggctccgggcccccctatgtggtctaccggtatgggtaggatcacaggcccatataagcttctcccacgttaataga

SEQ ID NO: 19451 - DNA, 902 bp, Homo sapiens
tcctccccacttccacctccatacgacactgaacggtgcacgcatctcccgccacccgcgctctgcacgtgtcaacgcacgccactcatcgtcctccgactccccacacccctctgagacgccgctccggcgttatcactaccatcctcacgcctcaccgggcgagtcaatacactgcacacacacgccacccgtggcccaacaccggcacgaccaatgcactatgacacgcctttctcgatctaccccgacgattaacaactggcgctccgaacgtcctcaactactcttctaacaatctatgtgcgccataccgcatcccacaacgcttcgcctgccgctcctcgaccacaccactcccggcgtccgcaccccgtaatacaaagaccccggctccgtgtggttacgctaagatccctccttgctaccccgcaacacgtctcaccatggtacacgagctcatcccaccccggcgctggcacacaccgaaacgcgcgaccgctgacgacaacaaaacacactcacttcgcccacgtgcagcaccaataacggccgggtatgtcgtccattctgacggcacgtcataggccgctacggcgtcggcgcggctctcttgtaatcgacccgcccctcacaacagcggtccgcagcgcttcttgtgctccctcccttaatcccccccccccccaggggccggtccataattcaattattcatgatgacaattgggaacacatgtcgtcattcatcgcacgcggcagccgggcttccagcgatattattcatgagttggcaagagtccctgagtgtaacccgcaggctttggatgtggatcacccgctccccatggtaaccagaaagtgctgggaaactagtcatttccccctgaactgaatcttaaa

SEQ ID NO: 19452 - DNA, 432 bp, Homo sapiens
ctatctctggagggtcttgaagaaagaagaaattctgtattatccaaacagatggttatgaggatctactttcaaccttccacgttatgtgctgtgaatcaagtcttcaccctaccatttatccattgtctccaagagcttttgatatatcaggaaatagggaagccctacatatggaaaagtgtaaggattgttttggtgagatgtgtgttccagactctctggattcaaatcccagctctgctactcataacagtacatgctgcccatgcataaacaatcaaagttaaaccgagaaaagatggatacacatggagctgctaccgattgggaaaggatttggttattttattatttcataatgctgagctgtgatggacctgacgacatctgagaaaaaaaaaattgcccaaatgaaaaaataaatcgcga

SEQ ID NO: 19453 - DNA, 1305 bp, Homo sapiens
  misc_feature (1)...(1305): n = A,T,C or G
cggcggtcgcctgtcgcgctgccgagtatatctctcctcgctcgttattctgtctctctcgtctcgccgcggcggggggtcgtnttgcgcgcgctcgtactgtcgtgtcgctctgttctccggtgccctgtcgctggtcaggtgcgtcctctcgacgtctgtgcggtcgctgcggtgcttactccgcggcttctcttcnctgctgtcgcgtcgggtcgcggctttcctgtgctgccatgctctctctgatggttctgctccttcgtcgggnttcgtgcgtcttgggcggcgtctgtgcgggtcgtgcggtcttctcttcccgcctgcgcgtccgtgtctccgtctcttctgttctcgcgctgtgccgcgtgcgcggctcggtcagtttggtttcggggggctcttcggcgtcgtcctcggcncctccctctggttctttccgcgtcctctttctctgcagttctgcggcgtgcgtggccggttgggtctctgcgcgttcccgttgtcctgcccctcgtgggtgcggggttgtccggtcgcgcggttctgtcgtgtgttctccggcgttctccggccgcgccgcccgccgcgtgccgtccgctctttgtccgcgcgccttgttgcccttcgcgggtcccgcttttccgcctctcgtgtggctgcgtctagtccccttccctggttgtcgcccggcgggtgtcttgtctttcttgcttcgtccgtctctcggcctcggggctcctgcctgtttaattatcgggtgtgggttctttatgtgtcgttctgcttgttttgttcgtcgtcgcgggcgcgggtggtggcgcttctctgttctttttgtgtgcgcncgtgcgcgggtgctgttttgttgcttttttcctgtcgccgcgtcgtggtgcactggtgcttccgccgcttccgcactgctctcgcgcgcgggctgcggtgcggccccgcgctgctccgtcgcgcgcgcgtgcgtccgtgcccggcgtcgtcgggtccgtgtcctcgtgggttcgtcgtctccgtcctctggccgcgtcgtcgtggtgtctcgctcgtcatctccctcgttcccgtcgtctcggcgccggcctgtgtcttcccccccggtcgcctcgcgccgcccgctcgtctgtctggtgcgtgtctcccgtcgggcgcgcntcccgggttggcgtggtgtttcgccgctccttgagcggctcgtggtgtttgtttcccctgtggagccccccctgcggtgcggcgcttgcgcccttctttgtgttcgcgtttctcctcgtcttcgcttctcgttct

SEQ ID NO: 19454 - DNA, 781 bp, Homo sapiens
  misc_feature (1)...(781): n = A,T,C or G
atggtactgcttatgaaacacagaataaaattcttcacgctgtgtaaaactctttctggagtctgtgaccacatcatatccctgtcgacagatcctctcggtttcacagtctgctcacctgaaagagatccaactggtatacattaaactaagcgaagggctggtaagagataccatgtttatcaaaaccaccatctttcagtttagagctaatgatgaggacaaagcagtctatgaatgtgggaatctatgaatgtcaacaaacactgaacattttggtattttcttgctggaggatttatgctagtggaatttagtgatgcatgataagaaattttatcaatatcattgaaagtgaaggaaaattgaatacggcgacttttgatttaatctacttggggactcatttagctttaatgacatttatttcacctaacctcctataaaaagtcgcttagatttataaggaagtttatagattttaataactaaacacccatagcgtccgcttccctttagggaggcgtaaattttcatcctacttaactgactccctagacttcgacacctccgcttcacaatagcagaattattcttttacatctgccgattcccagcctctcgaagattttagagataactcccgaaacaccttgaaacaaaaaggcctccttaacgtacatatcctttacacgcaccttntacctgccagttcacataccctcccccacctaacattttgtcaaaataatactcgaacatacaccgtgcatacataaat

SEQ ID NO: 19455 - DNA, 155 bp, Homo sapiens
  misc_feature (1)...(155): n = A,T,C or G
gttgctgctcctcgtcctccgtgcgggctggttcgttcggcgccttggccgtngccgctgcgtggtgttctcgtttcgggctntngcgtttctnnnntcctgtgcggcgcgcgccngcgcggcgtgcggtcggtcggtcgggcgtttgtggttct

SEQ ID NO: 19456 - DNA, 807 bp, Homo sapiens
cacaagattttgagaacccagattcaaataaagaaatagatatggccaggtgcgatggctcacgcctgtaatcccagcactttgggaggccgaggcggggcggatcacgagagacagggtcttactctattgtccaggctggattcaaccttgtgggctcaagtgatcctcctgcctcagcctctggagtatctgggactacgggggcgtaccaccacattctgctcatgccctatatattcttttgtatgtatgggtgtaaaaacggagataaagatcgagatgtggatgccatcaacttacgtgatgtttgaagttctgagaaagcatagatgagtaaaggagttaactgaactttagatcgcgcataagagcataaatatgatttctgggatatgaactatggggttaatttgaatactatgcgcttaagaatagaagaacgtaggctggcattgccttatagagaggggtgatttgatgaatgctccgtacactgacttcaagcgcataggatagtacggtcagggaaagcggatatcaggtcaactaaaagggcggcgctaggtgttgagcacagaagagatgggagtaaccccgatgaaagaccctgtgtattcgacgggtcatcttaggggctggagaccgtagaacggagcctgtcggagttgctggtgtgggtttaggtgtaggcacacataaggggaggtgaattgagtgcgacggcttttcgcgcttgtgagagagcggataatggcttatggacgctactatctgtagactaagaggagaacaatatagatataa

SEQ ID NO: 19457 - DNA, 434 bp, Homo sapiens
cttgtgaatgacttcttcttggtggcttgtcttgtgcccgtctcttcatatttgagactttctgtcgcatccaccagtgtatcagcattaacatgttggcagataaattgaacactgaaaggtggattgtaaatttgattagaaatgcaagactggatgtcttgattgattctaaattaggtcatgtggttatggaccctatcagcaagtgattgaaaagaccaaaagcctttcctttagaagccagatgttggccatgaatattgagaagaaacttaatcgctcctaactgggcaactcaagattctggcttctactgaagaaccataaagaaaagatgaaaaaaaaactatcaaagaaagatgaaataatagacttacattttggaaacaacatattacgtatagattttgaagaattggaataaaaattga

SEQ ID NO: 19458 - DNA, 263 bp, Homo sapiens
actttcagaaactcaccgcagctgacgataaaactgctcagggtttctttatggtgcaatggcccaggatgtcatatggcaaaacgcgagtgaagagcagctgtgtgatttctgagacctagttcagcctttgattcagtaaatgttaagcagcagaagacttctaatggttgaaattcattgttacaggatttaactcataaactttctctgcaatggttgctaagtctattccatgttaacactgtggaaataaattcaga

SEQ ID NO: 19459 - DNA, 274 bp, Homo sapiens
aatgctgagatgtataaactgtcttcagagcaattccatgagggagcacaataaagccccgcagggtggagcccgtctgctcggacctggtcaaggcataccagcgctgcgtgagcgccgcccagacatcattccctgccctggcagtgacttggagccctgtataagggaccaatcatgggaccacagccactgtgccctgccgtcatatgcccctgagcctggggctgccacgtgtttaggaaacaaagtatgcgctactgtctgaaaacaa

SEQ ID NO: 19460 - DNA, 219 bp, Homo sapiens
acagggtgtgctgggcatcaaggtgaagatcatgctgccaagactggccctaagaagcccctgcctgaccacgtgagcatcgtggaacccaaagatgagatactgcacaccaccccatctggaagccagaaccgcctgccgtcacccagccagtccccacagcgtaacagggtctccttggcagctgtattctggagtctgatctttaataaagattga

SEQ ID NO: 19461 - DNA, 301 bp, Homo sapiens
gaaacgcgcttaaaccctacagcagaggagcgggctggctgtgctccctacatccacatctcctgagtgcaggcctcggcggcagagttgcgttcagaaaaccagcaagcacatcccccaaacgaagaaacttggacgatctcagccttgtgcttgacaacttatcccccacctcccttaagtggttggggagggggatgagcggtggagtccaaagggatacagccacctcccggcccaaatgcaaattcatattcatgagagcgggataaataaaaatcgatgcggccgtaattcatga

SEQ ID NO: 19462 - DNA, 128 bp, Homo sapiens
atccaaatcacaggacagtacccaaacacaaagcagtagtaactagcaacggataacatcgagagtctcgctaagaaatgaaaattctgtctttccttccgtggtcacagctgaaagaaacaataaag

SEQ ID NO: 19463 - DNA, 1462 bp, Homo sapiens
  misc_feature (1)...(1462): n = A,T,C or G
ttgntggtgtgagagcgagtagctgtgtctcggctgtgtttgtgcgtgcgttctcccgtgtggtgtgtcctctcatttcgctacgcgcgcggtgtcgtccggcgtcgccgtcgcgttctctctgtgtgtggcgcgccctcctttgcgtggtcgctgcctnctgcgcgctgccatgtcgctccttggccgtcgcgtcgtctccgtccgttctcgttccgtatgtgtcgcttcgtctcgngcgcggntccttgctgcttgtcggtcgtgttgcggtcgcgcgccggtgcacggtcgcgccgcgcgtggtatgctctgggtgtctcgctgtcgcgcgttcgttgcgttcgtcgngctcgtcgcgcggtgttcgcgtgtgtttctgctcttgctcgccctgtcgcctttgagngtattctgcggttcctttgtagcgcgttgttggcggcgcgtcgggtgccgtgcgtctggtcgtgtccttctnctgcgtgggatggncgcgtcggtgctgggtgcgtatctccgtcctgctgtgctcgtcgcttggtctctgntgtgcggtctgctgtctctcgtggcgtccgtctacacattgtgtgctccctgcgtgtgctgctggtccgctttcgtggcgcgtcgttgtctggtgctcctccgtggtggttcgcgattgtctgtgtgggcgcgggggttctgggtgtcgtgactgtgctctngtcgcgtggggcggcttggtcggtttgctgttgctgtcctggcgtgtttatgcgcgtggggtggcttcgttcttttgtggtcggtgtcagtgcggctgttggggttcgcggcttcttatgtcctgtgctctcgctgtccgcgccgcttgacgtctcgcggggttcttggtgtcgtgggtgggtctgtgtgtcggtgcgcgggcgcttgcgngcngcgggcgcgngtttgcgcctgctcgttgcgggtgtgcgcgntgtgcgtcggcgtgccgctgcggtttcggtctgttggccggcctgttcgttcctctcgtcgtcttcnccctcgttcttgtgcgtgtgcgcgtgccgtctgcccgctctgtcttcgtctgtttctctgttttnccgcgtcctctgctgtgtcgccgcttgnttctggcgtcgttgttgtgcttgttgtgttgtgcgtccgctgtcgtcctgctcttgtttttctgtgtgtgtgttgtgtggtcgtcgcgcgctgggcgtgctctgtggtggtgcctggtcgctcgtcttctgtggcctcgcgtctctcgcgctctcgcccttccgtcttccggtctcgctgcggtcgttcgctcctggtgtttctctccgccgtgttgcaaggaccctgtgcgctctgtttgtttcccccctntgagggtgtctcttgctttgtgtcgtttcttctcgcggcgttcggtgtttcgttgcggtgggagcggctgtcgttgtcgcgg

SEQ ID NO: 19464 - DNA, 261 bp, Homo sapiens
  misc_feature (1)...(261): n = A,T,C or G
aagcagaatctggtaatataagtcaaaagtctgatgaagngaagatttaccactgaaactgacaatatattcagaggcagatctaagaaagaaaatggtagaagaagaacagaaaaaccatgtgaaatgcagaccgaagaattagctggaaattctgagacactaaaagaacctgaaacggtgggagcccagagtatatgagattaactctgtccttacatactcaatgcatatatgaaaacaatactaaataaacactga

SEQ ID NO: 19465 - DNA, 1262 bp, Homo sapiens
  misc_feature (1)...(1262): n = A,T,C or G
ctgtgtggcgcagacaacaatactcgcgccattcttcatttgttagtgtattatctttgctctcgtatctcaaagggagttggttgcggggtagcgcgtgtgggtggggggagcgttcaccagaccacaatagaaacagaggagagtgctacgggcacactccgagtattggacgctactactgtgacagtcggataangtctatattagtgataatgctgctcggctatcatcgcgaatgcagaaattaatgttgatcagatgagacagtatgtgagatacaatccgaagacatacgccgtaagttgaacattccgcaatatgtttccgcngcggatgtgttgagcgtgtaatcacgagacagccatccgcgcccgacatgcagtcgtgccggcntgtatatcgctccgttgtacggtgtaccgatgttccatgttggtccgcagatattgcgtttctcctgggccgtcagagtattccctcgtcatgagaagtagggctggcgtatgacgaatccaagtgagcctgcacgcggggagggcaaacgtgaggaagcgtttgaaaaggtacggcgccatcagagaaggcgtcgatgatgtatgtaccatcgaccgcgcgaatagcgtaacgcggttataatgtcgtgatgcggcgtgtcggcgttgggggacgatggaatgtgtagaaggcgttaggagaagtgtcggagggcgtaggtatagatatgagcttggttggagtgatgagcgatactagtgtgacggagtggtgctatcgtgatgcgagtcgggctntcgtagtccgcgatacgagcgagcgagcgctggggtccgcatcggantactgtcgtaagcggcgtatgtagcgagtgggagcgatgcgtctgcgagaggaggtgcagacacgctatatagtgctgtattacgcctagcaatnagtattgtttccgacgcgggcgcatattacgcatatcgcgaatgtgtcgcatgttgtatcggatatgtagccgcgtatgttacgccgtgcggttgagatcgatgctagccgccgaatccttaggtataacgtgcgtattcgatatatcgccggaatgctcggcatggatgtagtactagggtcgcgagcgagcgattccgccatataatgagtcggcagtgtagagaagantacgttaaagtacggctctatactggttggagatcagtagcacgttttatatagcccgattagtgtttcagagcaccgactggagtgagccgcgt

SEQ ID NO: 19466 - DNA, 1227 bp, Homo sapiens
  misc_feature (1)...(1227): n = A,T,C or G
aatataaaatcgcgagggnagnnnnnnnngccaccnnnnnnnnnnngcctaggggttatgcacacaggagaccgtgtgtaacacaggccaccttgtgtgcgtgggtcttctggttgacttttggagcaacgtcccaaaaaaccgcgtggatgccacacacccgcgggggggggtcccccccacactaaaggggaccccgcaaacaccgggggtacacacaacacacgggtgggtaccctgcggctaggaaggggagactttcacaaaaaacccgccacgattgcaccacgctcgcgggaggtggttgctaacaataacacatccccgtgctgcctcccagagacaacaaaaaaaatcttctttttggtgcgggggggcatcttcccccttgggcgatcggggagcggtacatggcgtgggttttgagaaaccccctcccaatgtcgttgctcggataagttcccaccccgagggataagcccagggatttgtgatgagtatgctcgctgcccaccgcgcctcgtttgtaatatataataaaaactctaccatgctataatgtctaaactaagacacgcgtgatggatgggatngatgggtagggtaatgaaagtggagatcgagttcagaccacccagtcgtatattcgcgcctataacaccagcactctgtgcggcgcgacgtagttagcgtattccggctgtctacaccaacatatatggccggtggcagagaacatttcgcctgtgacgttatatagttataattcaagcacaattaaaaggtgtcgaactgagagtcactatccacacacgccgcgctcctgtaggcactatattcacaatggacacacaactggtaccagctattcgccttacccacatgtggtggnagaagcacccgacggagattccctgcgatataacagctacctataacccggttcgacgtatgctgtgtgtgcagatgatagtaggcagatagtgattatatagcgcggcgcgcaccagacgagtcgtatcagaatgtaaattgccgccgnactcctgatgatcgatcctacgatattcgatatagcggaatattaacagaccagtaccgaccgcaccngtacgcttcgtcgttacatatgacatacacacaaccatctatctgatgtagtagtgtagcactaagtactatcatagatatgataggtgccgacgagcatgcacatgtcaactgaat

SEQ ID NO: 19467 - DNA, 1133 bp, Homo sapiens
  misc_feature (1)...(1133): n = A,T,C or G
ggtaatagaacttaatatcgaagatagaattaaaaagtaaacaattaaaaagataaactaataattattgattaaacacaatactaagacacataaataatctatatcggttctttctatgcatgtgataattaatcgctcacactaggcccacgaccatctaatcggaaagagacacgtaaataatatataaaaaggctcaccgagaaaagcaggtactgagagtttgttgtagcgatgtcgtcaagccgcgccgtgtaatatctaattaggataagtggaaaaaagtatgaacgtaatagtatattaaatataactacggatcataacggaaccaccgacataacattaaatataaattctaatanctaacctcaaatacgtttgacaacatgcacaaactgtaatatatattcgatagagatcaggtggtagctgggtgcgagtgacaaaaactttagtgactttgtgtatgtttgatttttaatctaattaaatacttgaccgataacaaaaacgaaaaaaagatgaataaaagggtaatggatcggatgatcgatcccccctttccgctagctctctaaataggaggcgataaggtgaagataagaggaagtgtgcggggggaatagaaaatattaatcaaatagcaaagaaaaataaacgcctatctaaaaccaaaactagttattacgaaatttgtgcgaggggaaataaaaacaaaaaaaagcagaccaaaacaaataggcgtcaagcgcactgtgtgacgaggaccaccgagagacgttccatctattttgtatttaaacctctctcggcgttaaacaccgttttgttatgtggtgttcgggcacacggtaacgttgtaacatatgcatacactgcgcacttacaaatttcttttctcccacacacacatcatagaaacgtaacaaagtcaactacttagataaaatcgatnaccataatnggacatccgggtggattcagaaaaagcacacaacccctcccccccccnntggtccnnccnccactaggatatatcaaaaataaaaagataaaaataaaatgaaaaaaagatatagataaataatataatattatacaactataaaataaattaaactccaccg

SEQ ID NO: 19468 - DNA, 1172 bp, Homo sapiens
  misc_feature (1)...(1172): n = A,T,C or G
ttggttgttttgatgtgaggtantgttgttggggagtcgtgggtggaggtgggaactatgagaggagggaggaacgctaaaaaaaaaaacaagaaaggagagagtgtggaggggggcggaccccgcggacggagcgaaaaggttgctcgcagacgagaacgacgaaatgaaggagaacgggcggggcggaggggacagctcagccgcaggacacgacccctatccccgcgggcaggcagaggccgccgtcctttaggaagggagacaactgcccctttgcgccgttctgaccactgcgtcgataaacgcaccctcggcgcacctggcgcgcgagtccccacgccaccccgttgctcgcacgtatgcgcactgttctgcgcccgaccggacgcgccagtcccttcagcgtgttgtaggcgtctcatcccatgtctgcattgtatatttgatagagtgcgccgcgcccccgtctgtgagtaaatcgtatcgcgtctacctctactcgctcccgccctactctatagagcgtacactgcgtcgtgctagggtggatgcggcgccccgcgcggggcggccgagtcccgcacggagaagtccagggagacggcacgcgagcaagagcgaggacaaaataaaataacggcgactacgtgccggactgtgagagtgcggtgtcttccatcgcgacgcaggcctgcgcgcctgcgcggcgcttgaatcggtctgtcgagaggatcagtcctactttctgctgtgatcataatctttgagagctgtgaaggacggacaacgaacgcaggcggnagcttgctggttgtgngcgtccggtcctagcgattcttttcgctccgctcccgttatgtgtcgatgccgttntgcgcgcgccgggcgtcgggtagcgccgagtccctcgcggcgacggcggtggagtcactacccggcgacgggcagcaggtacgatggaagaacgagagacggtaacgccgtcgcacggccgctcaccaccacagcgctcgaagtaatgacactgtcacgtcgccgtccagcgggcacggtagcaggtgagatggaggacagcgcgccagagacggtacagcgcgagacctcgagcacgcaggcgcacagcgtgactgcctccgagttgtcatcgaccgcgcgcgcggagatgcggt

SEQ ID NO: 19469 - DNA, 1988 bp, Homo sapiens
  misc_feature (1)...(1988): n = A,T,C or G
atttaagagagcgtgacgtctcatgagctctacgtntnaannnatatcaaacctcatanaacaacnctgtgtgcgacnagcggctctctctgcgtcagcaaagtacatcgacagcgcagacggatacgagcatngacacactgcattcgtgcngcgtctgtgtctnttctcgtcgatggctctcgacctatctctgcagaggatgccagctcacantacatagcntngtgaggtganggtgagtatactatggcgcgctgaggtgcatcgtggtagagatgtgtcactcttgcgcgtatcagttactngatgtagagcgcatcgtccaccgccacagcgccagcgccagatactncatgtagantcagacatatacgttagngcttatgtgtgtgtcgttgtactcgcatcgctctatgattagagcatgtctcatgacagcaacatantatagacactgcanctagtcatactactactctctgatcgtcanaccgactcgctgtgttattgcttactaatacngcttcagctgcgcatcgacagcacncacactnctcgccntcactcganacgacgcggtccntgtcgctttgatcttatgacatcagtcgagcggagtcgcactcgcaaatcgtcatggacgagaatgggccgctgatgctcacacgcncgtgtccgttctcactagtcacacgtatcggcgtacgtatgtacgngcgctgatgtatcgtcgctgtctcgtacgcgcgcgcgcctcgcgacgacgcattcagtatcgcgtcgagtgcgtgtggatcggtggcatcggctaacagtacgatacggtggtgcacgntccntattatacgtagtcatagaaggatctgaacgtcgctgcacctccnacactgcantctgtgtgtagtgtcatgtancgacactgacgtcgtcgctacgtgcgtcagagtatccactgacatcatcactgctgtacctgatctcatcgcgtagtatagcgataccggcgcgancgtatacgcgcgagcactcgngtgcanagtcgtcgcgcagcttanatatgatcgcgngtngtctctatcgtacagtaccgtgtcacnaacgtacnctgctagtgtgtgtgccctgcgcntggagtntcactgcancgtggncgaatcgaccgnagtncgcngactgatagtcatcatactactcatcacgctgggtcntacgtcgcgtactatacagagacgtagcgagtgtggtcactggctaagcgcatcgtcanattgtcatgatatccgtcacttgatgtgatatntcgcatacgatcgacacgtcntcgccctcgcatgcgtancantccgatatgttcataacgatcgtaacgtgacactctncgtntntgcctgagattagnctctgcgacgtctcacgcatcatacgntgtgaacaggcgtgctactgcgtgagctatgtactagaagtcatgnagcncacntcgcagcgtgtgtgcacagcgtctcgtcagtagctgccgcgtctngnatcgagcgcngtcactgtcgctgtacgtcgacagtcccgatcgcntcgcngccngtgcacntatctngattatgcgacgatcgctctgcagctcgtcgtgtgctcgtcgctnacgtatagtcagctgatcncntcnagcagactgcagcgcatctactattcagagctgcgacgactaagcagtntactatacagntcgtcacgagantngatgactattagctnagangcgtgcacctacacactgaccgccgtgntgtantgnacagccgngngtcaagcncgtcgcntcgtgtcgtcgnccgcaaccatcgcgagtagngtntgatgacgtgntgntcagntcgtnatcacgtcgacncgtatgntgacgnatcgngtcacgccagcgtcagctgntctcactagtnntcagcgtcgnatgttggtgagtcacgnactgatacgctgacgancgg

SEQ ID NO: 19470 - DNA, 840 bp, Homo sapiens
ccgccctcctcccgtaaaaccctcgcaatactacagccaaccccaatttctccttcccagcgatacaaggcgcgcgtcgaacctcaagcactcgcccgcattctgcgtaagaaaatatcccgcaacgccagctattttcaatacaagcccggcccacaacacccacgcaagcggcgggatcacacggcttcgggtgtccacatggcgctccacaaggtcggaccaattcggccgatgttccaccacccacgcagtactccatactaaaaactgtgcaatgagttcaccaatgtgttggaaacccccaaactcaaatgcagctctgctcgggcgaaagtgttcctatttctcaggccacgttatcctagaagaggaagaaaatgcttagttgaaagaaaagattgaggaatccaagggagctccttttcctttccctcaagagagtgatccagcttactcagcccaggatgaatgtttaagaagaattagatgcacttaaagtaaatatatctattgataaggcagcaatccaagaattgaatagatgtgtggcagagagaagagaagaccagttctttagatctggtgaagaccccccccctcaagaggagtactccagagaagaatggaaaagaaatgttggagcagacattacagaaggtcattgagttggaaaatcggctgaaatgttttgagaaaaggtcgagaaaattaaaagaagggaataaaaaattaatgaaagaaaatgaccctctccccatcccttcttaaaacagctaacaagtagatacagagaccagagaaaaagagttagatcagataataaaaggggatgcggca

SEQ ID NO: 19471 - DNA, 1833 bp, Homo sapiens
  misc_feature (1)...(1833): n = A,T,C or G
agcaacgtgagaactaacccgtcgtgaantannnnnnnntttttacaaccnngcnnacnnnancagccacagggttttttgacgcgacaaggaataaggcccgcgtgcataaatatcgtcanacccctgtggcatgtctgtgtctgactacgggtgtatactcttggagngcctgcgcgcctcatcacatacccacgtctggaatttatagcgcgaggcgctctgtttggagtgtcttcccgcccagcacattaaagagagggatcctccccacacaccacaaccgcgtggtatataaataccactgaagactttctttggtggtatcatctataacactcgccgcgtccgtaggcgcagaatatattatactataaatgaagaacactgcggtgtgttcagagccgtcgtctcgtgcgtnatctgttggtgatgagagataatcgcgcgagagcttattgtcgctgctcgccgcgtccatcttcagaggttgtccgatagtgtttcattattcataccgtgcgcggctgcgccgagatgtggcgtggggatgtgctcagtctgcgccnactcactacgcttgttatccatctttgtgcgagaagggttacgaattactttctcacttccaatagtgtacccaccccacgcaacacatacaacaagntgcgtgcagtggttatattccttcttagtgtgtatatatacacagtgtcnttctggttcacgacgctcggttatgagtgttcgaagtataagatctcgcctcactctgcgatgtcttcaacctatactanagacatcgtctctcgagctggagctggacatatatgtgcatctcnctcgcctgcgtgtgtttccgcactccctcaantggtgtagagtgtgtagtgntatattctcctcatatcttctagcntcncgcgcnagctagacactcatgctgtgttgtcgtgtatgctcgtctagtttatcccacgcgagcgtgatatcatgcgcacgatacacggntagcgtactatgtactgcttcaatacantatcacgctatagcgctggtagggacgtgnagtgtgtcagtcgntacgtgctgtctctactctctnctaccagngatatacactctcagtgatatgcatgatatcncancnctaacntgcnacgctacacntgcgacgttcgcgcgtcngngtgatggtgctctcgtgtttgtatgtcacgctctgtggngtctngtctctantcgtgcatcaccagatgnagatcacancagctcgatgataaccacacacagtaccgctcancagtgntgcgtgatcagtgtgtcagctcgctganagcgtgtattaccggtcgtagtagcgatagtatttacgactanacagcaganactcaagtatcactgntnttagcgacgncgtccacatcagcatacgcatccgtaggcacgatacttgatgtcatcttcgtcaggtnagtaaaactcgacntgagngcgatgtnatctctncaactaacgtaacantaagtctatgatcgaatgaaactcatcacagtctcgtatcgtactggattgagtttacntcctgtctcaccngtattcactcttgatgtgtctgtacatgctctnacncgcacnctatntgctagtcctcaacgtatcgcgacgcacacanctgcgtagtcancgtccatatttcnnacatgtcgtgtgnctatgtntgcaatcagcactncactacagctcgtcatctcgtcantacatatactatttcagntcgatcngcgattagtgcngtcgcttgatgtatgactgcatactgatatctcatcg

SEQ ID NO: 19472 - DNA, 998 bp, Homo sapiens
  misc_feature (1)...(998): n = A,T,C or G
ggataagtatttgggtnnnnntntcannnngnnattcccggtttgcccaaggaacggggaaaagacccctggtgttggtttttgtgacccaagggaacggcataaagacaatggttccccaccccctcttcgagcccaccctaaccaaagggagactccccaccgcgccggggtcttatacacagcgggggatgtttttgtataggtgtttacgagagaggtgctctttaaacataatgcgaggctcgactccgccgcgccggcgtngttgtcgcctggggtgatgatgagaaccccacttcgagagggggcattttttttccggggcggagggaagcagcaatgaccgaaaaaacaccctgataaaaatggctccagaatatattcacgtgttattatacccccccctcatgtcgtgtgagggatagtataatggcgtttcttgcatgaaacatcacgtccaacgaaccagactatttccgggcaaccgcccataaaggagcacttcgcgtggcgagtatttaaaaacatgtaatacgacaagcgtcacaaaagatgatcaacatatctcgcaccgcatcaatttgttctctcagccaacgtcttaactagatctaccacgcgtgaagtctgagccacatttgtgagaatccattcattcactgacaggtggtgaaggaacaagcaaagtgacagctatctattaaacacctcattcagattgaccctaacactagataatctaatccggtgcatgtaaccgaacggtgctttcaatggcccagtttattataaccaactatcacatccgtgaggtatattggggattgaacatagaccacgacatttcgcgcaatacttattacagcacgtattgctcctgcatcgtcaacaagcacccccggtgtgattttttttatatgcaacactagagtggtaatttgacccagcaaaaccagtacaagttagatgaagcatatcgactacttgcggtaaaa

SEQ ID NO: 19473 - DNA, 1926 bp, Homo sapiens
  misc_feature (1)...(1926): n = A,T,C or G
agaggaagacggacaccagcagcgacgccancgccagacacagcagaaagcgcggcggagggcgagagaggaagnaggagangagggagcgctacaggcgnaggacgagaacagnacaggcgagagcggaagaccccctacacgagcgcggagcgagacnaggacanacagacngcggagagacgangcacgagaggagagcagnacgagangagaagcgaacagccanaggcgggaganagcaacagcgnaacgcagagcacacacnaccgcgacaagcaccagacacgacggacnagcgagacgcganacgnananagaggagacggncgcgcgcggncgcggagagcacaacgcggngcggccaagcggagcacgcgacaacancgcacaggaggaacacgcgagaagcggaagagcacgacacgacgcagcgcgcgaggggcgngagggacggcgcggnggaaggaccagngaggaagacggccgaggcagagagaagcgcacacagggaccgaanagcaggcagcgcgagngaaggggaangacgcgagacncacgagcacaaggagcancacgcgcaacgcgcagacaagagcgcggacagcgtacactctctaggaggagagaggagncacncacacgcagcgaggaccnagagcgacacaanagngcgagagagacacaggagangccgcagtggncgcgangncagcacgaagagacccggcgtccgagccagaaggacagaccatcgaaggcaggacgagcgancacagananagacacagcgcgcgagagcngtcngngcgcaggcggcacgaggagaggcgtgngagcgaacgcgacagcgaatacancgacaccacgcaagctgccgcgcgcggtgagaccgacgacacaagagacaccgcgtgagaggagagaggcgagacagaacagacgtaatacagacaagcgaggcaggagcatagagaagaganacgaacgcaggagccaccgcgcgcaagagacggagaagacacgngnagtaaagacacgcgacacggcacagcaacagagagangcaacgancagcgcggnacggagccggcagacacgcacaccgcgagagacgagagagcggacnccgcgngcaggtgcgcgagagcagagagcgcgcganacggcgcggccgtgcangagcatgacgacggcggcgagangataacgnagatgggagnngagaggnanagcgangagcatactgaacgagngngcggcagacagncagcgacgcggaagcgagcgcaccagacggacagtgcacganacgacaagaggatcgacgcagagccggcgcagctgncagcggcgacagcgcgcagcaagagcgcgcanatgagacgcgtagcgagncagtacgcgganangaanacggacgacgagcgccaacgatagcagacgacgccgacacggcgagagaancgcgcgcgggcaacagcgcacgagcgcgcatacgccnctaagcgcgaaganaggagagagcgcgagctgcagcgagagacgtcgagtggagagagacgagagncagcgcggtgagggatganacgtgcgcgaaggngacgtagcgagcgtagtatgcaaggacagtcacgcgagagcaagcgaggcgcgagaggctgaggacagtgantcaggacagcgcgngcagcgcgagagacacggcgacggancgagcgcntgcgagaganaggagagagacgcctgcggctcgacgcgacgcaggagacacgncgaccgncgagtcgagacngagcgagccagcggaagcgnatagagagagganacggacggagcgccgcggcgcacgcgtatagagacacgcagangacagcgacgaggacgcaagcagacggcgacngagcgagcacgcgagggagcagg

SEQ ID NO: 19474 - DNA, 856 bp, Homo sapiens
  misc_feature (1)...(856): n = A,T,C or G
cgcaaacatctcacaaattgtttatttatgcgttttgaagtatccgatggggaaattcgggaatattattcctaaaagggggttatagtttaattgttaggcagtgggtgtgtttattcacaggttttggcgcttatgggggggtggtttttatatttaatagcgcgactagttgcctagatccccgtcggtgtaaaaactttacttgggaagggtttccatttggcccaaaggtggaaataattccggtaaggcgaaggtttcgcgggtttgggtttattagaaattaacaagcaaacctgaaggggcgagggccagaagggttcctgtaactttatcgggctccattaagtttatttaatgttttcggggaagttagattaattaatggaagaagaaagttgctttaatgagcctaaagaaaggggcatttagagaggaaccccatgaggagactttctgccaccaaccagcagatttgccagccatgtgagtgagccacnttggaagtcttgaaaatgactgaagtcctgtctgacatttcaatgaaccctcttgagaccctgggccanaattgcncagttaaagtattctnaaactccngannngcacacactgtgagacagaaatgttattgagttttaagctattgaattttgacgtaatttgttttggagcagtagacaactagtacagtattattttaacaaggagaatccatccaatgtgcacaggatactacccccaatgaatttttttataacaaaagaatgcatttattaagtcataccttaagtgcaaatcccaaaggaagaaagaacagtcttttcggtaaataaagagcgaatgcggccag

SEQ ID NO: 19475 - DNA, 1494 bp, Homo sapiens
  misc_feature (1)...(1494): n = A,T,C or G
atgcatgtcggaagtagtgatagatctactgatngtggngtaagcttcgttgtaaggtgaatgaacgactttcgtttgaantatctgctcatatgattggacaacgacgaatanngacgntctcacgnagcagtagaccgcggcacgtanggagtactcatatcgctgngagaggcgaggtgagacacgtagagctgtgacgnggagngtgcgatggtgaaagcagacgcgcggcagcatagggcgagacagattctgagtggnnaacnagcgactcgggatgtcgcgacgtcactagagnagtcacgcgcgagagcatgggtngngtgtgctacgnntaacatgngtgtgcactctgtgtcgcgcaattgtnggtgtgtgtgtctgcgacgaggnggagctggacgatggtcataatagacgtcgactcgtgtgngantactagacatgtctgctactcagtgatgagatagtagtgaaaatgaganagtggatatgtgttcagcgtgngcgctgatcgctcgattgctacgacactattgggtcagatggnggaagcgaatgtagcnagaggnactacgtagcagtggagaacggtgtcaggtaagaanagtgagtagagataggtgggagatagagagagggatgngagagagggagtatgtgacggagagtacgccgcagtggaggcagaccgagggtaggacgatagcagcatagtgtgagtacacgagagtngntgggtgcgcgcgtggagttgcgcgatggcngcggcgacatgtgtgcgcaggtnnnaacgcngagtacatacgacaatgtgaggcgcgattagagtgtaggcantgtacgnntcagaccactcgaacactcttctctgcgctntatctctcttctcgctaancnccgngtgacatccatctcatgtcgatgcaactatacgagacganaaaatacgaacgacaagacntagagctcgccaacagaactcacgatcgcaatanccttctctccattnnacctatngatcagtgtagtttncaactattgacgctctacctactgtctntnnntctantannctctctcactacactcttnaaagtgtaatgtttctgtctgatcgacnatgctacgtcacttgagcttangntaactaacgtcantttattatnttaanagcacacgatgaataacatacacgagtcacaaacgtagcgacaacgacggaatacncnaccacgcacctatatagaaatgttnctatctatctacacatacanaactgtcatctgcattctacatgtcnattacacttatacgtaactnnaatactccacacagntacagcaatagcacacagattacttttacaagattnaattnnaacnanacnncaatcnnnnccaaatctactnnncnnntccctcattacannnacccnncntacactatncactttttnntnccatcttnactcttnnnnnccccctcttt

SEQ ID NO: 19476 - DNA, 812 bp, Homo sapiens
cgtacatagcaggactgcctctcctagcatcccttgcagctaggtgaagtcatgtgactgcattctggccaatgaagatagcacagccaccagatgagagaagcctgatccctaactaatcgtgtggagctgagtggaggggatcaaaaacgatgaccctgggctgtgatacagccctgcgagactggccttgaaaaaaataaaagcgcgcgacaatcattgtttgagattgaaatgatgaaaatgagcccaatcaagacactgatctgtagacgaggctcctgtaacacatgtgcacattcgattcatcgtggggaggtttgcaaggtgcgaactcataagctgtaattgaacttcttaaaagggaggttcaagcggcgtttgaattcagatttcagtatatttcgaagtcctgtaagagtctccttttcgggggttgtgttcagcaccttttatgtgtgaggcatcgaattttggaatgtatggccagtgtgtattttacgcgttaaacaaagttttggggtcccactttttgttggccgcttatatgttataattcgagaacccggatgtgcgtgattatggtagacggcccactacttattcgttaagaatattgaacgcgaaacatttgcggcgaagaggccgtaagctgcatatattatccgcccgaatggtgcccgtttaaccccattatgtacgtattactgacccagtacatttacgttttagcgttgttctatgggaggccgaacagatagagcccacccataataattgattcaggagagctacaaacatgagtatagttg

SEQ ID NO: 19477 - DNA, 911 bp, Homo sapiens
  misc_feature (1)...(911): n = A,T,C or G
ccacacccctcttttccccccatttattttttctgttttaccccctccccccaccacacgtataagaggagcccaattaggcctcttaagagaggtgttccatccctcccccctgttgtcacgttattatccccacctttatatttcttgaaaatacagcatcgtccgcaacacggcccgggggtgtcaccccatagccatccccctcttttgtttaaccggtatttcctgtattggtgtcagcccccgatgttttaacattgcacagtttgaacgtttatctgcacagtggggtgaatgcagcccataaataagtgcggttctcaaaatggcaaaaagaacaccgaggaaaaggggtcattgaaaaagcgaagggttttaatggacttccagttcaacccccatgtagtaggctcaggtatcttacaatcatacctgtcggtaaaggtgaagcaaggcacttttttcacaaggtggcagaatggtaacatcaccgcgaaagcagtttccaacagcttacaaaaccatcagatttcttgagaactccctcactatcatgaggacagcatgggggaaactgcccccatgatccaatcacctccacctggtctctctctctcgacacgtgtggattatgggaattataattcaagataagatttgggtggagacacaaagcctaaccatattaataatgtattgcatacttgaaatttgttcttactatacctacgaaaaaaggtaactgtgaggtgactgacatgttaattcattcgattgtggaaggtatttcacaatgtatatcaaaacatataccttgaaattataggatttttatttatcagttataacccaataaagctttancgacaggtttccccccctcctttttgttttgtcccctgtctctg

SEQ ID NO: 19478 - DNA, 1927 bp, Homo sapiens
  misc_feature (1)...(1927): n = A,T,C or G
gtagtcgctantactgtgtgtaagctcatcacatactgagacgancacactacatatncaatatcacgatgagcgatgngtcgtcgcaggcatcgntcaagcgacgnagctactgagcgacgctgtcgctgcagcggncgtcatcgtagcntgcactgactatacaacgcgtngntatanagcagntnattcacagangacgcgcgcgacgccgagtccgacngnactcacgatagtgaaaactacatatagctganaacttcgtcgncancagactcaacacgtccgtcgctgatctgagtcgcgancttcatcnatatcgtgcagcgtgtgctactatgactcgttanccgcgacgtcgtcatggcgtgatngcgtcatagtagagctggcagcgaccagcactcgctgcgctagctcgacnttgcgcgcgtgcacacactgncacgtctccgacgncactgacgtcacactgcngntacgcgacacgantganacnacngcacagcngaacagctacactacacgcatagactattcctactatgcatcgttagctgnccncggcgactnacctacgtctgcatagcntangngtcgncgtacgctacagcangacgagacagtacagacacatcgtanatgcnatnananagtaatactctatcgacgcagcaagtcgcatcagctcggtagtacacagcgatcacgncagngtactgantatatcacacnacnctantacacctcacgcactacagcagtgtacgatcgctgactgacggcangtcgagtgtcgcgtgncggtagcgcgcgcnaagcgcactctatctctagacncncgcatccgacatcacacanagcacangtctaaaacganancacgcgcgcnctcgcgtcgagtcgncacgncncctcgtcctcgatgcgcggcacgacatcacnacacatgcgacgcgcacactcgccgagcaagacgcgggcactgcgacgcgcgtggcggagaagcgaagcgataagattcacagcatcgtataactaagantgacacagagacgcgtatgcactaganagcgacgaccgagcacaccgatngaagacgcgtaangacgtcgacaacggatcaccgaccatncgtattagtactatacatatcacatacggantataaaacaaataacaacatatactctgcgaaatcgtactcangatactacctcacgcatcaaccacacctcccacgtacgcccactcctctgcctcaccaactgcggtggcgacgcacgcgccgagcgcaacgcacacacgtgcgccgcatnatgtgnagtaggatgtgagcactngatgcgtgattgtgatgttatgtgtgttgctgngcgacgcgtcagactgacgtgtgagtgatcacgcggcatatcagcagagagatgaaaacagacgagtcgagtctgcgagcagcgggactgatcgcgcantctattgcgcaangacgtcgcgcatggtttgtgagtagcgcgtccgntctttgatggcgatnttgangaagnagaaatctgggagccagagcgncgcttgcgcgtaaactgngnggnnagcgctgangacgcanatcactgtactgctcacgcgatcagcgcgatagcacagacgcgaacgcncgcacatcgnggacncacgtactctatcgtgngtggaccgngccgggtggcttgtggtgcgtgctgnngatgtgctttctcgtctcgtggtcctcctaacaaccctccttcttctnctcttggtcctctctntctnttttaaggcgtctctttcttctctcttctttcgtaactaagtgtctccatanaatctgttatagtatnatatcaatangnaatntatnacttnnnnnctctntctgtgcncccacnatacacacaaccagcaa

SEQ ID NO: 19479 - DNA, 1614 bp, Homo sapiens
  misc_feature (1)...(1614): n = A,T,C or G
gtatgatcatctgcttnaatgtatgctgaaagatgcgacgacgacttctgttagcgtcgacagtttcggtttccagtatagcgcactcgtacacacgtagctcacgtccggtgtagtcggtactcgtacgctctgctgtagtatatagagtgacatgatctcgatgtacaaagcacgtgagtgcgaggcacggaagcagnttgtctacgtgagcgtctcgcangatagtcgtgttagtcntgcgatacactgttgattatcgataacaatgtgagcnatcntagtatgcggcggagagcgtgctcacgcactcgtctacgagcnatgcgttaacatagttaaggaacgaggttattgagtagagatatggtcgtgagctgtgtctgntagcgtagaganatacggtctgacggatacatacacaagtgtctcatactgcgatctgtcgcgtagcgtcgcaatgtanctagtcgtgagtcgagtgagtcagatccgagcccatcgtcagtcgatttatgaatgaagatatgaagtctgcgaattgttctcantatacacatcgacgagncagctcagactatagacacagaacacttctgattatgatcagcatgtatccgctgacaaccgctcgtcgtcagcagagggatatgcggctgcggcaccgcgatagtggtccagatgatgtgtgttcgcactgtaggcgagatgtaatatgacagtatttattnatctgatcatacaagcatgtgtattactagtacgatgtacgaatactntgctctatagtcctgcgacaaacgtagtggtacgtgcgatgtagtgngcgggtagaaagantggtgtgcagagagcatgtagtagtcacctcaacctccgagatgtcgtactcctgcgtgttgtcccacaccggcgagctgtgcggacgcgatgaggacttgacgtgtgtatgctgtgttgttatagtcaccgagaatgcatgtatagtgacgcactcttcgatgtatgtgagacgcgagagtgatgacgtctccttctctagagtacaatcgncgcgaaagaagaggacgagtgtggaggcagacgatcacactaggcttataagcacacgcgcataccatgcgtatgccctgcgtgcttgacatacttgcgcacgatcgtatgcatcagctagactgaagagatcgacctgttcgcgcctacatgcntacaacgtnagagacgcgcccagtcgacgtnatgctcactcgagacgcgcggctatgttcgacagtacctagatagtgagcgtnagttgtatgttgaatcacgtgtgagctaattgagagaacgtaggtgtgtatagtatagtcatacaacaatgtgaattatgttctcgatgaatattcctcatatacatggcagatantcgtctcgctccagtatgtgtactcatggcagcataagtcagccgtcatactccgcgcatcgcgctagnatacatctgtgtatctcnagttctgagcgatacagctggcgaggtgtggctngacgcgagagagaaatggcagcgataaggaggcggcaactagtgcatgagtatcgctataatgtgtgtgctgcgctcgatatgnt

SEQ ID NO: 19480 - DNA, 1038 bp, Homo sapiens
  misc_feature (1)...(1038): n = A,T,C or G
ccccgactcgacacgcacgcgcagtgctgggatcaaacgggcacgacaacacgtctcaactggcgccgcccgccggcccaagcgcgcgccgtnctactactcagaccgccccgtccgcgcgcatctaccacccagcccgcgggagcgacaccgagctcgatgtcgcaccacggcgcccacgcgcagcgtcatacganaagagaccagcgggcaccacgaatccagcaaacgcacactcaggcccacgcagagacaacaagctccgccacatctttcgtacgcatcaccacagataaataacacacacaaccacaccgtggagaattttacgctcgcgcggcgccaaacagacgagaagaaacgaccagagccgacgcgatcaagaaacactcgggagagaagagcacggaaatcaacacaggagatacatgatggagaagcacccccgcgtggggcgttggaggaaagaaagaggaaaagagagacgacagaagggggttgttcgcgggccacacaccccccccccctttttatcaacaaagtcgttctaagaggagcaacgaaagccccaaaccggggcgtggtgtggggaggggggcaaaacacccccggtgggcgcttaaaagggaacaaagagaatatagattaatttctttcccgcaactcagagcacgaaaatggaggtaacaacgtgagaaaaaaaagagggtttgaaggagtttcagaatagaattccccccccctcccagttaataaacgcgttcaagggaaagggggagagaaagagttcgccgcctaccgagttgggcatgtccatgaaaggttaaattcctctccgggagcagtaacagcctcaggcaacttaaagtgataccagttatttgattttttaaaaaatattattccacaaagaaaaccattttaggtcatctcccccaactctgttgcttactgcttaataaatataaaaataaacagcgatgcggccagaataaatagaaccggaggataaaaaagcggatcaagagaaagcagtgg

SEQ ID NO: 19481 - DNA, 832 bp, Homo sapiens
aaagcacaaggcggctgaaggggtattccccccaaatatttttgtttggatggctccttgagaagccggtgcatcatcccaccaaaagctgtcccatttagtaagccaggatccagtgctcaaggtgcgagtgggataactgaaaccaaaaaaacattgataagttgaacctttaacctagttttaaaaaaattgttaaccaggcattgcagaaacaataatttggtaagcaaggctttcatttgcaagacctttcaaagagaaaaaggatatgcatgacttaaatagcccaaacttgaagtacagagtctttggtataagccagtacttctgaaggtatactctgtggccctcgggatactggcatcaaatgccctcgtagtcattgtattcttcatcaccaaggaattacgttttttttaaaaaaatagcttcagaatgtccttgctgaagcagtaaaaaattaattttattaaattttgatccttgagcgcacatatttttcaatattctgcgtggtgaaatgggaaatatatagagagcacttctgctatgtacaaaagttccgtagttgaacacctgtatggcaatacactaggtaacttagataaaatgaaaaatttctagaaagacccaaactacctgaactgattcaagaaagaccaaaaaatccgaatagacttataacatgtaaagcgattcaaattgtaataccaacattcccatgaaggaaagcccaggaccaggtgacttcactggtaaatgctgtcaaatatttatgtaattaataccaattattcacaaactccaccaataaataacgatcggccag

SEQ ID NO: 19482 - DNA, 1640 bp, Homo sapiens
  misc_feature (1)...(1640): n = A,T,C or G
tgatgattgtgatcggattgtatgatgngtgtcgtcttananctactgatagtctacataattatgagtagatgttgatgagcgtctaccgagtagttttctgcgtcaggtaggagagaacagagcagngacagtcagcgacaacgtgctgatagcnatatgtagcggcatcctacgttccttgttgtagcgtcgcctctgagagtggtagcaatggacgacnatatacatcatatattactgctagtgatatanttgtacgaccgatgtcgcactcgacacgtgtgctgactantcataatcaatatacaccataaagactgagaacatgacgagccgaancatatcgaggcgcgagagaaataacgagaggaagataggaggtgtagaatacgacatgtctgcactcaagataaagatataatactantaatgtttacagaacatctgttgttgtgtcgtggtgtgccaccgcactgcgtncgtgctgctagaagaagcgacgcactaacttgcgccgcggaccccatgagtatgactatagcgcgcgagagacgttgttgacgctaccnacgctaggatggcgtgagacgacttagaantgtaacttgatatcgctcggtgcaagactcctcagatacattgttntaatgagacatactgtaccatctggcgagcatcgtgcatcgtatgtgtgagtcgtagagagttggacgtnctacgctcgcgcttcgtaactgctcgnacatgtgctctagctcgtcttactangaactgttcgtgtgatgcgatatgtcttagtatcgtagtncgtactgttacaaagtcagatatgnttgtatgaacntcttgtatcgtganctgacatgagtacacacaagtgtagnctgtacattgcgtgtgctcgtgcgcgtcgaganctgtctgaggcagatgatcttatgcttagatgataccttactcatatacgtgttcgcacattctgtggttacatcccttacactgtcacgttctggcggcgctctattgtaagattatgatatcgcgccgaatgatgacgtacggagtgcagatcncgtacgtgactgtcgctgtcacacgtcaacgctcgtacagacgatcgtgcataagagctaggganattacaagcatagagcgagtaaaatgtgtcatgtactttctgttcttcgtcatctctacgctaccgtattgcantacatattatgttgataatgaggacgatgtttgtagtagtatgatgtcgatatggtacacggattccgtgatgctaggtttgcgacgtagtagtgtattnctcgcggcggcgtggaatagatgtcgcgcgtgtgcgttgcattgtagtgtacgcctacatatcctcattgtnatcctcactccgtctgcactaaccgtcgtatgntatgtagtacactgaccaatcgcnagtaagagatctatttcgcgctctgacgtgtgtgttctatgccgaagtttaactgtcgacatcgtcacacacccgattgacaacgcgtgacnattgtgtgctacgatgtgctctgtactttgttatcagagaagtagcgccgagtagtttccactacatagntnaggtcgctgaatttataatattccacgtacag

SEQ ID NO: 19483 - DNA, 485 bp, Homo sapiens
cgactcccagttttcccaattaattgtcaattgcatctccccccacctctagtgaagcagccccctgctcatcggagtccggagcaaatacaagctctccacagaacagatccctatcttatacaggacgtgtaagtttctcaagaagtaccggaacagcacagctgctggtgtcgcaggactcggcagctgctctggcacagtcagctcccctctgaggcaaggaaaccccactctgagccagacccaacaggcgcacagctccaggtctaaaaggtttttgtgcaactgagacttggctccattttttttaagctttttatcatggacatgaatttatcatgattctgaatattgccaaacatacacacaagtgcccttgcctaccggcataaaatcataataattcacttcccattcttaaacttttaatataccgccacacccccccctacatctaatcttactcccccactcttctcacc

SEQ ID NO: 19484 - DNA, 996 bp, Homo sapiens
  misc_feature (1)...(996): n = A,T,C or G
acgtggcacccactccgcccggtccgcgccacggggcgcgcgcactctcgtgtcagataatgtcggggtggggcggcgtataaagaataaacgtgaacgtatctcggagttacatgctcccgccgtcgcagtgctctgtacacgctggccctcctctgcgctgcgctcacccgtccactctcacacaggcgccacacttcataccnccctccttacgcccccctcccccccatcccgacactcatgggacgtctctcgcccaaccggctttaagcggcgcatccccgcaggccctcccggagcgcgcgtcccccttcttacgccgcggcgcgtccatcgacggttttcgttccatctctcgcacgtgtgttgtggcgtacggcccccctgccggcgctcgttcctccctctccccccgctaacataactagaggaacacccccgcgtgtatcgattcaatccccgcatgcacacacttctccgccgggagcaggggggcccccccctggttgtcaccaacagccacgggggtaaagaccgttctcatttttacttctcacgcggtcgcgattgcctggcacctcgcgaagccaacccagaacctgttttaaacgtgctctcttatgtccacaatggggcccaaccggcgccacctgcgcccctgattttcattaagggcgcctcgccgtatacaccccgccacatggtctaccccattctcaatcccaaagacattaaatttctatgcccaatttttggacagaaggctaagagagttcttctatgctgatagtcagatgaggtaggcttagcatgaatttggcctggaaccaactcctgctacttgaagcttttttccactgaggccaccccccatctgagaatcgactcagcctgagaggaccgactcactagtattttacttaataattttaacaaaaccccagatgcgcccgcctcgcgctcttctcgccgtcccctcgcccctctcccgtc

SEQ ID NO: 19485 - DNA, 1217 bp, Homo sapiens
  misc_feature (1)...(1217): n = A,T,C or G
cacccacatcgaaaaacacccgtaaagcgaggaacagagatatcacacagccaaatactatcaacagtcaggaaccaacccacaataaaccgaatctacaataatgcgagacgcgaaaacatccacgacacgggcgtgagagatcgacagtaccaaacgagagggacaagtggagggagagagggctgcaccagcggcggaaatggacggagaggaaagacaggacgaaggagacgaggatggatacatgacactcaccgcacacaaggatcaccaactgacaggtaatcgaacataaaatgtgctcgacccacagaccaaacacacaactataataagaatccccagctgcgatacgacgggcataggatgagaatacaaaccatagacagggagagggacgacagcgccgggcgtcatagcacgagccacgaaccagtggaatcaacacgatcaacaatactgaccacatcataccggcaaacgccgcaacaccgccatcatggttgtgagagaagacgacggcaagcggagagaggagggtcagccggcgcggcccagtccccgcgtcgtgccgcaccgcattgagcgtgcgaacagggaagtgtagacgcaccacaacagcaacttaccgcaggtgcangatggcanacacataaaacaaaaacaaacgacgtccgnccggtcgccgctcgccctgacccccgccctcccgcctggcgtccgtccgtctctctccgccgcctgccccggtgngnccgcggcgtgccgcgcggtggcgggggtgcgccgggggcgcgggcggtctggttcccgtggcggtgggctcgtgtctgggggcgcgcgcccggccgcgngccgtggggggcggggtggtggggctcccggggctcctccgcgctttnngtccccgccgcccgcgcgccgcgcgccagccgggccgcgcgggccgcccggcgcgcgcggccgtggacttgtggccgccgcgcccgtctgggcccctgtttcgcgtgcgggggggctgttcgntnggnggccgcgtcgccgtccggcggccgcggggggggggccgccgcccccgcccgaaaccccgcttcctttcttggtcctcttttcctaaagcttttttttttgtcgtctcatctaacaccacagcgactccnctaacacgatacactntccatgnncnnaacaccannngccnnccctctccaccc

SEQ ID NO: 19486 - DNA, 1199 bp, Homo sapiens
  misc_feature (1)...(1199): n = A,T,C or G
atataaataccgccggtatcatcatgtattacacgcggcggattatgttgcgggaccccgcccctaatctatctacgcgcgaattcgatgaccgtaatcgtttaagcgccgttctgttgtgtttagacgcccgttcttacttttggggccgcgcgtgcccactatcatatattcgtatgcatccgccgattatagtgtatcgtagcgtgatctgtagccgataatgcaatacgcgcgatttgggtctcgcacatgttgagtaccgaaagatgtttatatttttaccaccgcgtcattgtccgtattgataatagaaacaagtacaggcacgcacgtctgtcgtacataaattcgattcccgccgttgtctttaggcggagctagcgcccgcctcgttttagttaaccgcacgcgataattgttaatggagtcgcaagaaatcacgtctacagagttgtattatttacgtgatataattattgtcatcccacgcatttgtccactaatgcgttagtatgctacagccgtttatatcgacggacgcgtaatacgtcgactcgccccgatctgaagaatatggtaatgactgtcggcacgtagctaaccgcacggtttccctaatgttcataacatttaggattatttccaaacacatatgcgtgaaggaaccgcgagccccgtttggctgtatctatcctctacgggtacctaatattttgcctccgggacgtgtacaccactcatgcacacgacggaaagcaacgtagcatgttcacgtatatatgccgccacgtccgtagagttagtgatacggttagaccccagattatgattcgcccgcctcttaattgatatcgccttccgatccgctccgcgccgctatctacactatcgattgantgcacccacacccatgataggtcaaattatcgcgtagttgacaccgccacacccaatagtcaatcacagagcggcggtcggcgtacacatcatatagtaccgcacccgtctgttacaccctccttttagcacgccctatatatatccgcacttgtgtctcaccacgagaagatatagcgacaagagagtggcagttacagaatgcacgcagaatcttcacctcaatagtntcagccgtgtgcatattggtctttgcatacagagccatccggatcttagtgctagtaagtatatagtcg

SEQ ID NO: 19487 - DNA, 1935 bp, Homo sapiens
  misc_feature (1)...(1935): n = A,T,C or G
gaggagagacagacggctcgagcgaacagaggcgcagcgagaacagagacgagcgccgcagacgcgnccgagacganacanngaggaaagagcacggcccccttgcantangnagaagnnaggaacannagcnggngangagcagaagagngcccccttttganagagagcggncagacacngaaaccgnganagagngcngcacnagcgagagagagagcaccgaagaagccacaganagagagagaagacagaganggagatatnnaacnagacagacgaacacgcgcgagcagcagaancatcacnacgccagcagggcaacagcagatcacgcaagacnaccccacggcgcgccgccgcgcgncgcagggagccagcgaagacgcgcacgcgaacgcagcgccgaggagagncgacacgacaaagagagcacacacgaacgcnacangacgaggngcggacgacaacgcgacagcgcgcacgcgcagaccacagcaagcgacgcgagcgcanaagcaaccgagcagngcacgcaganaacacagcgacagacgcgcgcgcacggcagcaacgcgcagatcacacgtataaatagcacacgcacggtacagataccacagacggcagcnacactgagcgagngagtcngcagcgnagagagacacgacacgacagcgagctanagcgacgcacctgnacgcgagagccatcagcaggacgcgnacgagcgacatgagcgcagagacgcncactcgacagctngcgacgagcgngccgacgactagcagcagcagcacagtnaatcacacgccagccgcgcagacaaccgacatcgttcagtgcngactcagagcggcgcaagntagaatcatatggcgaagatattagacgacagctacgcagccagcgcgcgccgcgcgcatccagctcgatcgagacnctcgcganagatantgaatcagcgcggatgatnaaagcacgacgcggacaccgccgcgagtangnatacgatagacacacacatatcacccgncggcgagaccggngagaatgacagacangatatgagcacgcgcatgctgtcggancaacgacaacaacagcaccgagacggcgaggcgcgacggaagcgcggcgcagcgagagagagcagatacacagcgcagcagaacgcagtgacacgagtacgcgcgagacgcgacgctgcgctgcacgcngaaagcgagcccngtatncacgcgagatcgacgccgcgaacncgcgaccgccagacgggcggacagtagaacgacancagacgcgactcgccaccnactgacgagacgagatcatcacagcgcactcangcctcgcgacgcctacagagncagcagcaagcatgngacgacgccagcgctgcaacgcgcgaccagagcagaacgcatcacgacaagcgacgcaacgacnacgaagaacacgaccagacagacgaatcacagagcagntcggccgcggncgtacgagtgcacagacacacgacagcgcgaagacagtgagccgcgcgncagcgaagcgacgcgagggcagcggagacacgacgcgcgcgaagagacatagcacgagagcactagtcgacgcacagagaagcgcacatcgncgacgacgacgcgcacnagngaatagacgacgcacgaacgcgcgcangcacgaagcgcgacgcgacgcgagcagcgctatgagagnaagacgcgagagcgcgcagcggtcggtcgagcgcagcgccaaacagacgcgcatgacagaagcgcactacgccgacgagagagcaatgatgtatagtgaacgncgacacacgcgcgacgccagcagncgagnaagaangnagacntgtatagtgcagcgagagcagcactagagatgcanacgcaaccccgcacgagacgacggagaacg

SEQ ID NO: 19488 - DNA, 848 bp, Homo sapiens
  misc_feature (1)...(848): n = A,T,C or G
tccgcataacatcattcccgcgttattgttagcgccattcgaaacccctcaaattcccaaaattttcttgcaaccctaggaatatcccacgggggtacccacgtgttttcctgcctcaaggggcttctccgctaattgctacacacgtcaggggttttagccaaagtgttgccgttaagatccgggacttttttaataaccacccctacgggttgccaaaaaagaaagtttcccttccaggttttattaaacaacagggagtaaagcaccaagcttagccactgagccctgggggctttcacacaccctgggaccctcttctcccacaggtgaagcggtttcattcgcctaaagagagggagtctgctcacaaaggcgtttggaaatccagaagatggctctttccccctgttaagcgatggagaacttgattttggacagaccatctctggaaaagacttttaatctcttccaaagacttaatgggacacccccccagtgaagggtgtctgatctatgaaagacaatttagaaaggtctcaatacagtcaaaagcagtttctaacaactttgaaggnaaantggcaataaattagatcccacacccgttaacaatcacttaaatggctagcagcccattctctatttacgaccgccatggaaaatattaatacaaataaaaatttgttttttaataactattcagataatttgatttttattaatatttttaatatttatgtaatattttgctcacccttccctaatattaaaatgaatgacatacatttctacaaccatttagaaagatatttgacaactgataataaaagactgatccggccagg

SEQ ID NO: 19489 - DNA, 1693 bp, Homo sapiens
  misc_feature (1)...(1693): n = A,T,C or G
agagccaccgcacgcnctgcgtgtcgagcncaagaccanatacgcgctgcgtgtgtataccacaagacaagtcgccacagtgactcgtgtgtgcacatccacgagcaatcgtcgcacactccacactcgcagttagtgttgttgtgtacccacatgcgtggatgtgtacaagacagacnactatatgccacagtgcactcagctggcacagagatgagagcagcgtcgacacacgcaccacgcgcgccatatgcttgatatccatcgtcacgaatactgcatatcagngtntgtcacagcangtcgcacacatgacacgcagaggagacagcngatgcgaccnacacacgcacagagctatncaacggtagacttgtctgtgtacacgntgctggacatgtgacgatgctncactgngtgtatgtngagcacgagcccccgacagtcgcatcgacacagcgtggtggcgnatctagcaccgtaggtagtggcctaccacgcacggtantgttgatgatcccacgcaccgcgaatgtctattctgcacacataaccgtctcntcaagagcacgcgcgcgtccgatgcagacaccgcattgatatgtcagcncggttgcgccacgacggccacacagacgcgagtcttgttcacgcctccgtcgaccaccgcacacgactgtcatcttgacaccgcacacgtgtaggtgaggtgtcacagagcgtacacagaccgtcgcaccacatcaccgccaccaacctggtagtattatgtatagagaacacgaacaggtaacatatgtagatacgccgccgcagcacgccacacacactnttcacaccgtgagtgtnacgatacgacccnagacacacgaacgcgcacacgccgccttgacaccgttggacagaagatgtagatgacgcacccacccgaggagtgcactgtctacagcgtagctgtgtcgtctaagtcagcaccgaatacaacatgctaacaactcgcgctgcccgacactcgttgtcacgccaagcggactatataaacgcacgtccacgattcatgtaatagacaacgagccataatcacacacctgagagtagacgatacacgttgagatgtcttgcaatgacaatagaagtataaatgatcgccgcgcgagcataggatgtgttttgcgcctcgctccacaaccaccatacgacacgactcgcagcacatagtacttcncanctggcgtgatcacgctccacgatgcataactgtaaacgcacaccagtcatataatagagacngtatcnacgcgaacagnataccagcgcgncgatctgcgactccgcagtagccgtgtgtnactgantctgctactccaatcgcatctgtggcgagtgacagtgagtccagcgcgagcgacgnacagagagatngnatgccaacaacatccgttgagtggtcttatntagaacggactgatntagagaagcagcacaaatcnacacatactcacatcaccacaaacatatatctatgagaaatgacattgtcccagtaccgagcacaccacagccgagatctanatgactacaaggcaggattatgagatacaaaacggactcagaagatgattgacatnagatgataggatacgagcactgatacgagagaacgagcagagaagacggagtcacaatacaacaa

SEQ ID NO: 19490 - DNA, 1088 bp, Homo sapiens
  misc_feature (1)...(1088): n = A,T,C or G
ggggggggggnaaaaataaaaaaaagagggggggtggcgcggtacgggcggattatctcatgggccaaccggggcttgcggggggagggccccgcccctcctttccccccccgggtcgggggggggggcncattcaccccccccccntnccccctctntcccccccttccctcctttttacccaaaaaatggccattctcttcctttcttttcttttgcgcgcgcgcggccgtttcgtgtaacatccggggggggggccgcgcccttatccccaactttttttgggggggtgtggggggcacttctncacctcctccncctcacaaaaaataaacaccccctcctccccnccccctccnttcctntccttctccatcccaccccctcatcccccattcttatattctttctcccacaaaccatattctcttttctttttatcactcaaccttttcactacctctcccttctccttnctcccattncactattttccaccttcaccataccacatcttttatttcttctcatattcacttactatctctcctccactatccacctnttcattttttctccttttaatattataatanaatntttctttctcttttcataatcacactctcccacccatccntaccactccttctcttcttcactacactctcaccttctattctctatccttttcctcctacctccttcctcttccacctaccctccatctcccttacatcacantcatattttttccctctacctctcatttcttcttatattcctcttaccctcatcctaccctttcccctcataatcacttttacccaaaatctatatccctttctcttacttattcttctcccttacccttcccccacccccctacctcttccttcatatacctcacctatactcacactccccttacctccccacatctatctttctatatacccactatctcaccctttcttctccctccctctacttatctcacaccattcaccctctttcccactttactcttacactatttcttcattctctctcttattttttcctcccctcatatcacctataccact

SEQ ID NO: 19491 - DNA, 111 bp, Homo sapiens
catgcagagactgcagtgagccaattactcaccatagccctacagcctgggtgacagagtgaaactccatctcaaaaaatacatacatacatacatttaaaaaaaaaaaaa

SEQ ID NO: 19492 - DNA, 1651 bp, Homo sapiens
  misc_feature (1)...(1651): n = A,T,C or G
ancgttatgctctgcatgaacactatgtcanagcgatcgcgctctgctatttctctattctcgtctgatcgcactgcttngctacttcacacttaattanatcgtcgtcgctccgctcgcgcatagctcctcctcntnctcngctttctgcttcggtgaccancaacatcaactatcaccacctctacttacgtcagcgcgtgtccngtgcgtcgtctgttctggctgcggcgcggcgngtatatacgcatctatatttgttattaacggtgttgttcttacgtcgccgantctattgttatcgtatctgagctccgcactcatgcactctggactacctgcttgactcttgctgggtcgaccgtatgctgatatgcacgcgacacgtcgtgagaactcatcgatatatcgcttctcgtgtgctctctnactgtcgcatcctctagtgcacatacgctggtgtcgtctctgngtgctctagtcacagcttcttgttgtactgncgcgagtatactgtctcagtctctgatgtgtctcatgtantctgtacactcgactggatcggcgactctctatactctgcacctctctgagtcnctctctggccgcatctancgcgcgtgtgtgcgatcacaggagtcggcggcgatcagaagatgcgtggctgcatagtgtgtaggancgctcgctgtctctcgctacgtgcgtacgagtgtcgtgtgtcgctcatgttctatccctgatctgnctgatgacagcatatatagggcgatcacttacacattatatatcaaatngattctccttccactcatctctatatctatnataatctaactacttgagaatcgtctgcggcagnactgaggagtggtgtagtgcgatcgagaccttagcacttcaactctgaactcctctctatacccttcagtacgtcggtggtgctccctgtacatactattanctaatctcacactctcgtgacttaccgtgacgcnctcgctacgactcctcgcgtcgcggcgctccaacctcccctcgctcgctccgtctccgtttctctttatcccctcgtctcttcttactaataaggccatcaacaatcactatattagtgacgagatattaacactncanaggtacggagagagcgagtgcgcggtgcgatcgcggggcgcgtcatgcacctactacgagcagcctctcactnaccagccacactnccgtctctggttnaactctacatcacatccagtgcgtggccgtnttcctctatataaccacgacgacataggtnaatctacgactagagtaagcncactgagcatcttcgctctcctacggtntgctcgtatagctcggcgcgtttctngacagagaacagtgcggcgacggtatcgcggtggaggangaaagaagncagacggaagtgtacgctgtgtgatacgcgcacgncgctcgttgtggttttctccgcgggctcgcgtcacacgctcgcggctgcttctcgttgtggtntcttctccttcttctaaacatcttcctctggtcgtgttncgattctcctttgcttcanatggtgtgctagcatgtgcgtatgcatgcagtcgtcacgcgcgccatacttcgtgttctcctnactactaccagt

SEQ ID NO: 19493 - DNA, 1487 bp, Homo sapiens; identical to SEQ ID NO: 9095
  misc_feature (1)...(1487): n = A,T,C or G

SEQ ID NO: 19494 - DNA, 926 bp, Homo sapiens
  misc_feature (1)...(926): n = A,T,C or G
ggcaaacaacaaggaaanaaaaaaaganncnnggcttcttgggcacgacccccgcagattccccaggaatacttgaaagacataaggcacggttcaacgcgacccttttaacacgccgtaatttccccttgacccaccgaggccgcacccggcgcaactctaaggaggggcctttatatccccattcccacaccgaatctaatacgcggaggtccgggggccgtctttactccctaggtaacatacacctcctgtataaaccaaaattttttttcggggtggaaaaccaacagtacagcgcacctcgtctagaaaacccctacccatgacctgcgaaaaattccccacaactaatggcnaccattattacaaacacacccgagccgccctccctcgtgacctggactcatttccaccaaggccacaacagaacgcaaccccgccagtcctagttatccggcaaacacactaactctactttagttcacccgtatcgacccgcccccccgctccaaacaacgccaccaagatagaacaatgttatctatgtcccgtacggcttagtaatattgcgtaatcctcctccgagaggacacatcataacaacccctccctaataagctcataccccagggtgacccaccccctccgtccccacaggggggtccattaccgccgttgcgtggctgcccaccccccacctgagtccacccttcgcagccccgccctcggaagcaattgatgtataaattaaccgatagatatgagaggaatgcgaccccagattatccaaccgaagaatatctatagaccgtgcgaggcgtcgcccgcaacaccttcatataacttttacttcataccttaaaggacggcccttccgttccaacgacaatacacaccgcaccgccgtctatatgattagttaa

SEQ ID NO: 19495 - DNA, 1316 bp, Homo sapiens
  misc_feature (1)...(1316): n = A,T,C or G
cggggggggaagcgcncagggggaggggggcggcaggcggcggccgccgacccagaaggaaagaaaaaagagagcctgaaaggagacacaaaaaaaaaaaagcttaaaagcgcgcggaaccccaccacgcgcgagaacgggcagcaccccgcggccgcggcacgagggccgacgaagaacccgcagaggcacgcgccccacccggaacgcagggagcggggaagaggacagggcgggnccgcgcggcgccgngccggagaccgcaaaagaaaaacgggcgcgcgagcgacccaggggcggcaagaagggacgcgccgcagcacccagcgaaacccccaccacgcccacccaccccccgcacgcaccgccgacacccgcgcccaagcccaacaggcgagcgaacaagcacgaacaggacancaacaagaacaaaacaccaacgaaacacaaacaaaccaaacaattaaaaaacactcaccgaggcccgccagaggggagagaggcggaagaaacgcggacacaaggccccggcgggcagcgcagcggccaggcagcatgggaagcgcgccgaggcggaaggacgaaggccaggcaaccagccagcccgcggcccgacgcaggcaggacggcgcgccgcccgcacagaagaagaaacacgaaacaaaacaaacggcgcgaccgcgaacggaacgcgcggtagccgcacaagacccgactgaccaagcgcagccgcgtaagggagcgaagcaacattacacgaccgcgacggaacgaccatcacacaacgcaagggagaacgaacaantagtcaaaaaacagcgagagacggnacggccaggaaccacagaaaagacgaagcagacgacgacacaacacnantatgagaagaacggcggcaacaccacgagtaacgacacgcacaangcgccgcggagcgacgcacacaaacacccacgacgcggaaagccgacacgcgcgagcgcgcacgccacagcnatcacacacacaacacacncaacatctaccacaccgcagcgacacacgaacgcgtgacacagagaagctcgcgagagnacgacgagcagcgagacacacacgacagccatagcacgatacaagcaancaagcgcacgaggtagacaaccanccacgcaacanagagacataggagaaaagagaggaggngagaggagagagncaggagagagaccgacgaggtagagcngnacagtcncggngcgacanacccagcgaggnagcgacgccacgacgcaaagccaagcgagagagagagagaacgcgtcgacgcagcaacc

SEQ ID NO: 19496 - DNA, 980 bp, Homo sapiens
  misc_feature (1)...(980): n = A,T,C or G
cttaataacttacgtcggcgaaagttctcataacgttgagcgccanaccagacatataattctatcttgacgcctctagtgtcatcgcgccagttttccaccttctattaaacacacactacgtatcatcattacgcacatgaacgacttattgacgcgaaacgacaaccatccagccggccgctacacggacatgatattatcgagagacgcacaaacccgcaaacaaaagcgcatgcgatcggcctacgttgagcgctactttaacggaggtgcacgaaaacaatatatcgtggacaacaggaagggtgcggaggtgaggacgtgaaaaagaatataatttgggtctcctcactttcancgccaatgctgcagacgggaagacaggcgtcacgtgaaacgccagacactccgatgtcccggaccttgttgaatttattgtctaggcatacatactggcgtggtcactctcgatatccgttcaacgaccaactctcgattatagatatagtatatgcataaataagtcgaaaacttatactacacgacacgacaacgttaaaatatttttatatctggcttgccaagctacgacgcttgaaaatcgtactaaacctatcattctttcatgtccatctctctctcggcgctcgtcggggagcagatcaaacatgaaaatcattgtacattacgaccagctagacagaaacgccatggcttgcctatctattatttattaaacccaccccacctcaaaaactattgagtttccttttctataactgaacagaggcagatgaccatagtaattttattatttaacatacgaacccaattgtatgcacttcctataattaattcgccccctactcctctaaaataaaacatctcgcgctcgcggggaaaggacaccaaaaaaaaaaaaaaaaaaaaaaagttatttatgttctccacaaaagtagggaaaaaaaaaaaaaaaa

SEQ ID NO: 19497 - DNA, 1872 bp, Homo sapiens
  misc_feature (1)...(1872): n = A,T,C or G
ccgctattgtgtcgctctatctgtgtctctcggtgcgcgcgcggtgcgacnttttctctgtctcgtgcttctgtacgnttgcgtnggcgcgtcgtgtatctctcgtctcgccttgtatcgtgctctctcgtgctccggtcctgtncgtggtctccttgtgtgcgcttgctgtttctctnttctgtctatattantngnggctctctggcgcactcctctctcctctcttctccgtctctcgtgctctattctcgcttcgctgctgctttcttgtctcgtcgcggtctgtgctcctcgcgcggcgtacctctcctcctgtctcctcttcagtgctctctnttctatacggtacgngtgtcgtcgttctatttctgcgcgcgcgcgtcgcgcgcgtctctctcggttgcgtggtcctggcgtatattcgtcctcgtccttcatcgcgggtngtggtctgtcgtccctgcgcgcgtctgctgttgcgcgtatcgtgcgcttacggtgagtctcntctgttctgtgcgtgcgcgcgctgcgtgcggttggcgtcgtatatctcttgtctctcgcgctccgtcctccgtctctcgctcatctctagcgtgctccctcgtcgcgcggtgtcttctctntctctctcncngtcagctgccactgcctctcggctctctccgcgtcgtctctntacacgacctcgctgctgctgtgctgcgatatatctatcgccgcgccgcgtccgcgtctctctatatgtcgcgtcttcgctgtctttgtcgtgccgctgtcttctacacagtcgcgcgcattcgctcctcgctccggcgttctccggttcggtatctcngcggtcgccctcgtgcgcttgctgctctgctttttctcggttccgctgccttcttccggtgtgtgcgtcttctgttgttcgccttcgttctcctgctgctgcggtgctgnctctctgtgttgttggtnttcgccccgtccgctcgntntttccnccgtctctttgtccgcgcttctccgcgtgctcgtgcttctccgctncttggcctctcctgtttgtttgtctcgngccctcccttcttcgtccttcnctctcctgcacncggcgcgcgcgtgctctcctctcgttccggcgcgcgcgcgtttcgnttcntgtcctcccctntcctctgcctgcgtctcgtccgcgctntttnttgcttncgttccgtgcttctnttctctgttgtgtgggttttgngttgntgtgtgtggtgtgtggtcggttccntctctgctgcgtcgtgnctnttntctcntcgtgcgcgcgtctcgtgctgcgctcntngttnctgcncgtctcgccgttgcctnctctcctctctctnctgtcgtctntncttntccgggtgtgcgtcgctctttcncgcnctcctctctgtcgccgngcgctcngtnctcnctctgctccgctnctgctcgtgcgtgccctcttgtgtncggtgcntccgtctgttcgtngtntcnncngctgctgtcgtcnctttcgtatcataacanctcnntntntnctttccgtgctctctnttctntctnnctgctctnctntnatntntctctcntcgtncngttcnctnctcgctctnntntccntgctggtcttctgtctcnctccgctcnntcntcnctnncaaggggcgtntncnctnctgtcggncncgntnctctggggttcnntctncnctnctgcntcgctaaagcnncngatttctctgctgcttntctcnctctgtgtgtactctatatnatntnctgctggcngcagtcgctnctgncatcctgggacgtcatgctctctggtcnctgcgccagtctgcgcgcttttcagtt

SEQ ID NO: 19498 - DNA, 566 bp, Homo sapiens
  misc_feature (1)...(566): n = A,T,C or G
actacggaaatgatgttaggcaaanggnnaantcaagcaattttcttattcaagttcaaaatgagtcataaagcagcagcaataactcgctacatcaataatgcatttggcccagnaactgcaaacgaatgtacagtgcagtggtggtttaanaagttttgaaaaggaaatgagagnnttgaaaatgagtagcatggtggccaaatattggaagttgacaatggccaattgagagcaatcattgaaggtgatcctcctacaacacaanaagttgtggaanagctaaatgttgaccattctacagtcattcggcattcnaagcaaattggaaaggtgaaaaagctcgataagtaggtgcctcatgagctgagtgaaaatcaaaaagaattgttttgaagtgtcatcttctcattctacccaacaacaacgaaccatttctcaactggattgnctcatgtgacaaaaagttgattttatacaagtggtgatnactancttantggctggaccaaaaagaggttccaaagcatttccccaaagccaaatttgnctcaaaaaaaaaaaaa

SEQ ID NO: 19499 - DNA, 978 bp, Homo sapiens
ctacacactatacacatctataaatactagcatgtgtacttataatccagccatcatcttacacattgatactatcgtaatgagatatatttgtgggtaacaacacgcaatagaattagaaccgaccacttactcacccactcctctcactgcgcaatgtcaacagatccttgacaagatgccgctgtctcgtcttcttcttcatttggcattactctttgtcctgtgtgtgcttcatcacatatctccgtcatagtagtagtagcagtacacgtctcttcatcatatttcgaataagagtatgcgcaatctatctcatatcattttaacacatgagaatagaaacttgcgctcgagtaactcacacatcctcgaattaccccactatactcactaataatttgttgcataacaactcgcgagtcgcctaactcagtcgtgattgaaatgacaattatcagatttatcagtccatcctgcttcccatctcctcgcatcaccctattactcggccatagccactttcactccactcgagcgacggggggaagtaccattttacatgtcgtaaacgtagcaaggtatccgaatcgctacgcaaggttctcctcttgtcctatatttatgaaatgtcatcttcctttattcacaattgtccacagcactgaccggcagctttgtcgtctatagcagctcgattatgtcagtgcaccccttacgaccgagatgtacagtgaaacgtgcaattgctcttcaatcttaactgaatactcacctatatgtgaacctgtgcgctataatagtggaagaagatgtggtagtcagagatggagcctgtcttcaataaatttacagttagtttcagaggtacattgttcttcttcgtgctgttaattaggtgttcccacaagtcaataaataccgataaagaaccgctctttctattctgcatcgttaaacttatactcagtcttgtgc

SEQ ID NO: 19500 - DNA, 1091 bp, Homo sapiens
  misc_feature (1)...(1091): n = A,T,C or G
cttagtcagctccatgggnccatctggncactcactacagcatgaacgttcttggggncgccactctgcatgaatacgcacattaatatgaactggcatatatacgatgggnctcacggctagcatacaggggctgcgtgtctctcccggacgcctctcgctcctctactcgtccatctcacaggcgtctatcgggttnaaactactagcctagacagcaaagnacaatggtcgggaagtcgcggggtaacacttgaggagcaacttcggnggctctaggataaacccacgagntactccacctggtccctaatgcaaatacactcaggacctaattngngcatcacccgcagtattgactacaggtnnccctgtctgcgcgtcctcttagctctccggcggcggctgntgcaccgagcacgacgagaggtaaggaaggaaaatattaaacgcggaggtggcaacataaggaatggagaagaactctaagctatgagcgaatcgaacctgcggatgcagggaagngcctcaccagggcggcagcacacctccccctgncgctacgcacacctgngaccatccttattcggggacccgcggacactgcccacaacacatttattacagtccacacacgaccatttgntncggtctggcatcaaaaatagtgaannaataatacttctctttgaacttaccattaccacacctatncacttatcaatnnacctaccnctcctcatgctacaccggatggnntcggacagcgttaggagactgagggataattggacaacgatcaaccaaaccaggacccgagatcttccatatatctaactgnncctggcattcttactccacctaacatctcagatgaacgaagtgcagcttctgcgccatgcccctctcttntctcccctcccacttcccttccacccctatctnccttcttactttctcttccatattctctnnccttctttctcctcttctttcctcttncctnccttttctttttttctnnncttntcctcctcttcttctcttnnttttncccttttttnccccttnnnctcttcactttntctctt

SEQ ID NO: 19501 - DNA, 1644 bp, Homo sapiens
  misc_feature (1)...(1644): n = A,T,C or G
actattcctcctgattataatcactcgatactaatttatacgatcacaagcccagacagcaccgagntgtccctttcacatacgagactaaacaactcngcnctttgagaatatggtctgactctgtgacngaaacagactcaccgcagcggatattatcaatacacaacagcagtatgtgcacataactcctcgacgctagnagtttttattctctgtgtggcccagtgatgtgagacgcccntcactactcctanaccgatatacaatagagcagatagaccagcgacgcactcaacggttgatattntcnttgaatccatctacacaaanagatcggatcgcgaagacattaatattactttggccacggntaggatcatctgttcatccttataatataataacaccacgatccgccatatctatgcgctgagcactgagacgtttccaccaccncaggtgttgcantatggaattgagacgcgcattatcnaaagcgagagagagccctgtactaccntcgctctttgatcgccatgagtgactgggcgtgcgataagtagtactacatcatccatgcangcaggccacatcatactatgaatcacacgctgttcttctcacnactcataatcatagcacgttaaagcacgtgacaacacaattcgtcgtgtgacgaaaggccttctcacatagttccattacaaattattgttctatctccctcaccactatacagagcgcgcgcgtgcaaccgtggtgtgagtcnacgntattctacaccgctggtgtctactcccctccctgcgtactagtactctatacaattgtataacagcntcgtgtattganataagcaccacaccggcaccgaactaataatacactcgcatgtcgttgtcttgtgatatcgtctntgtatagacagcccgtatctcgcgtgtcacttgnagaggcagcatgttggatatgtttcactcatctatcccttccgtgtgcgcgatcatctacaacacatatacgtctccacgtgtagcatatattatctctttagatttagattgtgagccactcatcgctgtacgcacggccacacagattagttaattttgatcactcatgatgcgcacgactctctacactatcgatgtgtnacctctatacgactgatgacaacaataatatcgcgacatctgattagatgtgtgtgtccggatcggtngagactggctagtgtatgcgagagcacgattgatgcgagtaacanacacgactatgctctctgatcgtcatcctacctcantagatagacgcagctcacgatgcctagtgangcntagtcaatgtatgaataagctcagtgatcgtgaagtnatcacctgtcgntgcagctcaccgcatcactcgacttatatcgagacacacaccacacgttgcgtntgatgcnatgtatanactccatcgtcatatgatgagatgcgaccgcaatagantcganatccatgnanantantntcacgcagcacgcgacacacgaacacnanctatgtgtactcgctaatttcagcaatgtttagatagttgccacgtgacactnatctatcgcgttcgcatagtcgtgatatagtcgcgcacgcaaag

SEQ ID NO: 19502 - DNA, 954 bp, Homo sapiens
  misc_feature (1)...(954): n = A,T,C or G
gcgcgaccccgtgcgggggggcgggggaaangacagggatttttttgttctcgccgccgattttacttaaaccgctcacgcagaccggctactgacacaccactcgtcaatcttaagctggggtggctctctcccttaatccacggatacaggtgacattcctctatctctcgggtgtttgaaaaaaaggcaaggagaccccctctccaattcccaatagctgaaaggacatcgtgcaatctccccactgactctctctgcttgccacgattaggtgaaaagggcaaggcatctcgcacatgaccacctgaatgccttggcggttttcacctctgccttgcaagcgatgtggggtactggggaagccacctcaaatctttcaaccttgggaactgtatcccgggtctcctttgcttatttttaaacgcgaagcgagctaaaaagttgcctccctttcccttgtttaagggagaaatccctagtccttactcaccgactctgctgcgctaggagcttcttgctgcggtagccagtatactctcgatcagactctgtgggtcccgtaaatccctggatttaccgcgcgtacgcaggatggaactgcgtgggtgtgaaggcacaaggctttggagggggtcagaaaccaggaggggggcgggggtgggagtgcatcttttcgggtggcagtgccgcggggtgcaagaacgtagagacaggccaagtccacgggtggccgccgccattatgaagattatagcgctactacagttatggccaggagcgatacgtgtactggatgcagcaatggagttggtcggtaagggggtattttgccactcttttcatccggatacatagtctctctcatcactctccctccgctcatcgattactgaacaattgtcgcctgtctgcaagtttgtgcgtgagagcggggtacgagagagaccccgc

SEQ ID NO: 19503 - DNA, 1143 bp, Homo sapiens
  misc_feature (1)...(1143): n = A,T,C or G
actataaatactaaatggnacttatggaagtactaacatcgttgttaatcacaaacggtnngaaacgaagtgagtgacaaacaatagtatctccgtgtgaatcaagcaacatagnnccacatatgagagatcgggtgcgtctatagtcagacaaggacggagatactaccagcatcggtgatcacggcggccgtatgtttggaggagatactacgatatagaacaagaaggngccttcataactgtgtcgcgtatgcgactataaagaggacgaatagatgaggagagttagttaggaccgcacctgngncccgctacttgnnatccgacagggtgatatgaagacaangngcactagcagtnnaagtcaattataatcatatacatacaaaatgnnanaattatctnatcgtacacgtaagcaagattagccagtacanggacatcactggacactcaataaattcatatggncgatgaagaagactagtgagtataatagaaggaaacggaaagggacacacaggtgttgttgctcggacgcacgtcagggtatcaactcaattgggcctaaggtaggggagagggacatatgatggtgtgggaaatctagagataaggggcaatcaaaaatagnaaacttnncattagtatagagaaaaagaaagatatacagaaaaaatannagacgtgcatataaagaaaaaaattactcaaaatacattaggagatatctaaaaaaacaatcaaanggaaaaaataaatnnataaacatccaaatgaattgacaacctggggtgnggacggagtggtggcgaagaagaagtaaggaagaatagaacaaacataacagtaattcgnacaattacatggatagttattttctacgncctttnaatcaatgaaatcctaaaaaaataagggttgaccgtatagacccctctggttcctcggaaaatgacggnnacaaacttctatttccatttaaacatactaatcnacagagaacaaccagtgaaccatatttnnacaaaataacacttactaataaatatncacnnccatcaataatntnnnnnttnntcactctaaatcatatcnnnnctnncaatatctacncacttnnctttnaaaattcaccct

SEQ ID NO: 19504 - DNA, 820 bp, Homo sapiens
cactgctggaacgactctcttaacttccaccgctcaacgaagagcccaacaggtgcaagctgatgacttggatgcctaagaagtactcaatacctcatatccaaaggtacctccccctactaatccagatttcgtgattggttgcatggcatatcaaaaaaaggcacaagaatctatcggctcgaaacttctaatgtctcaagcgaggcctcaaagttcatattagccacctcctcgatcactctctttccataactctgcgcaccatctgcttcttcctctttattgcgaaaaattccccatccttttcccgtcaactactttatccccttctatctgttctttttatttcattccccaccacaattcttctccattttccttttctcctccccttacattcttcccccacctatctattccccctttatagcctattatcactcccctataaccccccttctaatttcctcccccccaaccaccactccctcgtttgtacatggacctataaaaggcttacccccaacaatctacctatgtttcacaattccatatatcttaatgacctgttttcctgaccccccaccaacttggtcgatcattccctcaatcacctccaccgtatccacccctctttttctctctatcccttttaatgacccccctactaaacgcacacctatcttacttatccgcctcaccctatctctattttcctcccgctcccttcctaacttcctatacccccccgctcttatctttttttcccccccctcacatattattatccatctcttcacatttaccattactgcat

SEQ ID NO: 19505 - DNA, 475 bp, Homo sapiens
cgtagatgcggatcggcgttaagaccgatcaggtcgcaaagaggactagagaataagcatcagctgaacaggatacaggacaaacccgcgtggctgtgcacttgtttcgccctcaccacaccttatatcgaagctacttcgctgaaccttatacttcccaactatccccaatatcaccttgttttatcttagcgacctatcagcgaagatcttagggcgcacaacgatagttcgccacttaatgggcggtggtggcgccacgatcccaggggaaaaatacccccaacgcgtcctgggtaaatacgcttaccttagacgcgccatgggttggaaaggccctcccaaaatgttcgcttttctggagtgccactatgggcatatggtccgacaggatgggtatgatcccgacgggattttttcttgacccaatagaggggccttatccccagttgggtcttggttaatagcgtacaag

SEQ ID NO: 19506 - DNA, 778 bp, Homo sapiens
cagacattaagggaatactcgggcaatgccgcaggcataggatggtgagggcggacaacgtacatggagacgagaaagagggcggtggatgtggtgatgatgtagggagggggctacatatggggaaacatgacggcatataaagttaatcaacacagttagacctaggccttaacttagatcgaaagatagagtaagtgagtatgaaatataagatattttcaaacaaaaacaacgagtcgcattgagttagatcatctcaacctttgtttgtggggtgacgacggctaaatgagactgtaggggagcccgggggtgtcgggtgtggtggggaagaggaggtgtgaattgtgagggtgagaggggtggcggagtcgcggggggtggggagccagggctgcgtccgacgcggctcgcgccccggcgtctatgtgcggttaaggcgtggtccagggggacgtaagagataacagtctcgaaatatactccccgcgctctctaaataaaaaacctaacacgcctctatagtaagaaatctagtacagtcacttaggctcctttgtgtaatcatcgtgcacagacactcctctgtctcttgtgaattagtctctgtggtggatatcatatctacagaaatacggaacagagtatagggtgaggcgccagttccctcatttcatcattgccccacccccacaggagtacttgagcaacacaccttatgcttgtataagtttgacttttttatatccaaccaataaacgccgatgctggccag

SEQ ID NO: 19507 - DNA, 891 bp, Homo sapiens
  misc_feature (1)...(891): n = A,T,C or G
ttntanggcctttngggaagaccccccaatttttggngnagttgcnnancntggtttgaggagaggctcctttagganatagncttttcntatattggcanctacaaattcctcactgatcctgcncncntagnggggcctncnncctngnnagacttccatcagcgagcaatantgatgangatgggctggtccnagaacctgccccnttacagctgctnctgggggctcctntntanntttgttttctaaacaagcnnaanacttanagggcccangatgatgatgatgatgangatgatnatgatgatnatgatgatggtgatgatgatgatgatatggcgacaaagttgncannanacctccatncttgataaaacancnngggcnttccantttttncaggtatttcctttcantgactctgttacacagatggacggggcnagntggaatgttcctttanttagntcagggcaaggttggcaaactttttctgnaaagngccagacagcatatattttaggctttgcggcccccccaacttctncttaccactcgaacttagcccttgaacctcnaaccngncncaggccgtcngtntatgncttnggnnaanggnnnggctncaaaaaaaaaccaatgccggcgcttccntttaggngggggtanntnatggacttccccnttgaatcgntngccttgngtttngcgggnnnnagggttaacnttttaaggggtaantnggtagccnaaattggggnnccccgaaaaantgtnnncnnaggncctaanccgcacctaaagggcgggtnngttttttaggnccccnnnggaaaaataaaanttttcttnggggggnccncnnantataaacccntgtccccnnng

SEQ ID NO: 19508 - DNA, 824 bp, Homo sapiens
  misc_feature (1)...(824): n = A,T,C or G
aataataattatgncaattgtttaattttatagacttttagagaataaatgaacatactagaaaggtgaatattcagggcataattatttcatatttactgccaggtatagttcttcttatgattttagctttcttgagaatgaataataattcagaaatattgttataatgtaaacacataggaacacatagaatggagatctttgaggatattctcataaatggatataacatgaatcttntatatattaaactaaataaagcaataatagatatattaatatcggatgggattagaataagagaaaagtattaaagagtaaatataaataaaggaatgactcatgcatagtgttaatttctaaaaggatggtgtgagttgggttaatattatgttagtattttgaatattaggtgccatttttcttatattacagtataagtattagcaatatggaagattggaacaggttaatgagcattcagcgcatgatgggaatcagtgtatgggttattaaggacaacctttgagtttggggtgtatggggacagacagaataaagggcagggtgagattagtcctggctgactcaagatagtggtggtgagactgtgcgtttttgcaggttgttagttgaattgtctatggctccctctgtccttttcagcttaagatgaagaggcctgaggctcattcttgactcctgctggggaaggggttgttttactccaagtatagggcttcttgtttcctcctaactttcnnncttncttttttatcttattttntctccatcattnccccttnacttccattttttat

SEQ ID NO: 19509 - DNA, 248 bp, Homo sapiens
  misc_feature (1)...(248): n = A,T,C or G
tctgacttgctgttatnctggttctcaccaggaggtgtcgcactgcctcccaccctgtgtctgcttccgaataaaagaagaaagcaataaatcacgtgcggngtaaaaacnantannanacttncccnnnnaaangctcnannnnantatangaatnangnnanatatannaanaaaaagtganacntaangnnnagtgagnatntnntnanagnannannaanananattnnannannanntgnnaa

SEQ ID NO: 19510 - DNA, 285 bp, Homo sapiens
  misc_feature (1)...(285): n = A,T,C or G
cccgccggcgcattcccggcggcgtccgtaacatccgcgcccacacacacatcaacaccgataaccnccagcgtcacgagagacgcccctggacaaacccgccccacaccgccaggccgcggcttggctctggttaactcacgcaccaaaacgcgacgaccagggaggaccccgcggtgtcctctcttatggctcactccaccactcccaacccgggggaaaccccaacgggcttgttaatcggccccttgagcatcccccaaaacaaggggaaaccccaccggt

SEQ ID NO: 19511 - DNA, 840 bp, Homo sapiens
catttttattactaccctactctcataaccaggatttctatcgacgagcaaattcttgtatctaatctctgctatctccgctctcttcctgaacccgtactactttccatacgatcaacaatatcatatctggtcggcacatctatctatttcgcgtatatagcataactgctacgccgcgccgcgattgcatcaaccgctattccagttactcatttagttatgtttatgctgtcttctacttacattccaccgccggccgtttaaaataccaggagcctctctgactaaacaatgtaaaatagacaatatccacacatcttaattcgtcttgggaataactcatgtaacttcggcatagattccgcatcgctttttataaatggtaaatacaccctaaaccggctgaaagttcaaaatatactcgtcacctgaccatattcttcaacttctctgttattatcattctttcagattaattgttttatctgtacaaacctactaattataatattcattatttctcttcctacatgaccctctggatcttctacttttcaagaaaaaacaattttatacttcccccgctttaccaaagttaattaaattaatccccttttcgcgtcaaatataggctttctatacattgctgagttatttatccctatatcaaccaatagcattcacccgttttatttcctgtccttagtgtctgaagatgctcaccagttttttgtgcacagtaaggcagcatgctaaaatgcttttgttcagttctgtatatttgaaaatagcagtgtgttccctgatggttacctgcagtggcaccctgtacaaaaa

SEQ ID NO: 19512 - DNA, 891 bp, Homo sapiens
cccaaaatttttagaaccctgggaaaaaaatggtggaaatcaagaatttttggcaaaagggctttccagttaatggtaaccagtgagggtttaaccaaacgcctgaacttaacgcaagtgactttttaattacccccgcacaggggttgcttttcatttttaccagcagaaggcatctccaaaagaacccactgccctttaactccaatgttattctgaaatacaatatataaataatatggttaacccaaagaatctattttaggtcctgaatcaattctcccgcagataccaaaggctgactgcactaagtttccttttggggtgatgcagatgttttggaactgcatagaggtagtggttgcataacattgttaatgtactaaactgtactaaaattgaacactgaattgttcatttttaaatggctaattttatgttatatgaatttcacctgaaagacacagcgagacatcgtctctaaaaattttttttgaagttataatcatgtgtattttccatgtacacataaaaggaaggaggaaagacattctcagaagttctggtgattatctacagatgatgggattataaatgctttaggttttcatttttatattttgttagattctccaagtattctacagtgaacactgctacacttaaaaataaggaaaatactatttaaaaatttaacacacatagtaattaacaacagagaccacatctcggttttttttttaacccttctggcatgccaaaattcataaaatttcttgtttctgtttgcttgatgttttattcaaatttgatgtcagagttaaaggttatgagctagatatatgttttagaatatttgtagaaatatttacaataaatagggatcggcaa

SEQ ID NO: 19513 - DNA, 887 bp, Homo sapiens
  misc_feature (1)...(887): n = A,T,C or G
cttgggcgtggagggggggggggttgtatggggggtgggtggggaatgttgttgtggagtgagaggggtgtttttccagaaataggtgatagggggtgcgtcgatagagtggagggtagggaagaaatgggtgttgaaagggaggtgtggttctttgtgggatttgtgggttgtggaagggagttggaaaaaatgagggggaaggattaagaaagggggtaaaagaaagaagggtttttgaagaggggttttgttttggtggggagggagttggggagaaatattttttttttttggaaaggggttaagagggttaaaaatattttgggtttggattttttgtgaggggttggggaatatattgtttgggaaggggttaaagattttggtttgggggggtttttggtgcttttaggtttcagggggtggggggctttttttttttttttgttcggtttttttggtgagcagtaaggggggatttttgagtttttttggggaaagatttttttaaagggggttttttttggaatttggggatggcngggtttttttngggggaaacnggggaaanggggggtgggaagagaaaaaagnaggaggggcngnagaatnttttttttttttttnagggggggtggaaggggtttttcnaccatgtcaaattggnaaggtggggggaggggggaccatttgtggaaggttaatggggttttagagagttttaacccttgagggttttttggtttggggggcaggaggttttagtaaanttatggtgccccttccggtggtttcngggttaannnaggggggtttaannaggngtgttgtgtttggggctaacattgccangggnaagnnaggagggtttaagttataaggta

SEQ ID NO: 19514 - DNA, 849 bp, Homo sapiens
  misc_feature (1)...(849): n = A,T,C or G
agatgagtgacaaataagtggacgtgataggcatgaagatgatcagtggaacacctacacgtgaaatcgggaataacatatccggcactaatacaggagcaagatccacacgttctcacaaataagaagagtaaacataggcacgaatacgattaaagaggcaacggcgaatgaatgacggctctgaacgagacggggcggggtgtgcccactcnatacacctcccgtccttacagactgaatcactctacaacatcctatggaaatctcacgactttggagaagaccgggtatcaatgttaacgaaacatgcaaaagggcgttcttgcatgcttgtattcaatactacataagctaatactcactgtcgtaaaatcgcataagaaagataacgagcgcaacaagaaagtaagtacagcatccctcacattcaaaacagcgatcaccgtaatagtttttaattcatacaataaccctaatatgggttggccaccccccccccccagaaaaagcgccttttcttaccccaatggttggnaggacacatctatgagccaggaaatgggctctcaccagacagtgaatccgccagcaccttgatcgtggacttaccagccaaaagaatgatctatcagattctttcaagacttaagcgtaggttatgacatgcacttaaacccagctgtcagagacatagatgaaggagactctaatcactccttggggattacatacgctgatctctcttgatttccatgatttgccaacagcaacacacgcgagattagacacatcaggcacgggcactatgtgtaatgctggaacctaaataaaacgcagatgcgggcg

SEQ ID NO: 19515 - DNA, 1518 bp, Homo sapiens
  misc_feature (1)...(1518): n = A,T,C or G
attatcataactganntnacgatcgagtccaatcgttgctgatgagagcacctgagcagtcatggcgagtcgngtgtgtgtgtntctgtgnangtgagttgctacattcgttgcgnnatacagatgttgtangacancntgcttttgatntntatcctctgtcgcgtgtcgtgnngcacgtctcatacagctgtgnatattgccagctcgtgttgtngttcgacgtggnananagagtccgtctgcgcggcgatcggcacangagcntctcagctcgagtactacttctctctgtgtgcntgngcgttgcagtatatgtcggtgngcatctgtgtggtattagtacgantgtatcagnggtagtgacatgnganngactgtcatgtgngngcgtcgtgagangatgacgcgacgatagntgatatagtagagagtcgtatggtgaatatcgacangntgaagtgnatatcttatntctccttatcgaaattctatagactataatacttctccacntatatcaacgattagaatattcgtatgagtatgactctcgctctncgtgcctctgtacgtgttttatnactctctatactacgtatgcacgtacatatagtatcgtcgtntngcactgcatctacggtctgagccacaggtgcgagtgtnttggtggtgagtcgtgccggagacgccacaccaagccgcgtacgtcgcacgtgtacacatntaacgaactagtgtggntggggctgcataggacagctggtctgngtggactcggctcgtgcgttcgctcgtgttgtggttaggttcgcgagtnggtcggtggcgcgttcggtgtgctctggtcgtgtgtgtggctttntctttgctgcctacgtgttcggccgatcccagtcgtnggcgcctgtgattggactagtacatataattagtatatcangatatcatcaacgtgattcacgactcttaaattgagatgataggtacatctgtcgtcatgagatatcacatactgaacacgtgtcctagtactgcgagctacggcgctgtgcaactattcgtctacacacccatctnactccggccccgcccgtnncnctgtactcttccgactcccacttctnnntatttattgtttctatatctatcatgccgtcgttgtttatctctctttttanaaactctcttcttcatcgcttgttgctatatacgtactaatatcganagataatntncctgtggttctttnccgcatntgtntccgagcgttcccgttgtgctgtacgtgtnnaccgttaacacgatgcttcgctcttgtntnatcctctctcttcnataaattncattcnaaccttatancanccttcnctaaccatcttgntcntacttnttanttatncactcttctatntcnnngctctctnncttcgtcgtattcctcactatcatcgttacattattctgttcacaacaatttnnattttnnnnactntcgnnatttctgnnncccgaaac

SEQ ID NO: 19516 - DNA, 387 bp, Homo sapiens
  misc_feature (1)...(387): n = A,T,C or G
attattatagtatgcaataagacgtagtgacgacatagcctcaaaccacacaaatcaacgagaccctattttatagcccaacggtgccatatacaccaacttctctcaactgaattaacgacgacaccaactccacagcccatatcctacacaccgccacttgtcaacgttgtactaatcccctctccctacaaacccactagtccgacgaacttactcactggcctagcgatcagaactactatacattgcattcacacctctggcacgcgataactaaaaaatctttatatctacctaccgccactctccctgcaggcgaaacagccgttcaccaccccgacttccttccccccacactctcccacncccnnccnnnnncntatc

SEQ ID NO: 19517 - DNA, 1160 bp, Homo sapiens
attattcttgtgcttccgattcctctgaagacatgattcgagcgcatactagatcattccaaaatcacgtattccgcgcagtctgggtgtagtgaggcggctcacagcatatactatactttccatctctcaacatgcctgtcatccgtcgacatgtcgtagtataatctttcttctatatctccttgaggcgtttgtgaatgacgactctacgtacatctatactcgctccatcgtacactatcggcgacggcgtttggtctacttgcgtcatcgtaagtgtctgcggacgcgcggtcatcgattatattgaggtgcattatctcccgcggttggcgtgtgagcagtgaattaatatttatatcagtgtctctccctctgtctgtacacttattatgtctatggcgcaaaatgctatgcttgtagacaacacctaaacataccaatactaggcgcttgctcgtcatgcgtcgtcttatgaactccccaaagtccatattgactaaactaagatacgtgttcactagcagaattcgtgcatccgacgttcgccgtgacgagtcctgtctccaccgatcggctactcgcacccgtcctagccactctacacgaccctttaaattatttctttttatcgcgcgcgtacaccggtacattaatattatctatgtgccgcttatctattgcgccatacaagaagtcactatcaataattgatgatatcgcctaggtattgtctattacaccacagacgaatgagacggacgtgcgcgacagcccaacaccctgtatcatgatgtccgtccagcatctcactaactataactatatcaccccatatgtgcggcgcgcgggaggtcgagcgcggtaacagcgtacgtgtcctcgccttgctaccgttactccccacctcgcatcattcccgcaaagcacacactatcatttggtatcgcaggtatcgcagacaaatattagtcctcgttctcggccctcgcgcgctctatttttttatgcgaggcgcagttgggagatatgacctaagggcactgtgggggtatctctacccataagctttcttctgctgaatacctctgtacctaggatgtttatgtgacggcagcggccgctcacataacatgcacctatcccatgatacaaac

SEQ ID NO: 19518 - DNA, 480 bp, Homo sapiens
aatcattctgatacagcctcatcaaaactgctctgtgaagttcttggcagggggagtgattgtatgaaaatgaaattttaaagtgacttcatcaaagggtcctgcttccctcactatagagccatcacttgtcaacaaaaacaagtaggcacaggcataaaaaagagtgaaatcatggcctctgcagcaacacagatgtagctgaagtccggtattctaggcaaattaacgcaagaacaaaacaccaaatactgcatgttctcacttatcagtggggagctaaacactggttactaatggacataaagatgggaacaataggcactggagacaactagaggtaggatggacagaaaggagataggttgaaaaactactattgggtcctagccaactaccggggtgacggatcagccacccccaaacccaagaatactgcatatgcccatgggcagacctacacttggcccttaggaagta

SEQ ID NO: 19519 - DNA, 1474 bp, Homo sapiens
  misc_feature (1)...(1474): n = A,T,C or G
cacactcatacaacgactcatcgtataggaaacgcgacacatttgtatcgtctactcacatacatcatctgtacnancataacacactgcgtggggtgtggggcggngggcttattactcgatancttcgtggggacacgatcgcgtatcgagcacatgctcatggtcataatcgtgtgcgtcgctccacataagcgnanagcgtgaggataacaattagnacgcancgcgctgacgcctaatgagctgctcataacacttcgatgtgtggtcgagnctatactcaccccccngcgcncggagatatnataacncntgcaccacngccgatccacactatctcgtgcgcgtcgancatgcacacaacgagtactcagctggagtagtgctcaggagnggcgtatgtgattatggactcgacacatgacgactgcagacgnggcctgtgatcagctatnctctgcctatgcttgtatgtatgttctgattcgcagatcgatactgtcaccaagcatactncacgaacatcacatagatcaggagcggcagcgccgacgcgcctctatagangtttagctctcgacactcctgcatatagtcgcagggtgtatgatataataatgagcgctgaccgacacgacgcgcgngcctcgcgtatcgcgacagggagcggtgcgatgatcgtcggagaataacgcgcgggacgggaagagtaacaactatacacatgtccgcgcgatacttgtgacacccctgacggggcgaggcaatgacagcttcagttgacgtatataatgaacaatacgatggtatcgaaatacgcggtatcaangtgtaggtggaaacataggatatatatactacatgccataaatctcggcgggatgcatcatcgtcgcagtcacagtatatcgcagagtgtgatggacgagacctcatacgggtcggcaagctcgcgctggagtagtacggctaggagcaagtgtatatgacatcgtcgatacgttcgtggtgtacgactctgcaatggatacacctgcaagaacatataaagangcatatntcatactggtattcaaactacagcacaggagttgagcagaacgcggctaattaggcactactgngacactgattactatgatgtacggcgtagaaacgaacagtactaaactgaacaatataaaagacgatcatgaggtagtcgatcacataacagcttaacacattatcgcgttgttgtatataagtgtcagtgccagaccgtcagcggtcctcgccggcagagtatatggctcgcttctggtcgacattttacatataagacntacccgatgtgacatgagtnaacaagagtatcacgggtgagatgagtgagacaatagctcgtcgttacggtgaaatcngtatatagaggtgtatctgcgnaatatcagactgaaantagataggggagctaggcacagtcgcacac

SEQ ID NO: 19520 - DNA, 954 bp, Homo sapiens
  misc_feature (1)...(954): n = A,T,C or G
ctggctcccgcgtctctcccccccctcctcatgttcttacaggttacctccgagactcgtaaacccttaccctaaccgctccctcgctactctcgaccccaactcaaacacctctagtactaaaggcgctcttgtttttatctccccataccaccccccccacccgcgtgccgccctcgccccatctccctaccactcccggctcgtcccctttctctccctcgctttttttgatcctcctctacctggcctctctcttctcccatcaccgccccctccactttctacgcgcaacccctcgggcccccctttcttctttttctttcggcgctcacacatggcacgcccactttctattccaaagccccttcccttcatggtaacacccagcccattatcttttacggtagggcagtttcccccttcttcacctcgtaaatgtcccaaatcgtattcctttaaaattcgccctcggccaaataagcaatgggaggtgacaaggttcccgcttggtgttcccaatgcataaatatgtgaccaatggcccataacggtaatgcaaccaaagctgcaagattaccccccttttggaaggaaagagggggggtttttatgggtgccgatggactattcccctttacccgagagtgaagaccacattgagcttgtggntggcccccccccctggtgcccctnaaaccatttcttgcaatagtggttgaggtgatttttttagtggccaccattctgcttcgtgaaaagtacccacaaaagaaaaagaagcactcagatgaggggaaagaatttgagnagattgaanagttgtaatcagaccacccccacccgtatagaaaataatgtccccaggcatagaaaaaaagtaagttacttctgaatgaattccaaaaaaagggatgcggcagccnnccnnccctctcaaccccccccgatccc

SEQ ID NO: 19521 - DNA, 833 bp, Homo sapiens
  misc_feature (1)...(833): n = A,T,C or G
caattttttattcatttgtctagaatagagtactctcgttgtcagagaatcattagaagatctgtaatatcagttgtataggcggatagataaaaagaaaatcgttgtgatcagattatgtgcgacaaaaatagaaataggataatgaatgcactgtaactgggggagagtctacggactgtggctgggggacatagaaagtagggaaggtagggagaggtgtggtgtgttgtgagcgtgttgcacacacaaaaatgatganatacgctaaacaagcaaaaaaaaataaaagcggaaaaacaacgaaaatatacgtcagaaagaagaggtgataagtatagcttaaacaaagggaagtaaacgggagaaggcagaagcgagtaaagatagaaagagagagggggagagtatgacgcagaggggcgggtgggacgatggggtaccgtagtggggaggtagtcagtcgcgacatttggttcgtacaagaatagcagaggactggtagttgtaaaatattgttacaataaagactaaagataactaaaaacgatagatataaccgaaaataggaaggaggggcttcttgttaaaaaaacccctgggcttgtttccccccaggctcngcctcccgtgcgctgggtgccctcgttcggcgccctccctgcggcgctgtggtgttcgcccctgcccttttcttgtgtggtttgtgttttccgccgtgtgccccgntccctttctcccnncccccctgttccgctttctcttcnccctnnttgtttgntctggttttggtntnccccctttaaactgtggttncgtgtnncccncaaaga

SEQ ID NO: 19522 - DNA, 1928 bp, Homo sapiens
  misc_feature (1)...(1928): n = A,T,C or G
gtcatgtatgtaagancaagcacgcgcgaaccagacngaagaggtgagactcgacgatgcgctcnggtgggtgggaaccaacggagacggaggagtggtgctcttgcatcacatacgtcacactgctgagcgctggattgcacactcctctgagctcagtaaacacgcggagcgtgctcccactacctacgcgccgagatgcgaccgagaatgttccatctactctntcgattggtntngtatctgtcgtccgcgactgtgtgtcactcagntcagtcacgtataacagtctacgactgcgtgcgtcgcgtnagctgggntgatcacgcacgtggacgacagtcaacgagacaccagagtatatcacactatttcngtggtacacgagatcacgcagagagcagacanaaagagacaatcggaaatagaagagtgcgcagagtgagcgcgcangtgcgtngntggctcacactatactatgtgcacagactgantgcactgtngnctacacgacgagtacacgagcgaacaacacatacgctcgcggtgacnacaccncgcgcacttcactacgagngtcgtcagattagactagcatgcgtcgcatcggncgagccggtcancgaggcacgtccacacacaccgcatcncggtcgtgctggcacgcacatctcacagctatactgtactncgtcantactgcgtcacgcgcggacacacgtgangcggtgctgcggtcgacacgcaactctcngnatagancntcacagacgancntcttantgtgatcgacngcgngttataatgtgtctgatcacgctcaaagtctgctcgtcatntacntagctcacttgacgcgtacgctcactctcatgtgtgcatgaatcagctcgtnntancatatntgatcttatcatcngtgcatcanacgctgcgtaacatccagctcgtcnagnatcagtatcgcnctgcccngcncgagatctgctacactgccactcatcatagtgancnagtcagctcgtctgcgcacgagagantcntntgtnctacagctcagatctcgagctatncgctggctgcagctctctacgagtagcggcatgtgctgatgtgatgatngtgaggntgatngtgtgtngatgtgacgagagtagaccagtagcgagtgcacactatctaacancttatgncactgcatcactagctaacatagatctactcnctagacatgtacctagtagtgtnatatccgtgactcagtcccgagcanacgacgcagntcgtgtcactatccacgcactcacaatagntcgcgtggagtgatgcatncacntatcactagacncnagcatnacagactatacactgacacgtcagcgcagctgtngntngtgtaggngagtccttcgtcgcctactctagcatatacntgagntngngtcgaccagtgtgacgactgncnctacnacctcnagcttcatcgtagtntagnctgcntggtttnctcnagcctagatgtgtgactgcangacntacatcggntgcgacgcgtaggatgacagcngcgtngtcacagccgtagatctactacanaanaantaacatcangatgntactatgcgctacgtagtgcgtgcagtgcagatgngacagcnatcacngnactactgaactatactacgtcacagcaggcagtagagntnagtcgacagtaantgagtatttcattgntcgcgcactcgctanacgcgangtgcantanctgngtgcgtgncgagcgcactcaacatcantatgctgtgnctgcatcacatcagcctgtncgtgcgcagcagtgagcangncgtgagtcgacngtanctatcntgatcaggcagnccgtcaccngcatnnngntanancgcgtgtcgtgcgacgagcanagt

SEQ ID NO: 19523 - DNA, 676 bp, Homo sapiens
ccttgaggggcgtttaaatacgagagggttgtcaagactcccaacatgtacaagatgggggctggtccgcggcaacgccgggttgttggagaaaaccttgggggacactgttacccctgagcgaagggaaattgtggcaatgccctcttgagaggccccgggtggagactctataaccgcgccaaaaggatggttaaagcttcccactttaggaagaaaaggccccccctaaagaacttgggcttgtaacaccccgaagcttttttggggcgcacgcgttctttcaaaggggggggctttatccaccgtgtctggcgggcgataaaataaaaacccgggatctttttaaggaatggttaatttttccttccctcccgcggggagaaggccaaccagggaaattggccatcatcggctcgcagcggggaaaaaaaaagaatctttgggttttgtgaggactaaaagaaccctctaatatttgtggcccgagaccagaacttgtggtggtgttaaagggcctggcgcaggggaaaaattgttttttaaaaaacaaccggcccctcgctctaaagaggggggggtgaggctataaagcaaaattgccaccccggttgtgggcagggcgcgtaaaacttaaaggggagagcggttgccaaagccgaaaacaaagtcctcc

SEQ ID NO: 19524 - DNA, 745 bp, Homo sapiens
agctgcccgatgtgaggccactcaggcagcttatggaaggatgcacatagtgaggatctgaagactacagttagccagcaagtaactgaggtctgctgacaactatgtgagtgaacttggaaatggatcctccctaagtcctatgctcagatgacggcggcccctgaagaagagtttgactgcaacctcgtaagagaccataagccattaaaccatccagctcagcccctccgacttccagccctgtcaaagtgtgtgagataataaatgtctgatcttaaatggctaagttttaggataatttggtacacagcaataggtaactaatatattacaacaaaaattcttattacttttctgtggagcatgtttaaaaatagtgatcataaagtgtttttacgaatgcttgaaataaattctagagatggtctcccttaccaatggagtatctcccagtaaacttaagatgcaaatttgtgagtttctaaaaaattgccttttcacactaatttcaaaattagactggaaggtgagcaaagcatcatactgtgtgtacgtatcattcacagctggcttttttctgtgagtgctatctacaggagaccctgcttatccactgggggtatgtggcaagacccgtgatagattctgagatccatggatagcgccgaacgctttttgtaatgaggaggggcctgtgtttacctacagtaaagggtgattgataaaatgggggcgttgggag

SEQ ID NO: 19525 - DNA, 274 bp, Homo sapiens
ttttgtatgaaagttggtatgttctcccatccttaaatttatttttgagccctgctttcgatgaggaaagctctagaaagtcgagtctcagaggaaatggtaccaagctaagcagagattctgttgtaggagctggaggtatatagtagggggtggaattatttctggctcagttcatcttctggaaagttaccgtattgcccaatgtccggggcccaaagatgccggtgaattcagacttgattgaaaaccactgctatccaagaagctcagg

SEQ ID NO: 19526 - DNA, 465 bp, Homo sapiens
gcaagtcgccaaactgaattcctgagattgaagcttttccatcaggagctttggttggattggcatcacagtggtttgggtaaatccccgtgatgttactgaaacaacgaggatcatctgctgtgtgccaacactctcaccctggtggggagctgggtttattggttaaatttaattaagcataggtttagatttctgtgaccaatctgtttatattccagtataatcagccttcttgatgtgctatttatttaatcaataaagaattcagaattgtagagttatgaaattttaaaaatatatttttaagcagttttcctttcagaacactcaatcataaaatatatctaatagatgccattaatctcattgtaactaaccactaaatttctacaatgcagtttccttctattcaaatatttgcatgacctggaagctaaaataaaataaaatgggatgcggccg

SEQ ID NO: 19527 - DNA, 518 bp, Homo sapiens
gcgctggtcagcctacacagcgggatgtttttttttcctatccagccccttgcattgatggtcataattcttcagcagtctagccagtactgtcattaggtagtcgtttcgtttagtcaccagcacacctacgtatagtattaggtgttggagccataccgcgacctcttgctccaagataagatacatagaagggaggcccgtttatagtcatgttcacatgcactcacgatattacggttttatggtgtgagtgcataggtcctcataggatacagtaataacatatccactcgttgcacatcttgagaattactgagcttagcaatagttcatacagtttgaacgatccgcctattatgtgcacggtccagaatctaacatgtgtggtgtagcgtcgggatagagactcaacacgcctgtgatggatcagggagcacgttcagactgtctatggcatgctcaggcacgccggccattgtgatagatcagctaagctttaccgatgttacaacaag

SEQ ID NO: 19528 - DNA, 744 bp, Homo sapiens
ataaacatacagacaaatgtcaaaaaacttgataactaatatacaaaaattatgttataaaataaaattaaaatataataaaaaaattgttatctgctaaaacagataaacaaaacaaaaaataccattataaataatatgacaatatagaaaacaatagactccgagggttatcgtataataaagaagtttgggtgtttatataattggtaaaatataaaaacaaaaaatggggaatagaatgggtacactcagcccaacgcatgagtgggagtaatggaaagatctcttttccttctactaagacaaagtactaataaagaaaaaatattgacgtattcaaaaaatatattcaggttgatgatctccagttcagtctttgagaaatttattttagacttcagccaaattcactgtcttaattatggaagacttgctagtttaataaacctactctacagcccactgttcagtctttgacatcacaattctaatatagccaggtccaaaatgcaaatggtgccatctacattactaccgccactccagcagcactgttattaaattaatagcacagtctgcaagaaaaaaacagcagggacccaaatggtgtggaactagttgagtttctgtttaaccttcagcagatagaaacacagagccagttcagtcatggttcgcttagtcaatccgtactcaagagctgtgtccaacttctttagtttgtattttccttcaggtgtt

SEQ ID NO: 19529 - DNA, 511 bp, Homo sapiens
aaatatacacagctccgttcgaactcaacaaacacacgcaactcgctactcgtcggagagttgagagcgaaaatcgcttatactacgagcttcctctctagatattaaagaaaaagtcaaaaattaaaataaatatcacctatcctctattctaataatgtgtttagacaacgatatagatcaaaattacgatcagtcagtttaggtcaccgcccaccattttggaactcgcatccaaatatttctataaactctctattcccatagaaaacgtttaacaatttttattgagatacacggacagcggttattacacaatcatctaacaaaaatctaaacaacatactatctgattataaactttagcaatttaaaaatatttgcagtatagtaacaaacctcctatcccctcgcatccttgtgatgcgccaacatacgtatgacacatacagcgtggttcgatatagcagatatttaaaaatccccacaaatccctgtgtaaaaaccaaat

SEQ ID NO: 19530 - DNA, 940 bp, Homo sapiens
  misc_feature (1)...(940): n = A,T,C or G
gcgccagaccacataacccacaaagcgaccacaccgccgctgtcatcgcgcgaaggcataaccccacacgagagcgaacaacaacncaaaaaatttccgataccgcacccggcggcaccgggggtggttgtctcttccactgctgtctgaccgcacactcaggaaacagcaaccaacaatatcccgaccacccacaacgagaaccaaggcgcaccataacgggtacgagaacaccacagccggcgaacggccccgctgagcccccacatacgaaacgcacaaacaccggcgagcaaaaacagattggacggaataaaccacacacacaccaaggaagaaaacaagctcaaaacacgggcccacaccgagccaccgggcaaacactcttactcctatccaccttcaatacgggtcgggggggacaaaaaacaaaacagaccgcctacgtgggtggtgtgttgcgcccccaacgggatggatctaagtacctataagccatcgccaccacgggcgtcaccagtttattaaaaacccaattggaaataacacaggggaggaaaaccggagaatttttgggcaaaaaggcgtatagaagataaaatgggaaaagaagaaagggttaatgataataaaatttagaaactaagtgggagtcccccccccccataaaccacggttaaggaggatttgccagctaaggaaattgaagaaaatattgatgagtcaaaggctggcaaaatcccaaaaccagggcaaaggagtggaagcttnttttgtgaagccaggtggaggcnttacctntttgaatgcaccacccccacccccctggatttggtgtacaagcaggcctttaatttatattgaactgtaaatatgtcactagagaaataaaaccggatgcggccaaccnnnnnncctttttcnnnctccccgcgaaaac

SEQ ID NO: 19531 - DNA, 905 bp, Homo sapiens
  misc_feature (1)...(905): n = A,T,C or G
gtgataccctcccgcatggaggnttcagcgcgcagagaanaggaagaaggaggggagctagnncgtgcagtgcactnctcttgaatctttccaccgctacagagattgcgtgggaagatcaaggaagagaaatgaatttatatggaagagaactttgcacactacatagccctacacagaacgcattattaccaagtcttttacatttataaagtgctattcaaagcactcgggccttaaaatacaatgtcacaatcaccagctaaggctgaagattcagacacacaacacccgcctgtttgaagctcgtgtttaggaccccagcctgggtgacagagagaagacttcctggccatgaacaggaaattttcgctggtgggggtgaacccacatccgcggtgtgtgaaatgggaaaaagatatttccaaaagataaatttcgttctccggacccaaactctcacacgtaaaaaagactttggggctgtgactcgtggaaactaggccctcccaaaatttcttcacatgagaggctgtctgtgcatatagagaactattaattatcagctccccggtttcaacggattaccccgtcatgtctgccattagacccacaagtccatcattttttgcgaacactggcacgcgatggagcaagtatgatccttaatctcgtttcgttccaagactcccccttagtattgtcgtttcacactgcatacctgaactccttataactaatagagactgcaagatgctcctccttcgtgatagcctcgtgatcttgtaaccgtccagatgcaagcgganagagagcaaggtgacgcggattgtgcgggatctctcatcagtccttcgccgctctttcccactctctggcagccccgatagatcgcttgccggcgc

SEQ ID NO: 19532 - DNA, 1717 bp, Homo sapiens
  misc_feature (1)...(1717): n = A,T,C or G
ggattctcgcgcacacagccgcacatatatntccgtgccgcacacaatgtgtcagccataaggacgaaaacacgcgtgattaattatgaatgattaagcaagacaaggaacacgacttttttgccagatcatacgcgatgagnacaaataactacgtaccatatgatctaagaagacagcctagaactacacacatcatctcataaagatgcggctacagagccggatcgatgacngtattctctctaccagctaacgtgtggtctcggacacgataactcagcggccactgatatgagcacgcggacagtaggcggtcgcgcccgtgtgaagatccgacgccacacaccatacgacaattggtgtcgcgcgccgctgacctcgtcatcgccaaacagacttcgtatgatctgcagatacacgcacgtcactcgccgcgcgcacgacctacaataaacatctgcatacgcacgcacactaatccncntgatatcgctgatcncatacacccaggcgacagtagcataatagacattgacgagacgagtntcgcgtcagtacagagtgtacgacctcggtatacgncaccacnagacccatcacaaggcagaagagttgacgacgagacgactagtgtncagagctcagagatacgagatcgtgtgtgcgagataagaatcgcacaggctgcatctcgcgtatagatcacactagatacacaccaccgtcgcactatcgtctgagcaataatacagatcctcagagtgaccgagacttcttatgagagccccgtcgntagattatcgatngtgtacgcgacgctgncgctcccacacgcatgtatacctctgcacgataactgctatcatagatatgtacgatatgctacctctccgagaaatatgctacatcacgcgactagccgccgtaatataactagcagacgatcgcggctctacgacgataacctacgactcgatcatttgtgctcacaatacatcctatctcgcacacgcgtcgagagcgatagacatagcgagcactagaagcgatcgacagactacgagacgtgcgatagtcgacatnctagatgcacacatcgtgantacaccaccccaaatcggacacacagcgacnagcgctccgccttcancgatngatgagacactctgtcacatgacgacgagctcgcncgacgatagataccagtactagggtcgtacgcgacgtggagacgctcgatgaattctacacgtacagcgagagcatacagaantatcagagagntgcggncagactgagcagtntacgtactacncatcgacacgcgcgactcggagccacgcgctcagcacgcgtaaatgaatcgtatgaagagcacgcgcgtntcagcatananaggcgtgagatacgaagncgcgaccagcgcnatgctgagaaatatnatcgctatacatccgctatcntactgtgtgaaagtacgatggngagcgacagctgtatagatgcagttncctcgaattatgcgtgacgatacgagtcgagatcggtactcagcgctctcagtgcataacagacgtatacacgatactcagactattatatacacgcactagctcgaccgcgcncntgcttagacagacgacacgtcctccccgatgccacacgccactgacgtaagtgacgagactaagtcgaggcgcgcgagcgacgctcg

SEQ ID NO: 19533 - DNA, 575 bp, Homo sapiens
gtaagatggtgtttaatacaaccttgcggataaccaaggaaaactggggctggcctgaacgaacaatgaaaagaattgtggttctccgggttaaaagtgggaagcggacccacccactgaacacccaaaatgatttttgttagggggtgtcccctaaacccaagcggactggtcaggcgttatagtactgggacaagtgctttttgggctgcccaaacttgcgttattttcttttaggggggggggggacgcccatttctccagtatggataccgcgtagctttaatgccagggggggggttgccggttttaacgcactttttccgctcgcgggccgtccactgtggaagagtcttggcggtccgcgtggtatgttcgcctgcagataaaggacttgtcccgggcgtgctgagggcagagagcatacagtccgccccggagtggtgatgagcggagggatagtgcggtgcgccggctcgtatggtgtggacgttgggtttggttttccggcgggagtgtcggagttgttgtctgggagatttctccccttgtgggagagcgggagttgattttcg

SEQ ID NO: 19534 - DNA, 345 bp, Homo sapiens
ttaatccaggaagatatttttgatactgggaatgacaaaaatggaaaggaagaagtcataaagagaaaaattccttatatttttaaacggcagctgtatgagaataaacccagaagaccctacatactcaaaaaagatttttactattactgagagaataaatcatttatttacaagggattgtgattcatcatcccctaattaaaaatcaaattatatttgtgtgaaaatgtgacaaacacacttatctgttttttttacaattgtggtttattgaatgtgatttttttgccctaatataaattagactaagtgttttcaaataaatttaaattttcagcctgg

SEQ ID NO: 19535 - DNA, 830 bp, Homo sapiens
  misc_feature (1)...(830): n = A,T,C or G
ctatctctgcccctacaggccactacagataactttccaccgagcgggggtttctaacaccacatattggcaccgggaatcggagactctcncgatactccccggaccgagggccagaacgcctagtatagaaagagaccggttggcatacggggacagaagtaatgttactcccccccactaaaaatgcgcaatgaagttatagtctagatccccaccctagaagggaaggttttcaagtcagcctgtggcagttacacaccctgatccgagcagccaaaaatttaatgaatactgtagtggaaacaggacaaatgtcttacattgcctcaaccaaggtcatccgaatccagagtcctgctgggccccggcacccagatgtgatgtgaagaatgaaggctcctgcaaaaaaacccttgatttaaaagagagaagccagaggaaacgtgtgcagctgtcagacgaggctcagctaggaaatagatccatccagtgcaagtcatgagtgctttagagtgatacaaatctactcaatccaatatatctacagatagtgcctatatgactaaatcgtgcataaccacctagctctgttttacagctaaggagttcagtgatttcgctaagctagggtgtttcactcacaaaagacattctatattgggcgctccatcaacaaacacaatactatattctgggtatcatatgcgactgtacatattgtagtatgaggctagcatcctaatcaagttaagataatgattccgcgtgtatgaacagagatgctgactatcgaccagtgtcggttgattgcagctcttcctgactca

SEQ ID NO: 19536 - DNA, 1146 bp, Homo sapiens
  misc_feature (1)...(1146): n = A,T,C or G
tctcaatgttcctaagatgaatctatagaagtacgtcgttgttcgccagactaaccatacacgtatggtcgacgtatacgacgcgaacgattcccaaccccactccatctatgctttcacttccctttatacgccccgtatcatgcgccgctcaggagtgataacatttgagggtgggcagagcagtcgccgctagtattcccacatatcccctagacataaattccggagccgccgcaagataagtacggcctgaaacagttaattctacacccaatagatcagcgctagaaggagcgcggttggatggagtatatttgagtgagtgacgtacacatatactcgcatcactgtactcgccccccctctataagtgtgaattataagttgcgtaccatttattcgcgggtccgtcccgagtaccgccgctgttcgcatctttcttcgtatcccccgcgcgatttagaatgaaaatcatccctatctcacgtgaattcatacgattctatccagtaaatatgggttaccgcggtggcggccgagtatatctatattacctatttatgcgacctgccgccgcgcaccgcgcatcccgctcagtgtcgctgtaagcgatctgatctaatcgcgatatcgattctggattgtggccgttattaacgacgatgagaaccgtctcacagcaactcgtgatatgtgtgacaatgcaatgtcgctgctcagctgattctgagcagcttaccatatgagctcagagatactacatcgtcatagtgcgcactgcagaggctgcgtcgtctncgcacgcgactgctcatttcagatttatgtcgctcataggtcgcacgtgagcacgcgacaatgtaatagtcgtccatcatcngcttagtgtgcgcgactcgcgccatcagcagtgttctgacgacgacagtattttattttattataagagatcgcgagaatgccgcgccacactcgcagcgaataaatataaatactgtctatatgatatcgaagcgccagctaatatatgcatagcacgctgaatatgacatcancgcgcagcgcactagatatatacttatcaacgtaacgagcacggacgatacgtcagcgaccgattagtacagaagtacacgtacgtat

SEQ ID NO: 19537 - DNA, 779 bp, Homo sapiens
aatctttgctggagaggaataaaactagctatcttcaaaacccatgattgatgtcaatgagccaaatattgcagggtaaacatgcaatgagaggaaaacaagggaaaaacctgaattgttacagcccagcttcttgagcaaaacgaggtatgagagcaagagagggccttcgttgttccctttctgaaaatttgaaatctttcaagcactttcttttctgcccatcctttgcacacaatatggaaatataggaggtatctggggagaggagaagtttaaaatgagagtatccaacaaaagctttcctaggataccagtagcaaaatttcagataagaagtcactcaaagacatgcattgaggaccgaaggcaaatgggagataggaaatgacatgtcaaaatgacgctgggcacaatgaagttagatgagcaaaacataagtatcttttctccagcaacataactaagcatcaaagtttaaatgagtcaaaattcctatctgatgtcttcacaaatcttcattcctgagagtctatttggacttatgcttgaaagggaagggaaggtcgtatactcttcttacataattcacttcttcatttaaacataaaattcaccctcccacctcctgggtgggaggcacaggcctttgtttaaaattaaagtcaattttcaaatgactgaccacagtgtccagaggccacatgatggcaaagtgagaaagaatgaagaacttcgaaggtcttcataacagatctgagattgctcctccatgctag

SEQ ID NO: 19538 - DNA, 1080 bp, Homo sapiens
  misc_feature (1)...(1080): n = A,T,C or G
gcagtgtgtgggcgtcagtaggttagagggagaggaggccggacacacattacgcgatcacgcgagcctttcccacgcattaacatactccgacgccccacgacttatccgtatacgtttcgctcgtccgtggtttccgctgccgctgggcattgcagcgcgacgtaccgagcacttccgatcgtgcggatccgccgatcgcagtgggcgacctgatagcccgccataagagccgagctcaatgcgtttgcgatgagaagaagcaaggatgacatgatccacgcccgtataatatagacgtacataagatgcagacatagtggccagcccgatagagancgtgagtcaggagaaagagttatatgtgcagtgtcagtattgtcgcgtgagcacagccactgttatcgccccccgcgcgcctatacgtttaaaaaaggaccgaacgatgatagatggggagcggaggcccgaaccccggctgctcgctaacaagtatctatcgcgctgttagtaatttagaagctagaacggagtacgcgacgcgaacggcaatgtgtgacggcgagctacacgccgcgctcccgnccagtttctatattactactttctcctctccacagcacccacgcacatctcaaccattttccagcgaccgcagtcctaagtcgtactatcgaccgctataccgtctttatcactcgccgtcggctccaacactagcgctcattatctcaaagatccatgacaggagcatcgtaaccgcgagtgccaagcgtctagagtcctcacaatcaacgaacccgagatagtatttgtgcagtgggggtatggttttgctaggggacccacacggctgatgttgatatccattccgatcaatagtcccccccccccccccctggcggatatcgtatatatggtatagtgagcattagcgcgccgcttgagacccatttacaagtcaatgtaagaatcggcagagcccatagagcgcgactaattgtcgagcgtccaccgcgccgtttatatatcgggcccccaccgccttacgccatccgctcgataacaattcatccacat

SEQ ID NO: 19539 - DNA, 842 bp, Homo sapiens
gcctccgacttccctatttagggtcaatgtaaaaggccttttagagatcacagttccatcttttttcaagccagagtgtgttatttttcccctaagggcgatggtttgaaatcggccctaccaggagagggacgctttgactctagggaaattagcaatcacactcctccgagaacttggaaaagatattaccatgcaatacggaaggcttaataaagtaatttatatgagtcaacccttcaaagaatcaccaatgaaagttcagcccaatagattatctgtgaaaaaacatctgcagaaatggcttgacacagatattcatctccacaggaagcttcaggactccttataagaaaatatttgggcaaaagctcaggatcacttttagagagatgcaaaagccacctttttgcctctattgcagccttagtactgcagagttctgtcagtcataatagcgtctaaccaaaatttcctgtgtcctggaatggccctactgctggaaaatagctcctcacttctgaacgtgacctttgccatttttgtgctcagtgatcttgattctgcgttttggggcctgtaggtacaacagtggcctacacaaaagagagaacacttctgccctaccctgggcttctccttttcctttatctcctgggtaaattctctctggagttaagtcattctccctttgttcaaaaaatgtcatgtgctggtaggaaaagcaaatattgaaaactgcaaagaccatgcctacaaagttcctggagattgtttgactgttctaaactgaattataaactagatcacattcataggaaataaataccgtatccggccag

SEQ ID NO: 19540 - DNA, 786 bp, Homo sapiens
aaaccaaaaaaacgggcccttttaaggtttcggggcctttttgaggccctttggccccaaagttttttcccggggtatccccccgtttttgggaaaacccgaattcccccccttaaagtaacaaaaacacctctcccccaaacccaaagccccaaggccaaggaattcagtgaccagggtcattatataacccccccctaaaggaagcggccccaaaggtcccccccttaaggccaaaagggccaaattttttttttggggtatttttttttttcatttttataataaaattttttttttataaattttttttttttttttttttttttttttttttttttttttaagattgtgttacttgattttattttacactaggtggtgggcagacaaagtaatccttaataaagttgacaatcagcttcactcaatatttttaataatgcacattaaaaaaaagtattcatcttacaaattcttctgcaatccaaacatacaatagcttggagaacatttagaaaacaaaagccaatgtaaaaagacagattaaaacaactagaacagtacaggttttatttatatggctcgaattttacagttttcttactgcatcatcaatgtcagaaatctgttccttcagctggctccattgttctggatttaaagaaataccttttcttcctggtttcatttcaccttcaggatcaatccaatattctctaatatcaattagcactttgcctttaaagtcgcgaacactaacgtacctcatttgtccaatcaaag

SEQ ID NO: 19541 - DNA, 1033 bp, Homo sapiens
  misc_feature (1)...(1033): n = A,T,C or G
catacctccctcacttgtcctgcggcccgcgccccctccactcatcccaccgacattcaccgcaatacacctcacctatattacccgcgcgccaccgcactccacgctccactacgctgctccaccacactatggccccactccgacaccacactcccctgggccaccgcacgctgccaaaatccccaccccacccactcctcctcactccaccttctcctgcaactccgccgcccttcccctgccaccgaacacaactcaccagacacaccccccccacagtctctcacacataaccagatgtccacgacaaccctccaccactcaatccgataccaacataactacacttcagtaacccgccacaaccctcctccctctgaaccatctccatgcgcacttcactagccactctgaccagcgcggtccgccgccctaccccgtgcctcaactctgcaggtgccttcatccactccacacatccacttccgcatcccccagccgctagtcacagtcgacccccagccaccccacgacaacagcaccctccatcttgcgcgcagcagatcggaattactctcgccccccggctcctcgtggtccccaccaccccgctagtaagacttattccaccaccactcccgcccacctagcagccagacggtcagggacccacagaccaccccattgtattactccttccgccacaagagtcatatcttcttgcatcctactgttgttgcttctactctttccggggaggcgataatcatgaagcatctccccccgccgtaaaacgttcgagactcacacttttatacgtgagataacgcctgaacctgtgcctaattaaatagttcaggtgggctatgatcaagtgtggtggtgtgacagatcacggtggttgtaaattaagtgacgtgttaagctctcccctccacacagaggttagggagatcgaatgagcatatgtggtgaaaggtaaagattaacaaaagaggtaacagggttagggatgcntctttttgcccac

SEQ ID NO: 19542 - DNA, 818 bp, Homo sapiens
  misc_feature (1)...(818): n = A,T,C or G
cagatggggtctcattatactgcccaaactggtcttnaactcctgggctgaggggatcctcctacctcnntctctcaaagcactgggattacaggtgtgagccaccatgtccagcctactttcttttcttaaaggacaatggattgcagcaattttattaactaggacattattatgaggattgccagagtataaatacagtcgggggagggagcttctnaagaccatctaccaaaaataccttaaaactactaatttcagtctataccctaaaactgacaaatattttttaaaattacctctaaattgcctccatgtttttatttggagattacaaaaatattaacatgtgtggtttttggaataaatattgactaataaaaaaacaatgatccgggccgcttccctttaaggaggggttaatttcatgatccctctctaactaacttccgtgatcatcgagacatcgggtgcggggaaacggtattaacctttcttagaggcggagaactgcggtgtatcaaaaaaaccgaggggaaatcccggggataaaacctgtaaagccgaaggagctacagagtgcctccggacccgtaaaaggcgcgggccgctcgggttgaggcatagaggcccggcgctcatgaagaaatacaacaagagagcgtgtcaaagaggacggggcatcaccatgttatgaataactaaccacagcaacgccgcctgagagacgtagttcaaatgtaaatggggaacgatggaagtaacacgtgacccgcataggggaagccaggggacgagcggaggttcataaagaatgt

SEQ ID NO: 19543 - DNA, 220 bp, Homo sapiens
taaataaataaaatacaattaaaagagtaagaagaaagctgggagaacatggctgagttactgctgcttgtggctatcgaggttgttgcagtctggccgaccaactgatggcagtaaagagaccaccagcagtgacacctgccaatgacagatgcacgcccatcacccttttggtacacaaaacctgctctcaataaacgcctgaactagttggactcaa

SEQ ID NO: 19544 - DNA, 660 bp, Homo sapiens
  misc_feature (1)...(660): n = A,T,C or G
tgcagataacaatactaatagngtgggccccagatgaaccgcctgtgtgngaatcagtcatctgccggagagcagcactcatgaaacacaactgtagggagtcagctgggcgctcggccccgtatcanggaggggcgtagatatgcgcacgagtccgcccggagcacacatagtacgccgggtgtcaaccaatagggggatagacggacgtacaccggatgcgaccccacatatgtatcttttgtattaaaggcgcagtgaagccccaaaataatttacgacagtacgcttgttgtgatgcgcggaggcggggtcaatcaagcggaaacaccagcgccgggtgctcgtcttataatatcggcgctccccggccaaaacaagaagccgccagggccgctcctatgtatatgggggagcctccttctttgtcggaaagaaaaaacacgattgttcttttatggggggcatccgaacaccctaaaaaaagggaaaacccggttcgctttgtttcttggggtcccccccctcccccaagaaaaggggaaaccccacgggttttgtttaaggggacattggccactccccagaatagggggataacccaatgggttgggtttaggggcacttggccaatcccccaaatcaggggaaaagcccact

SEQ ID NO: 19545 - DNA, 1500 bp, Homo sapiens
  misc_feature (1)...(1500): n = A,T,C or G
atatcgcctgcccgcggcggcatctcttaataacatcatatagtggcacggtcgccgatcgtgcgcgcatcagtgtcncnactanagaaatcacngactgtacatgtaagaattgatanggcgatacgagtgagcgtacagtctgntgactgaggcgcgagtggcagacgctctcgagcgtatcgcgtgcgtgcgtcatgtagatacgagcgcttgagaggggtcatcgtatgacagtatagtatcgcacggtggatcggagtcactccatgatgtaacgctctaggacatacactattaacgtaagctcgagacacgtcgaccgtgcagtggagtatcactcatacgcatacacagctcggaggcgtgtgatatagagtgtnactttgacgtntatacgtcaccgtgagaacgtcgacgcgctcgacggncaagacgataagtccaccgcgtcatagtcaccgcgacgtgnaagatcgtgctaattctcgcctggttctctgcatgaactgcagcatgaggtgggctggctgatatgggacgaggaggatgagacgatgctgccagcaggagacgcagagagagagaacgcgtggagcgagggtgagaacgtgcgtgggacgacacacgcgatgtcatcatgtagaatgaagttgcgcgccagcgaggcacagtgcggatgatcacaatacgacgagaagggctgtcacgtgtcgtgttgttatgtgatgctacacgatcgttaagcgtagcgccagaacatgtcgtncactgtgtacgtgtagtgtagttaacgtacgaccggatgaggcgaaagtcactagtgctaacgttatctactcagatagtacancatggtcatctcaagcattcgaacctgtcagctcatatcgatgatctcctgcgctcgcantacgagattcacgtatngtgcacttctaatggctagagctcgtatcgctgcacgacgacgtagtggacgggagagagtgggcaggcgggtcgtagaatggcgatacgcccgtgcgcaaggagggcagtgaaaataagatgctgggcatggaatacatacttatacttancgcagacaatagaacaacaacttaaggcgacgctacacgcagcgcctgtgactgtanagacgtgcatcattacgangattgttgtagttgttggtagactacctcacacgtcgtgnaatgcgcagacgcttaanatgagntcagaaatatacaacaatgacacacgatgtcgtgtggtctcgcctggcagagaaggtaagaagtganaagaatagtcaccctattaccacctctatatatgtcatgtatgatacgataggccgcgnagatgcgataccttacagtagaggatgtagagacgataggatgtgtggtttcggtctgtcgtcatgngagcgctgtgtgagcagttatagttcacccctagccaggctttcttggttgctctggtgtcgaggattgtgggaagtaacggcgc

SEQ ID NO: 19546 - DNA, 676 bp, Homo sapiens
  misc_feature (1)...(676): n = A,T,C or G
ccggtgtgggggaatcggctcgccctgatactcgaccgtaggacgttccacaggaggtggggtgagagggaaagtcggtaatatcatgaaagtcaagaaagggtgttgaaagggggaacggcgtgaaaagggggacacgggagacgagtcccgaatagggcggagcggggggaaaggggggactctcggagaaatgcctgcgtagtcagcgggcaggaaccttctctggggcgggggcagggggcgaagagggttttattggggccactgtaaaggtttattaccaaatggtgctattttcttgtcccagaatgcgtttgggttnagggggaaaggacctgggcccaggtaactttggtgcaggagtaaaaatgttccccaccctgggtgctggggcatgtgttgccacctgaagccggttgttatttaaaggggacaggaaccccctcgggggtattttaattgggtttacccccctcccaatcagggttggcgggttcccccaaaaggggggaaggggaaagggaatttgttttctaacaatcctaaaaaaaattttttttttttggccccccacccttctttttgctttttggtcattctgaaacccccccggtttgtggggtggcccccaatttaaatttttgttcccccaattaaacattttttttttgtg

SEQ ID NO: 19547 - DNA, 311 bp, Homo sapiens
aaactccgtataacccaaattgtttattagaatcccgtgagaataaagacccgtggtgaatcaggatggtttttgtcgaaaaggagcgtcaacacgtggtatagaaaacagattgtgagaggttgtgacaaaacaatctgtgaaattgaacgctagaattttatttttattaacccacacaacaaagcgtcccaaagattgccatcagccggatggaaatactgtgggacaaccacgcattgaccggtggataagcgcctgcgcatagcaaagacaaaaaaggagagggacaaaaataaaaaaaaaaaaaa

SEQ ID NO: 19548 - DNA, 869 bp, Homo sapiens
aaccgcccgtcaatccgagcagacgaaatccagcaaaaactaccgcaaaccggggcgccacgcttaacgccccatccagtatctatactactcaagtcgaaatgggcacaagagaaacgtatggtatgtgaaaaactaagccaaaacacccacatacacgagagatcactatggcgatatcatcaaacacaagcgccacaatggatcacaaaaaagcagcgtatcaagagaaaaactcaaaaaggtgcatacccacaaccaactacgcaccgccacatgcctattgcggggaaagacgtataccaagcgttcccgagaaaggagaaggaaccgcccatggaaaatgggttaccataaaccattgaattacaatctagtgataatgaaaaaaaaaatatccaagagataaataaaaggttgcgcatgcgtcatatcttttgtggaaacacggcaaacgtatcccataaagaaaaatttactttatttcttaaagagtcaaaaacacgcgggataatattttattaacatataaatgccacataaaaattgtacatatatggtatataacgtgatgttttgatataatatacattgtgaaatagttaaatccagctgagtgatatatccaagacctcacatacctcggttgttgtaagaacatgtaagatgtaatctcttagcaactttaaagtatacaatatattgttattaaatgtagtcaccatgctgtataagagtacactcttatttaccctgtctaactgaaactttgtaccctttcaccaacatctcctcattgccccacccccacattggatcatggcaaccacactatgcttgtatgagtttgacttttttagatccctcaa

SEQ ID NO: 19549 - DNA, 600 bp, Homo sapiens
  misc_feature (1)...(600): n = A,T,C or G
gacacacgatatgatgtgtggatataatggatgcagttaagatatatcagcttagggtcatcacaacgagagctaacataagacagaataaggctaggggtgacgacatatagagtgagagggggaaagaggaacggagaaaagagaccataggaaatacaagagtgctacacaggagnnaactaaacgtgtgagtagcataatgaatacagtgaaatattagtaatagtggctaacaagaattaaattacaagagggaacgttggagtagaggaggtggaggaggaaagatgaggaggagatagagagataggtatgcagacaacaagaagacagcgatcagaacagtaaacggaattcgtangagttatnnatttacgacagtattgtgatcatcgagcnctgngagcacaaacatcatatacagtaaagtattatggnntgagtctnctacgacatgtctntcgtacaccgcagcgacttctgtggnngttcacataganttaaagtatatagtgtgtgagatgcgttggctntagtacacatatgagatgtcgnactagagatacatcacgacataaatgataagaggaatataaa

SEQ ID NO: 19550 - DNA, 385 bp, Homo sapiens
atttcactcctgtcacccaggctggaatgcaatggtgtcatcttggctaactacaacctctgcctcccaggctcatgcgatcctcctgctgtagcctcccgagtagctgggactacaggcacatgcctcccctccggctaatttttgtattttctgtagagacagggtctcaccatgttgcctaagctgatctcgaactcctgagctaaactgatccacccgcctcggcctcccaaaatactaggattacaggagtgagccattgcgcctggccttctctagcatttggttttccttgcaagaatctggacagttgtattcagctggtagtttggaaatttactttttaaactaaatgtattttaataaaaatgtgatgcgcccg

SEQ ID NO: 19551 - DNA, 573 bp, Homo sapiens
cttagaaaagcggtttggaggtgtatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctctcaaatacagtgtttaaattaaaatagaaaaataagggctcatgacaagtacattatttgattctacttaggatagctttttagcaggatctccttcagaatttttgtcttgactttgaatctttgcctgtttgtctagacatttgactaacattctgtctgaatttggaagtattctaataccagatttgaataaagtctttcctaaataaaaaaaaaaaaa

SEQ ID NO: 19552 - DNA, 1273 bp, Homo sapiens
  misc_feature (1)...(1273): n = A,T,C or G
caagctgaccgcgaccagtcaatcgaacctagagatgagcgatcggacaagccgaaaagattcacaattcaatcagatcacgcgatcctccgtcccggtcggcagagctgtgcctgacgtcggcgaatgcgtcggcccctagtccacatcttcagacacacatagagaaaacagatgagagacagatgacgccatgggatagtccaggaagacataacgcagtaggatattgccactgtgatgtgctccccacacggatcctaggtcatagcatcacaaattatataaatatcggacgttacacacattgcgtctgctacactcaatctttcatcgaccaggaccctagagtggccacctgaaaaccagcgatcgtccttcattgtaaacataatctcccgcctctggatatagtgngaccatgtacgcgctatctgcccatgccaacaccgcagagaaaacgtgcatcactagtgcgttcctagcgtccggaccatatgcacaagtgaagtcgcacccggaatcatctacgtgcacataaagcacattcgtatgtccctcattcgacacagaaaccacgcactgtggcaggcagctgtcgnacgcgaccacaacgaggcaaggccgcgagtatatccagagataggtctagtatatctcatatttccctccctctctcctcgcactgctcgcccccgcctcctacgtcgccgcgcgtatcgctctcgcgcacgcctaccattgtatctttcaatctctcggcgctgtcgatatagaactcgcagcgatacgcgacgagtagcacccctcactacgcgagctgagctagtaggccngaccgcgctccgatgacgggcgacgttctgactattgtatatataaacccaaccgcgtgccacacacagacacggcacgtagtaccgcatctgtatactatccgcaatcgactcctcacactgtattatcatgctcacncgcgcacccgcgtgtatcgcacacagcaagcggctctccgctcagcgcggtcccgctctcagcgtagcgtaccaatcagatattacatgtcatactaacactactcactcacatctcagatcganangactatataatcacacatatcgcgtcatgcgcgcgactaggtatcgccgtgatctacgacgccgacatatcgactcgcctcaatacgacatagaagtgaagcagtctngcatgtgcgcaccatcacactactgatacnatcatacatatatgatatcacntctagatatat

SEQ ID NO: 19553 - DNA, 491 bp, Homo sapiens
  misc_feature (1)...(491): n = A,T,C or G
ttttnnnnnnnnnaannnnnnnnnnnnnnnnnnnnttttaannnnnnnnnnnnnaaannnnnnnnnnnnnnnnnnnnnnnaannnnnnntnnnnnnnnnnnaaatttttatnnttntnnnntntnnnnatnnnnattnttnatttnnnnnntntnnntntnnttttattnattnnnanncnnntttnnnnnnnnnntttntatattnnttnnttatgtttatatttcttaagctggtgagtgggagtgtttgttatatgatatgttttttgaaatatatccgacttatttagtgttttattattatttactatctttaaaactgcttattggttttgtctaactanattttgtnatttattgttacattccctcattcctccntttttcttccctacccacccccctgaccccccacccccaccctncccccgtccctcaccccccacacccctcgtgaggttgattgcgccttgtggccattgtactcga

SEQ ID NO: 19554 - DNA, 1720 bp, Homo sapiens
  misc_feature (1)...(1720): n = A,T,C or G
gtggaattgtagagatantgnnaatagtagtganattagaagagagagtaaganagtgagatganagattttaaaatatgtgttatagtatgtaggangttnngaagngtantgatnnnagnagtnnttaaaggtagataggtgatgtttgatnnnataatagatattnnnntagaatagtatgttgtagnnaatatntggngtggtgatgngtgtggtgntntaagatgagatgagtagtgagatggtgntgaggagngagttagttagtgtgttgtgagtgtgtatgtnangtnnnatgtgtagaggaggangtgagatggtnnaaagatatgttgcagagatacgagtatgtagattatgcgagnagagattaatgatagtgcccaagtgagtgatgtngaagtcgatattnnncagtagcaagacctncantctgctgagtatacgagtatcgcagtcatagagtgnaacgcgctcnngtgacgggtagccagccagagtgcgtcgccagagcatgtcagagagnnnnacacgcgagagagaggagnanatgttgattngatactgatatgcgaatatgngacgtcacagagtcgcgcgcgacgctgntgatatgtgtaanntagagttgantttaggatagaggactagatcagagcgagggtagctggnnctntantacgctgntgcngcctgactcagtacgctacttaatagctctgctaatatccacacagaggcgagcaacatgtgtacgtacaagatagtatcataagacccnangcncatatgcacgtgntcncagcngagatcacgtatgcctatacgcagactggtgtcgagtcctcaccgagnacgattgnncnccagntcgcgagtggagcgacagtgacacatcngcgcgncacgcacaggacatcgcgcgcagtctagcacacacgctcactcgagacttgagcgtatctgaggacgtgcgctcagtgttncgtctctatgcgtntcacttcgcggacgcgctcntgagtacgtgattcattcgtctcgatctctccactccncnatcgaccacgcgccatattctctatcggtatatcgtttctctgttatatgactcgcatagtccttctcatcgatactggtanctactcacgtagtcagtcggcagncgcgcaacgtcntngtgtgtagtcgagatagagtcgcgaggcgcgatacaccgtatgtgtantnctacgtatgcngctctatagacatatatatacgtgtgcgntgcagtacaggacgttatactagacccncacacaatgtttgtaagggctctacagacgtggttcgagagatgnncaccgatagtacgagtggtcctcgcgcacgaactatccaacacgttcgcagtggcgncgacaggatcgtgtgatctgatagagactactaggcgcaccgaggaggcgatacacaatcagcnccctagcgtcaggtctcctctgcgcgtagtaggctcagttgtgaggcgcnagcgtcttgcacacgagagactgagtgcggagatctgtgtacgncggtgtaatagtgctcgntgagatagacataatatatagtattgtggtgtcatcgttagtgtgtgtcagacacgtgcgtccgntactattctgcgacggtagatatagagtgtgacgcatcgtgtcntatatctgtggtgcagggcgtagtgnagaat

SEQ ID NO: 19555 - DNA, 567 bp, Homo sapiens
catagtcaaaatttggcctggggtgaattcctagccttaacgaaaatgggaccaaaactcgttggctctcataaccaaatatgaagaacatggggggcctttaaccaccctcaactggaaaagaggcagaaggggtcttttttcccaatcggataacaccggaaacaaaaggacattttgtcataccttgtcttgcttctcccgttcggaaaaggggcaagcgcgctaacccttaactcaagtcaataagactggggtattggatcccatagagaagaaactccagaggccgcccccttcgtttttatcagcgggataagtaaattaggcgcgtgtgttagaggaggatgtatcccgtcagttggttatatcgcaaccccccgacccatcgacattcgcggtattgtaattgatgcatatatccctcgtatccatcgaaattttaatatagtgttatttgtgtgaaaacagtgattttcgatcatggtgcctgtttccgtgtgggtgattttttatttattggcggtggaatgatcgatatccggctgattttcatagcatctactt

SEQ ID NO: 19556 - DNA, 646 bp, Homo sapiens
  misc_feature (1)...(646): n = A,T,C or G
caccctaacgccatatatccttattcacaactttattatcactcccccacattgcttccccctcctaaccatatttcaacttaatcttattatccacctctgtacgactccgttcaacacaacctttacagtccaatctcaattaatccaatcacccataatatccctctccaaaaacctccaattattttacaacatccacatctaaacgacctccaataccatccaaaactctcattattcttttctacaaaaccacactaaagaatatacccatacaataaccaattacattcccccccccaaccattcatcatcccataaataaccccattacaaactccatcaattctctttntttttnnnnnttnnnnnnnnnnaacactaaatataaanaaaagaatacaatcaggagaaattcccataaaaagaagagatactctnaataaaataaaataaatacacagaatgataataataagaggngnggngaggaaaaacacaagttacgggggcgaacaaaacaatgttnnntataaccatgagaaattttctaatccggctttcaattggtttnccaaccccaaaaaaatcatatcgcntttataccccccgggtaagtttaacactccccaacgacnaaacc

SEQ ID NO: 19557 - DNA, 557 bp, Homo sapiens
cacagctgcccctcaaggcctcgcgacctctcacctccccaccactgcacaccgggcacgcccatcgataaatacctcgcgccatgccgcccaccacgtgcacgctgccggcccccttattcgcctgtctacgtacacaacaactactccaccctctcctgcgtagtctgctgaggtgatagctcgtatctccgcttaatcacacaccacacaccccaccaacctcggcacccacctaaacgcacgccacgccccacctaaccatctcgctgccgccacgcttagccaggcgcgtcgaccgttatcataagtaactaccctgagccctgtgaggcgcataacatccgctgcccacacactctccgcggcgggcggccgagcgactcacgtcaacgctaccccaccacaccaacgcactcgcaccggcggcaaattcacaaccacaaacaaaaaccatatccccccccactcatcatatccacaacttccgctaccagactaaaaccaacaagcagaccgttacgccacaactacatagtcccaccctcaaacaccct

SEQ ID NO: 19558 - DNA, 860 bp, Homo sapiens
cgatattattcatctgtcccaaaggagcgaggggctacccatgtctgtcgggggcgcaaaggcaatccacaacctgcccatgtgcgtggcaatagggggtagggacagaataaatacctgaggaaggccgtgccctttgggcccgggaggcaaccatttcacaatgcggaacctgtggccgtggagcgttacgcggcctgccgaacaagattgtcggcggggggggggacgtgaaagacgcgccgagtggcgataagatgcgcgctggcgtgtctgcgggccgcggcgcggagcgggccgcgcggcggtggataggtcgcctggctgaccccgagcgtcggcccgcagcgtccgcttcgggcacctcctgggtggtatcccggtaggcgtgaggtcgcccgccgggctccaagtccggttagttcgctatccggcagctagcgcccgagtgcgccgccgcacgcccccattgtacggattaatagcgtgatgccgagggagccttctgccgacctattctcgcccccactcttcgcctccgccggcagttgggttaacgcctcgcccccgccgctattaatgccgataccactgcccccttgagctagtgcgctcatgtctttcccgctgtttaggtaacccgcggcagtatccaagagtagggcccgggccggcggatccagaggtgtggtttcccatcgcccccgcacgcgcccgcgaaaatacggcacttaagagacgcgtccacggcgcgctgtctgcgatgaccgtcttggtttaataggtgcctcctactatccccggtaccccgttcagcgagaagttccgccccactaaacggtcattgtgggcgcggctct

SEQ ID NO: 19559 - DNA, 1475 bp, Homo sapiens
  misc_feature (1)...(1475): n = A,T,C or G
cttcagattacgttcacataccacctctcgtaaccaatcaacccgccgaacttctttatctggtcagccggatggtacccgaaagttatcccacgcgctcgaccctgccagtatcatagtcatcgcctgtcgctctccccgcatatgtacaggatcacgctcgcgatgcgcgccccccagtaaccgcattcccacagctataacgcgtcgcgcgagataccgtagagacctcagatgaccacctttgttagcgcgccataatagctgcagaggatggattgtatttctgaataccccacagtcatatatactagtgcgccccccacttatgatgtgctagtgattgtcgaccgagagaagaagcagtgccgttccagacgcgagcgcacgaagctcgctgtatatgtggccagtaccgatcattcacagcggtagtatctcccgcgacgaatattatgtccccgcgccgccccgcacacgattatgttgtgagtttaagtgtcgcttgcacggactgatctctcgatgttcgcgctcacaaagtcccgacggcgtattacgcggcgaacatagntattgacagtagaactctagcgccgttctgctctccatcagtgtatcaatcaccgcgtggtgtacggcatgtcagatgcgcgcgatgntatcagtgcacgacgggcgaaggttactactcaccgccatcgccagagcgcgcgcgtataatattcatatattcacacatattagacacgtgtcgcagacgctcacgcacatcgccgcacgtgtgataccggactcatttgatagcgtgntgacgattctggcttcatgatgnttccgtgggtnagcgcgcgccgccgtgcctctctgtattgaattncgnngngncgcggnccgccccgtctgcggtgcgcctatcctcttcccgcacgtctcgattgagatactgaatatcgaggtnnnnngncgtaatcactgctgctatcctctctaatctcgncggngntgcgcgggcgggcgcgcgggngnnnncnnncgcngcggcgccgatcgggaatatcacgatatagacgcagaagagagtcgcgctgcctcatgacacctgtctatagtcatactgcctgtgcacaccgtatcgcattttgtatcgtccgcgcctccactgtcacaccgcagtatccgagcgattgctatatacatnatatattatagtctatngaatcgatgagtcacgccgccgcgcgattctcgtcatcagcacgacatgttcgtcatacacnagcagatcatatacgtcctacaccgcatctacccttctanagtctcactcgacatgagtgatagtgcgaccagcgacgcgctgcgcggagccgtgtattatatcgataatctgatcgtccgncagccacagctgaccatgatcgagcgctctcgcgncgcngtantaggagcagcgactcttcgttcgccagagt

SEQ ID NO: 19560 - DNA, 795 bp, Homo sapiens
aaatattatctcatctgtgccaaaggatggaggggcaacccatgtctatcgtagtcacaaaggcacattcaaagctgcacatgtgcttggacatagggaatggacagactaatgaccgaaaaaggacgtcccttggtcctggaggcatttgtcaaatatcaaagcatgctccaaaggcgtcccatcctgctgagaacatcttttagggcctctacatagaagtatatccagtgacctattctgccactgtgggctctaatgacttaaccaagaagactcatgtggtagcgacttgattctggactaaccgtggacctcgtcttccttgtgtgaagtttaccatgactgccatcacataaccatttatttaagtagtgtgaatacccccactgaataattcacgtcatagccacacataaaacctgtttttagggctaactgagccaacccctacaagaacggggactcagttgttttaagcgcttctgggtccgccaggatctgtgattcgtgcagaaatttatattttcatgcacagtcgtgagaacttagttattatctctgtcaacacaagttcgtgctaataatggaaatatctttttcctagcacattcgtgtagagaaggttgcctcctaatatccaatcctgttctcaatgatttggttttatttttattataagagcgggcctcacgaatatgactccgtaaggtttgattgcctcagccagtaactaatatcacttcggtatatacggggtactgtgtttcgctcgataaccccatcctgttacga

SEQ ID NO: 19561 - DNA, 836 bp, Homo sapiens
catatctgttctatggttcgactatacaaagctatataaacaagcctgtgtaaagatcagaaatatagcttatgattgtatacgaaaattcgaattagtataagaatactaataggcctatcaatatataaaataaatagtgtgctgtacgtctgttagggcatatatatctaacctaagagtcatcaagggtaccagtatatatggttaaagcgtgggctggtttttcttgtaggagtgactatctaagctatctcatcacctatggtaagtagtaagaaaaaaccctttcgatgtgtgtcttaatagatgtacatttatccggttttgagaggcctctgggcagacatcacagcaactggagtctgtatcatttcatgtttgtttgttagactggtaggatgttatttcacacagtcacgctaagttgcccaggtggtagtgcagtggcgtgatctaggctcaccgctagttccgcatgccgggttcactccattctcttgcctcagcttctctgagtagctggcactacaggcaccaaggcaccaggtccggctattttgtttgtctttttagtagattcatggtttcaccatgatggccaggatggtctcgatctcttggcatcgtgatccacccaccttggcctcccaaagtgttgggattcaaggcgtgagccacagagcccggcatcagtgccttttttaacttgagggtgtagaggtcgtccacgcttgtttgcttgaaagataatataatacatgctgtctgaacaggtttaagtgcttgctttcccagtaaaggttaattatgataataaagagagatgcagcgcg

SEQ ID NO: 19562 - DNA, 1247 bp, Homo sapiens
  misc_feature (1)...(1247): n = A,T,C or G
cacacttcatacgnatcgccgtagagcgcggtgnttgtgctccatgcttctggacggtgtctcgctctatgtgaactctctatacttttgngatgtactacactattnagtactacgtgtctcctcttatnntantcattatagtctcttgantnttcatttncngtctaatcattcgcctctaatgtatgtttcttctgtgnntcncctctcttctgngnatcgttatctctattagagcgcgcgcgtgacttgngagtatctactctcgtgctgctctnttaccgtatncctcctctatctgtcgcgttangtctatcgtagggagtctaggactgtagtgtgnagcagagtaacatatacgtagagttatntgtantnnacatataatatggcgcgccatcattgattatattntgtatattncaacatatantgcanagagacgttcatggtgcacgctggtacgtggacgncctgtgatcgtctattgtngttagatcagttagttagtgtatcttctcgtacnggcagnggaagttattacttcgttgtgttcaggtatcgtctgtctgtggtgnngagtggaccgatgattcgtgtgagactcaccgtcactatgatgactgtgggtaagtccgttgtactctaccgtgttgtgcaggtgtgttcgggtgggtagacgcgacatagtgagggggtgacttacctgttggcagatgganatggtttggagcntctcttgccttctcactgactcgttaattctcttgaagtcgtctcttggntcgattctctttttttctcttactggagctgatttttgttctggtgtcattcattttnactctattctttgtacattttcttgagttctctcttttcttgctcggtcttcttttaaacccgtcctcccttttttgctttttttcttgttcttctttttnncttatttnntttttcttttattttttcttgttnttttttgnccctcctatttatcctcccttncggccgttctttttctctcttgaattctccttcttttctttttttttttttgtcttcattnatctttctttttcttttnntcttttttttttctttntctnnncatnnnncctttttntnattnnnttctctttcttttttnnactttctttttaattttttctnnnncctcttncaaaantttnttnncttttctntctttttctctncctttttccttcctcctttctccttcc

SEQ ID NO: 19563 - DNA, 750 bp, Homo sapiens
  misc_feature (1)...(750): n = A,T,C or G
aaataagacggtaggatttttcctaaaccatccacaccagtacaatcttttacccagtctcagccttcagctaagtcgcatttgcacaccagcaccccaatttcttcttgcattgtccatctagtcagcccagtagttcacgccatcacaggtagaacagatggttggctcattccagactgggttcttcatgcaatgctttgtgccaccagaaaggtcagcttgtgagcatactcacatggtgctggcacactgactatgcccggccagttgtagtacaggtggcacaatttgaatgtaagtctctgcatatggtcgggcttcaagccgttgacatcatagatgacattatagtaggtaggactaacagttccccggcaggccacctggctgatcagataaaagtcataccattcgttacgcgttgcttctgaatccacaacagtgccaagtggggggttctgtacagtgcggttcatctcggtaaagaatcgtggcatgcacttcttcctgaccacaatcaccgacagtcttgagctggtatttgagctggattctgccacactgctcagcagctgtgggacttcatattcaataagtgttttcagctngaccatcccctacaccagcacggtacacaattatccgtgctggcaaatcatgattgtacttgtaccatttgttgagtgctccagtcatgaaaactttcaagcaatctgcaacatcagtcattgttctctaaagatcagc

SEQ ID NO: 19564 - DNA, 215 bp, Homo sapiens
  misc_feature (1)...(215): n = A,T,C or G
taatttacaaagaatggaactttatttctcataagctaaattttatttagttctggaggctgagaagtccaagatcaaggtgttggcaggtttagttgtctggtgagggctgccatctgcttccaagatggtgctatgttgctgcatcctccggaggggaggaacactgtatcctcacatggggaaggcagaagggcaagcaaggtgaangtagg

SEQ ID NO: 19565 - DNA, 1374 bp, Homo sapiens
  misc_feature (1)...(1374): n = A,T,C or G
cgactagagcgacgttcgcgtatacctacctctggtccgcatgacatgtaagaaatcttagtctacatgacttgtcccacgctgtagtgttaggtgattgtcgtcagctagtgtgtgcgtactcgggtgtcgatcttcngactgtctgtctgtacacttggtaagattaataagcatgttgtatctactaaagacgctattgctgtacactgatatggaccaagagtagtaatcagagaactgtgctagtgctcagaaatgagagcgacgctgccggacacaccagtggcctaaggggataactctctcacatgcgctgtcttatcgtcagctctaattcgagctattgctctcttgcgncgcgcggtagcgacgtcgtagagctctcaggcttgggagtcaagagcacacatcncgagtactcgcggcgaggatgtatggagacgctcttctgggcttcagagagtaagtctgtaggagtgtacctgtaatagacggcgttcggctgangtattgtctatagcagtgtttatgtcgtctcgatacggtagtacctcgctggctgcagtcaaggtcacatagtggagcttccttgtatacgtagtagtcaagctatagtgtactgngatctccgtggataatacttgtagantactgggtcttgtcggcgtctcggcggcctttaactccctccgcggctcagaaccatgagaaacaatgttccgtactagccactatgttatcaaagaacacgactcacatacctaaggacgcggcgccatctacaagaccattgcgtacaagtgatatcttcagtgctattatntagaataggagcagagcacgactacatcggtgtactgatctggtcgtccgncggtgacgtagcctcaantaaccgtacccagacacagcaaggcccgatctganggatgcacatctacgtatgngatgtgcctcgctgtgatccgtgactcccttatcgtcgtcgtatttgctagcacctggagtgaacgcgctgcngcgcaccacgtagcccgcagtacacattcgtctatctctgacatgtntatgtcgacgagcgctgacatagccatgctgacacanacatgagacatgagtacttgggggcagccgtgtgtatagagctctctgaaacatcccagngangagaatgatcacggtgcaggcatgctcgttggatgttcgcatacgaatacgctaacgccgacagtcgagacactgtctattagtatacgcttgngctacctcacctgttctacgtgcacattatgnagctcgtatcaatgtgacctgtcttcctcttgtgcggcttctgactctttctgcctctagccctctcttcactcctgt

SEQ ID NO: 19566 - DNA, 1161 bp, Homo sapiens
  misc_feature (1)...(1161): n = A,T,C or G
ctgtcgccgccggtggtcttcgtccgcttccgtcttattcgttccctttgcagtccgtgctcgctgttactccagccctgccatgtcggctgctcctcgcttcctatcatcgtgtcggtctgtcgtccgctggtgtgtttccgcgtccgcgtcggccgcgctgccctgacgactgcgtgccttcttcgttcgctcggtctctggcccgtccgcgcgctgctcctctatgccccttccgtccgcgtcgctcgtcgttggtgggctgttggttcggtgcggtgggtcctctgtttctccggcctttctccgttcggcgtgtcttttgttgccttgcctnttggggtggttcggtcccctccctcccgcgttgttctccgggtgtggcgtcttgtctggtgtcggcacgcgcttggtcgcttcttggtgtggcgttgcttgctatttggctggtctctcttcttgcgcgccctccgtcctggccgggctgcgtggtgtctcgggtggtggtcattccctcttgcttttcgcgcgcgtctctcgggtcgctctcccgtgtgtcgtggggctgcccgcttgcggtctctggggggcgcttttctctgcttgtctttgcgtgttggtctctcccccgccgcgcgtgctcgtgtggcgcctccttccgccggagttcttcgtctgtcgtccctccgcctccgcgctgtctctgttcgttttgtccgccctctctctgggtgcgcgtttgtgctcttgtctgcgtgttctgcttctgctgctcgtccctcccctctcctgcgcgtgtcgtcgccgcgcgcctctcgcttgttctctcttgtgtctgcctccgtgtgttggttgtagtcggtgtgaggggtggacttggctgccacttttgccggctgggtatctggcgtctctcctctgttgtcctctcttgccctgccttgctccgccgcggctgctcttctccgcgtgttcgtcgtgttcgttcgcggttcggatggcgttcttcgtcccttccgcgtctctgtcgggtctttcctctgctcggacaacgttcgcgcctcttctgttttgcctcccgtcaaaggtcttttgtgtccttctgggtctgctcgggcttgttcatccgtttagtctgttcgtgctcgtcggtggtggcgc

SEQ ID NO: 19567 - DNA, 694 bp, Homo sapiens
ctccgttatattgttagcgggggggttttttgccacaggtttgtggttaagggggggggtttttttttatcccgcggagggggggcatttttttttctttttgggggggcgccccttttttccggaaaatgagggtttgagggtttcaattttcaagttttttgaggggaaaaataaaatggggccccaaaaggggggggagaggaaaatttttggggtctttcagattttgtggcctttttaaaaggggggaaaagaactctttggaggaaaatggccttccaaaattgtggaggggtattccctccgccccttttttagggggggggggggttttaaattttaaagaaaaaggggttaaagggaaaccaaaggggttttcgagggttttttcccttttttaatttccaggggaaatttgccaaaagtttgggggtggaaaatttttttttaaaccattttttttttttttttttttacaattgttttttaaacctgattgggggaaattttttttagggaaaaaagtgggaaaaacccccccccttttttttaaaaagaaacccggttttggggttttgttttaaaacccccccccaaggaaatttgaaaaaaaaaaaaaaggccttggggaaaaaaccccccccgggggggggggaaaaaaaaaaaaaaaaaaatttttttttttttcccc

SEQ ID NO: 19568 - DNA, 700 bp, Homo sapiens
  misc_feature (1)...(700): n = A,T,C or G
ttccctcgtctgtcctactctctcttctctgtggctctttgtttgttccgtcccgggtctcgtcgcgctcggtgcctcttcgtctttcctcttggctttctcgttctcttttcgttgtggttgggtctctttctccttgtctcccctctctgttttctgcgtccctgccttgcccccgtgtccccctatgggggtctcccccgctgccctccttcttcttccgtttcgcctttcccttcgccttcctttgtcccgcctaatctgcctttttctgctatacttcgtctttcctctctgttgtccggcgttcgtttncccttctttgcctggctggccggttcgtgctgttcttcgcctgtggggtttctgggaagccccacgcggctctcagggtttttttcggctttccgaatttcccggggctttctctcaagttttgggggttggggatttttttttaacgcaccgctccttttttttacccctccactttttttctttccccgttgttggagattttttttcgggaaaaagtttgttttaatccccgggtttttttttcaaaaaaaaccccctttttgggttttgttttaaactcccctccccagaacactttaaaaaaaaaataaagggccttgggaaaaacccccccccccggtggggggttaaatttttttttaaaaggttttttttttttttt

SEQ ID NO: 19569 - DNA, 576 bp, Homo sapiens
  misc_feature (1)...(576): n = A,T,C or G
aaggctacggcattggggatgatgaatactcctgtgcgtatgatggctgccggcagctgatttggtacaatgccagaagtaagcctcacatacacccatgctggaaagaaggagatacagtacgatttctgttagacttgaatgaaaagcaaatgatcttctttttaaatggcaaccaactgcctcctgaaaagcaagtcttttaatgtactgtctctggattttttgctgaagataggtagatggcatatcaacgatgcgagtacaattgtggagtcaaaccattatcaagcccaccatctattaaagagagtactttaaatgacctccacttgctaacctttgacgaaaactgtctttgccccctgccccgccccttccgtgtgttgttagccccgtattgtgccgtaaccctcctgttacactttgttgcaattacgtcgggcgccgtgccggctgccggcctcgtgtcacgaccgacggaatgcaggcttcagagatatacaagcncgaacgcgactatagggcgagggtcgtaaagtncagacataatgatgcacatggatttcgacaatg

SEQ ID NO: 19570 - DNA, 730 bp, Homo sapiens
  misc_feature (1)...(730): n = A,T,C or G
tttctcctttcccctaccgccctttcccgaagacccctcccgctcaccccccactccaccccccccgcccccccgcccccccacgggaccactccgcccttcccctcccctcaccggcggccgccccccccacggcgctcccggccgtccacccaccagagttaccctgcgtcaccaacccacctcgcacatagaccaccatcccccgccgccccccccccaccccctccctgttgtgtccttccccccccgcccccgtccccacgagattgttttttttttgaagtcccaaaagccttaaagcaattgtactccaggaagtaccccccgctttgggggttatggcttctcccacataatagaatagtttttaaataaagaatgacttccctttaatagagataaaggttgcaactagccagcataacttgggctgttgcaataataaatgattaagtagctaatttagcacccagaatcactttctctgaacttgcattgatgagagtagacagtgcttgacaccactgatgattgtgtaggaattggttgggtggggtccncggcgnacaagtctgtaaagcagcctttcaaatgtaagcgcagcttcccacttgatctcagtagtcagatgtattctcttactttctgttttcttctgttgtctattttcccctcaaatcaaattctgcaggctgtttgtcgccataataaggagtccgcccaaacc

SEQ ID NO: 19571 - DNA, 1963 bp, Homo sapiens
  misc_feature (1)...(1963): n = A,T,C or G
cntcgatgatcgcacgnntncgatcccagctcgaganacgtcaatggctgcacgaccntctatcatcacatcgantcntgccgatcgacactagngagtcactatcgttcntccgagtatacacatcatcatctnaactacgactaaccactatgntgtgnagacgangtccgcgnagncgtagcgacancagctgtacatcatcancgnatcgcgtgaacccatcactacacganagtgctgtcgcactcgagagtgcgacggagacgtnttgagcntatactatcgntcatcgtctngactgntgtngcgtttagcgggtctgtgntcacgcagccatatgtgtattgatcatacgcaccttcatatgctaccgacacgctgtgatacantcgtggtagcggagcncgcgcgcgtntgngncgtgntcgcactactaatcatatatagattagtataactacttacatacacacgactancacggtcgtagtcatgatactgtagtgagtctacgtatacggtcgacaccagngctcgancagcgancactactaatcgatagcagaatagacgaatcatcattatantagcacntcagcgctgatcacggctacatccattcagagattcactgcgactactagcggagcancactagtcgtcgctacatcacgtagtanctgtgtagcacngcgagctagcagtactgcgagcntcgcatatgatcacgtatcaccanctnanactctaccagtgtcagcgngctgagcaggtngntgactataatcgcagactattatcgacgcgtagacggactatacangntgtcgctctcacacagtagacgtactaaatcatgagctctgatcgcacagtacgcctcgcntctngtctcncgagtcgtgtgcgatcgacatgagcnangacgctgtggtcatctgtanatcatacgctagtcagtgcagcggagngcgttataattagagcagcanatacgngtcgctcgtgtaacagcantactcatactanaatatcatatctgtatatgcattctgtctacgctgtcacatcgctgacttcctcantngantggtgcngagcataacgcgagcacaaanttatcgactgcgttgaaaattatgcgtactgcagatcgtcagcagcttcacgtgtcgatataaatgctatacgatactcgcggatcactctcgcgtantatgagatcagcatcatcgctatcatncggacgcacgtggcggcataccatgtacctctgtgcgcggtatnacgacatcaggacttatacgcctattgcgtattntacgtgctgcgtgtcctgcagtcataatgtatattgctacacagtactgtcgctgantacacgtctgcttctcttactagctacgtctcaattctcacagcgggcgctgtcgcggtatgagtgtgagcgctnattgatagaacacataataatctgaatagtgcntgtctcggtacgtgttacctctcgctgcgtcgttcgacggtacgtagcatctcctccacatgcagcacgctaggagacagtactcatctcantcantcntcgcactactnattcacataatcattctgtaccagcgtgacgcacactagtncntgttgactcantatatgtcacgctcgctatgcgatactcgattcactaacaactatctatccatactattatacgttatagngctcatgcggacgtaggcggctaacgtggaactnagcgatggtgtctagctgcgtatcttactgcgaacanctgcttgaaatacacctcangcggcctaagtcccgctcgactgacgtcactgatctctggcactgtatcggcgaccttattaatntccagctcgtctgtgtcctgctcctatcactctgctctctntcngtgtccgtgactcanctatagatacacttgcggtgcaca

SEQ ID NO: 19572 - DNA, 213 bp, Homo sapiens
agaaaggatgggaaaggggtacaacaggggagggaaggctaagtgagtactctctaccttaagtccttctggccatttaaacagatgtgtataaaagacaggtacttgagatgctgaggcaggagacttgcttgagcctgggaggcagagattgcagtgagccaagatggcaccattgcaagagtgaagctatgtctcagaaaaaaaaaaaaa

SEQ ID NO: 19573 - DNA, 1115 bp, Homo sapiens
  misc_feature (1)...(1115): n = A,T,C or G
ctagggcttcgacgcgtgcgggtaaacgtgtgatctcgaaggcgtagagtgcgtctagtcgcaggctcggctcgatctacatccaccgatatagagcagcggagactaataagagagagacgagatatgctgtcaggtgatcgactgccacaaccgtcgccgacgccacacgcttcttcctctgcctcactcagacgttgtccagctcgggcgtgacagctttcacaccactatagtcttatatactacagggacctcggtgcttctactgtgactaatatgatgcgcccagtagctagcattagtaacggcgcgcgacctgacgacgtcttggcaccacggaagaacgtgcacgccatacgagctcacgacgcgtcgcaggaatccatggatgcacacgctgtatcgacaaagacgatactcactcacgatcgcgtgccgtagatcagcgcaaagtgattcgactcgccaacacatgcgcgtgcagaaggaggaggaggcgaacgtgtacacgggtgcgcggagggtcgtagttgagagaagggagtgcgggtgggggcgagtggaatcattcctcatttggaacaccggcaccttcatcacacacaagtatggagggattgtgccatttagtgtgcttttaattacagcttcggttcgtcttaactttttctcttcagtctcccctacccgacaaacacccatcactgacacgatctgtatacctatccccctcccctccataccgtcaattttgncctggtgagcaattgacataagtgtgggtggtgtggggggaggcggaccgagggatgcgaagatgaaagtcattctaactggacgtcacgcgcatcacgcaaaaaacaaaatcatgtgtgattggtgatgcacatacctagaaatagtactatttctgtgtgatttctgcgctacacccaccgtacctgtcgccggatccttcattcttctgatgtgtgggtgantaaggaggtcctttgatagtccgttgcttatttataagtgagcttatttcgttccccccgccaccccccccccctccccttccgccctatcctncccccctctacttcccccctttncctccccctccccct

SEQ ID NO: 19574 - DNA, 1208 bp, Homo sapiens
  misc_feature (1)...(1208): n = A,T,C or G
gagagagcggcaaaaaaaaaagaaacagaaaggnnnnccttattgttgactgcccgccgggnggctttgaagangggacgacgcgagcggaaaagagagccggagaagagcaaacgcaggttgaacggggagggagcaaaccctgagccaacngacaaacaaaacacgaggaacagaagaacgaaggccacanaacaggcgcgcccaccgcacgagcacacggagcgaggcgcagaggagacacgaagagttaagagaaagacgagagacgacgaccagacagccgcggcggaagacagcaaagagagacaacaaaaattttttctaagaggcaaaaccacagcaaggagggcagcgggggcacaacgccggcgcgaggcaaagagcgcacccgaacacacgcaaaagcgcggaaaaccggggggccacagaggcaaggggggaggccacaagcaagcaacggagacacgcaacgaggaagaagacacagccacgaggacaaaagaggacagaggcaagacaacaacgaaggaaaggcggagggcagaagagaagcgaggggaagcaaacaaaagagcaaagaaacgaaaacacggncgagccagcccaggaggagggaagacaacggagacaggagagagcaaaacgacncaccacacacaacgaggcagcgcagcccgagcagaacgggagacaggaggagaccaccgagaagcaggcggcgaccaaggagagagganacagcagaacgagacggaagcgacgcgagcggacgcgagcgagncggcgaacgaggagcgacaggggagaggaagagggacgagcgggccggagagagagcgaaagagacgaaggagaggagagcaggaggacagagaaaagcgacggcgggcgcgaagcagcaggacacacgcagaggaaggagcacacgacgacgagaggggaggcggacgagaggagagagcagaggcgaganacaagcggcgagnaggcaagaagagcagagaaggagcgaaaggaagcacgacagcncagcagacgagagaacgaggacaggcaacgcngcagaagcacanccacgcgccagcaggagcgagagcgcacgacgcagaggacgcagcaaggagcgagagcagcacggagaccagcagcncagcgaccggaacgggnanacaggcgcgagancnagagaagacgagcaagagcgg

SEQ ID NO: 19575 - DNA, 680 bp, Homo sapiens
  misc_feature (1)...(680): n = A,T,C or G
ctgggctggttgtggcacttcgcgtgggtgtttcctatgtgggtcttggtgtctcgtgctgacttccttgccgcccgcgtgcccttccgtctcggtgcccccggcggcccgcgtgctccgcggtttcttccctctggcgcatcgctctcctcccgtttgcaacaccagggcatttcccggttggcctgtagtttccgccgccgaggcagtgtacgactccgtccgcatattcctttctgctcgtccacggccctgcgtccctcctgcttctcccccttctcttatttagctctctctgtcggaacggtcctcttttcctcctcttctttcgctgcgccccgtctatcgcgcgcgtcgggctgcggtctgtcttcctcgtgtcacccctgctccagttaccccttatcgctttcatgtgtgctcggtgtaatcgtcgcccgttatcgtcggagtgcccgcgaccacccctagngtgctgcctcgtctcccgtccgtcacctcttccatgctctgattttatctggattcccgtgtagtgttgccctggcggacggtcttgacgccgtggcgatttacctgatttggtcactgtcgatgtgttgtccgtaagccgtgcttgccttcgcctccacctcctgtcagtcatgctagtctcgcccttttctcgtactcaactgtgt

SEQ ID NO: 19576 - DNA, 834 bp, Homo sapiens
ggatcccgatttattccagtgaaacaacaactggaacttcaagtaactcctcccagagtacttccaactctgggttggccccaaatccaactaatgccaccaccaaggcggctggaggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgcggcaaggcaaaacaggccttcatagaatctactaattccacaccttgtattgacacagaaaacgttgagaatcccaaatttgattgatccgaagaacatgcgagaggctccactcgatgatgcatgccactcctacccccgctcgagtgtcatgcacacgatgaaggagaggcaaccatccaccaccccccccacatgacctgctcgaacgcgccctgcgcatccacccccctccctccctactctgccctccccacggctgtgctttgcccagcgtcttctctcctgtgcagcccccacccccggctccctccccccgcgcccgctcctcctccccgcactccccgcccgccccgactcccgcctccctcgcgtccctcaccctccacctcctgcccccggtccgcgcgcggccaacctgcgcgcgtcgccctcggtcgccctgacgaccccccgccatcggcctcgctccgtccgacctccggcctcccccctgccccccccccgctcctatcgctactacgtctccgtccagccgtcccctacgtccccgacattcctatcgcgtcccgct

SEQ ID NO: 19577 - DNA, 1765 bp, Homo sapiens
  misc_feature (1)...(1765): n = A,T,C or G
ttgcaaatatgtgtaagaagacaccagcctannatttataatttatatcaaaattgcactcngnnnnnggngngnggggccttagncatagagcaggaaccgacatatcttcttttattaattatatttatacaacacaaacataatcaaaacatctagtacgtatgcaccntacatactacttgcaccatgatttgatgaatgataaacatacataatacacanttatctcaacaggatagagaggtgtcgtcctancactctctctcgctcacgaacacacacatcntctatattaacaccaatctccactctcaaacncaccctcttcgattctatcgtatttgtataattaattaacatgaatattaaactaccactctcaccacacncacccgccccgccataaatacaataacatcaagtatcatcatacancacacntgatataatgatatcctcncttctacctactccgtcctacttgccnacacacattctatactntaaatcgccacgcgcacgaantaattcttngtntatgttcctgttatcgcgtatggatgaaggtaccacgcgcgcacacncactccactctccacatatcatatgtaataatancgtccgcccccactaatatatacatatctcagcgtatactctctcaatctccatcatgtatttatcatcatctccacacgtcgcgcaccacataagtcatttatatatactagtattatattattatatatctctactcatatatgtatatcgtactaaacgtaatcatctatatactacctaccactacacactcgacattcacgcntactcatcancgtattgtgtaatcacatctactcacctctctattatcataacacacgtacccgtaatatanatctacatatcataaatcagaataacataactacnanacataatacatatatataccaacgcactgtgattatataccatgccttatgtaaancacatcagtccacaccaacagatacttatagtnatccaactacggaacactgtgctggtacacttatacacgatatgtatncatcacgagacatcgctactgantaatacgaaattatctcctatagcgatacangcacancgctgtattntagtgcgagttgtatntctntcacattattctgtcaaangacatcacgaagtatatctattctactatatctatcatatatcatgtgtancagtcgacatactagattaacttactatgtactcgttatctntctacacgtttatatcgatttnctcactatcatcatactantagcatctcatcttcaccatctatgacacatatacaaagatatattatagcacaatacactgatatatacgactcactccacccacagctccgcgcactgtaacacccgataatagtatatgacantgacacatgcacgctaantgatatcatgntacatattgcactagatccgcagacncacaatngatatgatacactatatagctctctgatctagcatattactcgccgcgcacgttctgcacactacgtctacacgtactccactcatattaacgatatcatatcataacgcntctcagccatagtgtatcntagagagacacgctacgcgtgtgaccatattataaantacacntatatagtatataaatatancatctantactacttataacacgctcgcatgcnatacatacatctatcatcatatgtcttatagtt

SEQ ID NO: 19578 - DNA, 1217 bp, Homo sapiens
  misc_feature (1)...(1217): n = A,T,C or G
cttttatatcgtttttatataatttatacancncnnnggggagctagctgcagtccactcttcttatttattctcaccgctacaccactgagactgccctatgtttgtaagagagaacaaacatccgcgtcccccccacttggtttttgtggtttgtgattgaaaaaacagcttcctcccctccgcangtgaagagaaagacttgggcccccctattnaatttacacataagcgcccaccgagctctccccgggtgtcgacngtctgggtggttggccgtggggtataccctttatgacgcagtatggtgggagaaggggacgcccatccttattttttgtcttttctcttgtgggggggggggcgcgcctcccctatgttttattgctcccccaattacgttatggattttcgcgctcatcgtttcgtcctaccgccccgcaattttactatgtgagagtgagggatgaggatgagtagtctgaggttttctactaccacggatgaagtcccaccgagttaatagttactgagagaactgcattattgttggccagtacgatagttgacactccctggccaagtatggttatgtagtgcacgtatcgcgtcgcggagcaatgtggttgtcgtgtggcgcgcgcatntcatgttttggattggcggtggtgtagcctaggaggtcgggctgagagataggtacgcggtcgatccgctgcgtgaccgcgcggcagagcgatcttagagagcgtagactagatcgtgtagtgcttgtacgtctctctcgttagctctagcgtattcagagcgaattcgtcattgtgatcgatagctgatctatctcttattgcgcctcgtgtctgcagtacacgtgtatggcgcactcgctcatccaggcgtgttctacttctgatacacatgggtagtatgtgattgccgttccatgacccatccatagatagcggatgcagacgcgtggtgacgctcgagatgagagtatgaggggtggtatagtgcacngtgcttggcagacattagtntagttgcgcttgtcgttgcgccgtggactcgtgagcgtgcgtgtacagtttcaagactacagctgtgcgtgggctacagtcgtttgcgtngaaagtgtatgagattatgttagtcataccgatttctgattcctattttatatcatggtaatatcgacgtataggacgatgcaatgg

SEQ ID NO: 19579 - DNA, 1728 bp, Homo sapiens
  misc_feature (1)...(1728): n = A,T,C or G
atgatatccaatgtctgctataatatgctccccacttcagtaatctganaccaaacacactaggagtcttgctcnatatccganatngacagattagtgtcagcgcggtatccgttactcaccangaagacaggatcttatcgtcgactcagatatgaaataaggacatacagagattatgatcatacgtatatatataagtatacgacgaagtagtataatataccgagtcaccacncctcaantgatctgatacacatcattcgcatacggccatgcncgctagtgtacgtatccgcgcagcgtgatgaccgacgcggcgcgatgatacgttanatgatnatctatggatgcatgtagccacgtcaaagactaantcgatcgagtagatcgtggtagncgatcatctccgcgccagtcggcagatgtatatcactctcgccgccagtgagttatatagtattcgcgcncccgcagcagtaacagtcacgtaactccgaccgtatattatcgactcgcccaccacctaccgccgacgtcggacgctacaccacgacagtantatnatgatgtttctaacacgcgtccagatgatgaggagagagcgcaaacagaagacacaanatnattntataatcnatatcatgtcatactatattactaataataatcatgcttattattagcntgactataaaanatacgacacagtgaaattactatgatcacgaatgtcgctagcatctgagntgtaatatgtagactntattncgaatgtgatatgaagagctatancgcagtcatgntcnagatcggctaggnacgtatacgtcangagancagcaataggacgcagagaagtagantgatctagtagatagccagacttncatctctatgagtgagaatgcgcgtatgcatgagcgaggtatagccagtgtacacggagtatcgctggcgaatgtatagtgtgagagtctgatgagctgtgtagttgnatgaggcgcggtttcggcgatcggcgnatacgagngatatggagcgactccgtacgcgatgttagtccatatagagaatatctananatcatgttagtatcgatcgtagatcatagtgtacgtcagctatagcattctaagttgacgcgcgtcatcaagtatgtgntgcgcgtcgagctgttgatgagtganagtcanagtagtcgtatgtatgcgtacgctccatatcagttggccgctgtactcagtgagattcaatgcgagcccgacgnagcgcgttatagtgctatccacttaatcgtatacacattttagcgatcgtcgcagcgagcgcagtcgagcntacagntaggnagtagataagcgntatccacacagccagagcgcatgatgcgttacagcacttgntagtgaactagatctagtgttgcatntaggctcgcacncgagtagcgcgatctagaagtgacggaagcagatggctactgtcacacaacgcactgtaatatgattgacgacgcgccgacctcgtgcaccaagatatatatacgatattacacagtnancngcgcagtactacgtggtcantagtacagtcgcngtatagagcgcagataatgagatctacagatantatacgcgcgatgacactgtgacagtcagacgaatctgcacatacatntataancacactatgtactagatatgcacgcgccgcgcacagattact

SEQ ID NO: 19580 - DNA, 1047 bp, Homo sapiens
  misc_feature (1)...(1047): n = A,T,C or G
cgattaggcaaaaanaaattttnnnnnnnggggactactgcaacgctctcttaaactttctagtgaaaggaacattctgttgtttaattaggggagggatcattttctacgggggcgtctgacagcccacaaacttttttttaaggggacttttaaccaccctccccgccctttttcacaaaattaccccttgaaatggaaaaaaggaagaaaaaaggggcccaaaacacggggtgggttataatttcccccaacactccggtgaataaaagagcaaatccgaggggggggcggcgcctcctcctttgtctttttttccccgttatattttccgtcttgcgcgaaaatttctccggctggcggcgagtattttgaattgtagtaccgcgggctaaagtccgcgtgcgggttcgggcacgggacacgggcccttcggaacccgaggaaaagaaaacaaagatccccccgcaatatatcacctaccacttcgagtcgccacaatagcacacccgcggtcgaaggtacttcgtgcggagcgagtctattaatctactccagaataccgctattaggccgcaagaggagttactcagaacgttaccacgtagtgtgtgcgggtgagagtctaaccgaactccatccccggcgtgagncggatgtagacatgtgagtagaacgagcccgatggtgcggatgtcgcacaacgatcatgatcaaaagtcctaccagcgtatctcgtcgcactcaggctcatttattattgtacattggtcgggacgttatgcgcctcctgtcacgccagttgactacgtagtatctcataaatatagcagtgttgagtttggcagcgaccccgatcagcatacgaggcgaacgtcaggcgtgagttgacttgcgccgcagtccgatgagcgtctgccgagtatgggagcgcgcgaggcgtatcaagatggtgtgattgggagttangtaggtgattggatatgaatatnattgtatttaacgccattcaactatcgtcagtctatcagaaaggtgagttaagat

SEQ ID NO: 19581 - DNA, 1775 bp, Homo sapiens
  misc_feature (1)...(1775): n = A,T,C or G
cgtcgtcntataacgctctgtctcgnggcgaacgcggcacgttgtaacaatacgcgatgcatagtctcatctgcgcntggaatactcgtgngcagtcgattctacacgtgattgtatgggagcttcctctgctatagtacgacgtacgactatcactntactcgtgatgcgtatccacgctcagcttanctcaacaggagacatagcgccgaacgtgctaatacagcgagtaacaagtcaagagtctacacggagtagatcctgcaactgatctcactgtagcttcttagccactgctgcgctacgatctatagcgcagttcgtgctctatgatgtagcatatcgcacatatcgtctttctgtgacgcgacgagttagntcaccctaatgtctacacatcaatgacgtngtatatagagnctgactctactagagtgagtatgcatntgtacacgcagtgccggcgtctnanatgcgtgtactatcatgatgcgtgggtattagcgagtngagatgtattatgacgtgtgttgttcagtactatcgtctcgcatgaactgcgagtgtgatactgtggntgcgtattagtggtgtcggtcatcatgagacgacgtgacanctcatcgtgatgatagagtacatggagtgatgataggatagagngangtcgtatgtgggctgtagtgtgtcattatcagcagcacacgtatagtcatcctgcgtgccgcatctccgcgcgatagtactgcacacgacatactgtctgtagagacaccgatgctacggagtgtatgagatctcgcacgcgtatagtatcntttggctgttcgtgatactacagcgattacaccgctctatacacnacgactaatatctacttacganatgactctcagtntgaagacagcgcgatgacngcgtctgcatacacanacatcgtcacagcgcatgcgctcgcgacactcatattcatacactataccgacacctnatatctacctctgagcngcnctcaacgctgtggatgattcgacaccacattcgtctgcttgctgacgctcgacgtggactgacatcacgccatngtntngcgcgggtctgtatgcgtatatcagcgagtgtacggcagangagcngtcgctnggcgtagtcgacgcgtgtgggaggagngccgnggcaggtcgtgtncgcctatacgttgcgattgaccacgtangtcacccgtgtgagttgttgtgagagctatagatctatgggngtgacangaacatnagagtagtagtgtgtggggatgatactctgacactgcngggctgcgctagnanccgcgatataagtgagaggctgatggtcgagtctacagtgtagatagagagcggaggtggatgctagagacgagcggcagcagtatnntgcgngcgngnctgatgatcttatgtggtgntgctttncttgtcgccgtcaatgcactgctcgtactnganactgtnngctgtagncgctctgtcnagccgcttgttgcgtcgtactcagngatntgatagatannctctgtgacacgtgggtncgcatngacatatacatgngcgatattattnnnccntnatntnttntcnacntccanntataaaaatannnatnnnnnnnnnttcnncnnttnnttnnnntcntnctanctannaccnaanantnntntnantatactcattannnnatannnnaannnnannnannnnnnnnnnnttttnnnnnnntaannttttnnnnccccaccc

SEQ ID NO: 19582 - DNA, 827 bp, Homo sapiens
tctctaataatcaccgctacaggcccactttcaaagtgacttaacttgattttaaatgaaaaaacatgcagaagtgtgaacgcatctcctcaaaggacagggacgtggctcaagcatagtccactacaaccagctagagtgcgttgctctttaaaataggggcgcaaaggtcaagaaaattcacaaccttctaattaaacacctaagtactttggtaagggactaaggggagcgggcctctcaaaccttgggagaatatacaaaaatccatgccggatgcctgccccccccaatttttacacaaaaaaaacagttcactccgcacaactaatgaaaatcccactaagggtaaaaacaagcaggttgaaaaaaaaaaaatttcgggcacaaggtcgccccgaatttatcaattggttcaggccaatgacttgccaagcaacctatttacaggcaggagatctttggagagacgaacactcttcttttaaaaaacaagggagaaagaaagtatttttaaatagagagaccgctagctttcttgtactggggcgagaagctctaggctccggacgtttttgtaagactggctctcctggcgttcctatggtatggcttaggagagagaaactccctcccccaatttttgttataacaagacagaaagatagttgttacgtagatctcgggcgaggaggggcagtggatctttagggaggacaccagagtggatatcgccactcgacccctcaaggcgaaggttggggaagacgaggttaatcaatataaaattcattagatattactcaccaccaatattatttataatg

SEQ ID NO: 19583 - DNA, 1202 bp, Homo sapiens
  misc_feature (1)...(1202): n = A,T,C or G
tcggatagattcagtctgcagacaacgatacaagataaacatcaagcgccaggggtgtttagtcggtgtcctgcgttgaattgatattttgacggcgcgctagtggcgaagatagtatggagtgaaacgccggctgcgtcgatggtttggtaggtagcggaaaatagagngacagatcgtgtacgtgcgagtcgcgtatcgatgtatttgaccagtcggtgcgcagttctagtcacggaattgtaaggtgccgccgccgctcattagcgcgcatatagttatatgtgtgatcgagatcatgatgaagtgacgtagtgacggccgcgatatactgaatagtaagaccacgcgcgccgaactctttaagtgttttgtgttatcggatgtatactgccggcctcggcgatacaatccaatataatattatgctcgcgagtatttccgatagcggtatgagacgtgtcttattgtggtccgcgccgcacagaatatctacggaagtagagtcctagcgagagaggtatattatgtgatatttatataaactgtcagtactacggcttctggatgtaggttactatgactaacttgagatgcgcagtggccagaagtgtcgaaagataggtgtcgaagatcacttaacgtattctgtcgtgttcatgttatatttttgaggagtgacaaaattcattcactgcggacactagttatcgattgtggtagaaatatatataaataaacaatgcgtggagtggtctgcgatgagaggataataacatagtactgtgaaagctcccagtgtgtaagtgtatacgagattattgaaacgacgtgcaacgaccacatggtgtctcattagagtatagggagtctattgaacggacgaatggaaatgagatgtatatatgttgtccttatcatgtaggaggataatcctccacggccacaagtagtaaagctaagagatacgcattcgagtcgtcggtaattgcgaggaatgtcgagactantgcagcgttgagagtagcaaagcgacgcgtatagtntacatcgctactgggtcggattagtattgctagccgagttatgatgatcaacggcagattgcaccatggcgtgcagagcgaagcgcgtgaatntttatattgataataaattattactaaaattataactatattaggatttatgtaatgtgtgtt

SEQ ID NO: 19584 - DNA, 1166 bp, Homo sapiens
  misc_feature (1)...(1166): n = A,T,C or G
atatatcattccagatattacgaggatgagaggngncanannnnacctantcaggaaacaactagtcatggttattaacgcacgcaacaaagcccatcaggttttgaaaacagttttttgtattcaacaaaacggaagagccgtctgtaaaaaagaaaaacccaaatatcgcacctagactgtctccaatatatctggtctattgatgatcctcagaacatgtcttgtgtataacccagcctaggtgcaattgtaggcctggttcatgaatcgctctctgatttctttccgccaattatttcccatagcaatancgccgttctctttgatgtggtgtattgtcccgcaatatatataatgacaaaaataataaattatttattggttagtatgtttgtagcagtaatgtaataatatcggggaccgaagacgcaaactcgcggtgacatttttttttgagttaggataggtattgtgtcagttctctcaattagaattccttaatattgtctttgtgttactcgcagtcgacttgttgtaggagaaatcactctattgatctttattaaaatgccgatgcgcgaccgcagaggcatagtgttgtacgtgagagagagtagttctgcctctattgtttcatgtatcattttgtatagtaataaggtattcttttttcccgtttataatgagccgccgccattaagttcgccaccgtttgagttgcagctgattagtttgtagcttaccacacataagccactncgcgtctgtatcaatcggcttagtaaagtatgtgatatcgtaccgctgatgtagactatattctgagcgtggtgtctgtgagtgagctctgtggaaagggagtcacacatcacggttctgatgtgtacttatatatccactcgagtcactatcctacattcctacgtggtgctcgttacgtcgacgagattcagaccgacccccacataattatatgacacgcgcncacgaccgccacttatatagctatacaacatttatgccaacatcgcgcaatgtcgtaacatatcagcgccgtactccgttgcacactgttatcacgcacactatatacgtgtgnagtatattcgcgttgtgttatatgccatntgtcactagatattcacctctccctcgtcactact

SEQ ID NO: 19585 - DNA, 1641 bp, Homo sapiens
  misc_feature (1)...(1641): n = A,T,C or G
tagtatctcatcgcgctgtgagaagccnatagcgtagagtgtggcggagtagtagaaagagaacgnnggnnnnnnnnnttcttattcgcacgaggagacacagactgaggcgtgagagaggatgtttngagacgctgacaagcaagtctacgtccgtgtatcaatntgaggtgaaggctatatgtagaacgactatgtaggagttattgactatgtacctactataaaggccggggaagaggtggtggcgatggtgagatagaagagctacaagtaaggacaattgcactcgtcgatggattgatcgacaccatccatgggcattcatacagaatccactagagactatatctttatgagttgtgcacccagagtctggaggctagatacatgtctgtgggacgtggcaatatatgtaagaagtcttgtagaggtatgtggctgcgcagtgtgctggcgagtcgtgacgacgcaccgcattatgacttgcagcttcgcggcgaggcgggggtgattgtgctacgctctgacaactcgctctactttgtgagctatgctgactaatgtattgtacgtcgtcagtattatgattagttacgnctacaatcactacgactgaatactcatgcactgctctncataccctcgtatgcagtctgctggttttgctgctgttcgtgatgcgtcggttgaccgaatgagcgctttatctntgnatatctgtaatactgcacatgcatgtcantctggcgtgtacgacagacgctgcgcatcanatattgatacgctgatnttgtcagctgcgatagttcagtaaatatagcacgtgcanatatgtcggtatacagagcgtagatgagatggtgtgacagaangacaatcgtcgatatantagtgtatgtatgagagtgtcgagagatgagacgtgtgtgtacgatctgtgttgacgcgcactctagtcaacacatagatgtnatatcgtagcctncgcgtactgacgncagtgccgcgttngnaggaagtagtattgtgcagtgatgtgtgactgcgtgatcgcagatctcttatgctagatgacgacgctgcgtgaggnacggcatcgataggatcggtgatcgtaatagattgactagcgtcgagtatgngcagatcgcactatnatcagcttgagtacatctcgtagnatacgtatgcgtatagtcggaactgtgaatataatataatatctgatgantaggagatagtagttctaagtgtntagagtgagagcagtagcgtcgagtgtcgcgtaagacgangacatgagctagagaagtaaggacgngntctatatgaccgcgntgcggcactagtgagatcacgagtactgttgtactcatcgatatgtatncagcgctgaatgaagantgtaacagcactagagcagaagatcgaacagtgcgtgtggcacgacntcgtgctttacgtcgcacgtgaatgctgtatcatacgctctcgcagcgtgcagtgtgacgcctcattttatatcgcgctagtactggcgcgnagcgaggacggtgagaatactacagcgcgtgtangagcangacatatacgacgcacaccgctgatatcagacgacgatagagtgtgatatagtag

SEQ ID NO: 19586 - DNA, 850 bp, Homo sapiens
caagcataaaaataatattacgggagcaataagaaacatatatgtatgttgcaaacgaaaataaataaaatttactagctgaatacgtgggtgttatatcaaagagacatacaaatatataaaaaatcgtgtacaaacaatagaggattattatacctaccagaaactgcacgcgcttgttaatatatacaagacatcgaagtagattgtaaaaaataaaaaaagaaagaagaccctgatattagaatccccggaaaaatacaccaaaaaaattgttacaacccacaaagaaagaaaatcatgtttcgaaagggaagttgtttattgtatataatcacacaagtgaggattccttttcccttcaatggaataaaaaatacaaactctacttaaaagtcttgtgtgaagtacatgccagcctacaaaacatgtctctaaccaagtcgaaagagtccagaattcgttcattcactcattcattcattcaacaaatgtttattaataggtattgtttaccaagcactgtgtgttaaggagaagatggtatgaaacaagcagacccaggcctcagggaagagaggctgttacattcagagacaattaccatacactacaatgaatgctttgatgaagggaggcaaaaaaacaaaaacaaaaacaacaacaacaaaaaccccacaacgatgtggatccctccctgtgggggtgaggagaaaggaaaacagcttcagggatctccaagcccttgtgccggccactcttctttcttctcttccttcctcctctgtctttcctttcatccttcctcctcccttctctttggacatcactaataaaaggagatgcggcc

SEQ ID NO: 19587 - DNA, 887 bp, Homo sapiens
taaacgtaaatgtacagcgtgaaacagaagtgatataatgtgataaaatatctcctgccatgtaataagagttttagttacacgcttacacgtttaatctggacggcgaatatcagggggagggggatcgatactcaaattaggcaacatggggattaaagctattcagctactgaagaattaaccgaataaggtagaaaaagtaaatataggacgaacgatataagcattctagtttgacacttctaaatatatcattatattaaaaaaagaacgtcctatacgtatacaggaaaagagacagacattaactagattttccgcattacagaaaggggttaacagaagcttacatgagggattaacaaggatatttaataaatatcgcagacggataaaatcaataggattcacttatacaccttttgaaaaatacgcaatagaatgttttgtaatatggaacattcgataattgtcgtatataaaatgtcgggcaacgaaataagtatgattagaagagcttaaattaccctactttcgtatgataaaggggagctgatggaagaattgaatgttgtgaaggacatgaaagaaaatggtgattaactgcctaaattgagaggaaaaaataaaaaaatcttcggcttggtgcccgactattgataataaataattaatcacattgggagcggttcatgatttcgtcctcagaaacgggctaggaatagaaaattcctgctttctcagtaacatgttttgtgtatttcacaatgtcgtgctaaataaatgtatgttacatttttttcaccaccagaaaatagaatgcaataaactgtatgcggccggcgatatctatatagccgaataatatagacatataaacgacc

SEQ ID NO: 19588 - DNA, 807 bp, Homo sapiens
aaaaggataacaagggatataaagatatataaaggaaatctgcatagtgaagcgctagcaataagggaagggaagaatgctaaaatagcccagataaaagatcctatgctttgaggaaattcatttttagaatggcatgcggtagaatgcttaatcaagataaaagattagtccaagtataggtataagctgtaggaaatattacagacgattatgcactggtagtttttataaggatttcacatattttatacaaatttcgcacaaatatgtataacctactagtataagggactttatatgtaagtattaaaatatcacctaaaatggtttttaaatcggcctgtctatagaggttgctccacacactagtcaagttcaaatgaagtaattgacataacatggaggcattaagaggcagtgtgttttgttaaaagaacaaaggtgactggaattccaattttgtatgtatgacccaggaaaaggcattcagtaaattctcaaggcctctgctcatttctgcaatgaggaaattggacagataaactctaaagtcaattggaactctgatttgctaccttgattaaaaaaaatgccaaagatgatgatttctcttcagttttagtaagtctaatttacaaagaaaaacagcaacatgaaatcatttcgttgtgggaattctttggtctgccatttagaaattaaataaaagttaaaaatacaagaacgccttgttgcattaactttatattatagaatgaatagcttaaatgttgttcttattgttgcaatatttacacttgttgg

SEQ ID NO: 19589 - DNA, 2079 bp, Homo sapiens
  misc_feature (1)...(2079): n = A,T,C or G
ctgctctatactgtacttcgtatcagagacactctacgncagnccacgtacgtcagatagctcgngtcctggtcactacgtnnnacagcatctctgtatgnactgcgactatgacagcgctatatgagcgctgagcctnatactgtataaanacatactagacttaccacgcctgtagtcggcgctnatgtggtcactctaagagtcggcgtatttcgactatctaccngcgnatctacttctcgcancatctgtntatcgccatagatcagttgtactgccacactcatgcatgtgttgtcttatatacatcgtctaccgcggtgcgtatacgacaactgncnacactgctgntnagacttacatatcatantatgcgttntagtatatgtactacttctgagcatatntngagcantgtaggcacatagcatgcagcgnactcgaccgtacaacgtcgtgtctcactcgtctctctnttcntcgcgcatngacagtgactggcgactgtcgaatcgtgctgtgtnctactcacattgtcgtactatctnctctatcgtcgtcactctacatttatatgantggacgnagacaccggagtcccngcgtcttccagataccgcagtggattacaatagtatgtaaccgacnatgagagactgatgtctgtcgatncacncgtgatactnctgcgcatcgtgncgtctactcgagtgntgntgnacgctctacagnatgtagcagtcagctaantcncgatgcatcatctcactcgcgcactgcatcgctcgacgctccacgaaccacgttgactagcatacatgttatgagaggnaatcgcgtggtgccacgagatcgatacgagtcacagccacacgctnatagagatcatactcacgtagatattgtagaatgacagcagccgacgccacctaactgcagggttgtagtcagcntcgtgatcggtatatcagtacggacgcacacaatgaacacgatagtagctaagacaggaatatagagcggcacatctggnccgtacgaactcacgtctcgttctgtntctatccagtacctacgccagagagtgagacgtcgcactatnacacaggagagcgcgtgtctaacntcgtgtactctcctatatgcatgtgtgcgcatagctcttagtactactctatatcactactgtagttaatagagatggagtattgtactagtcacgaaaagaaananagtgacgtaggtcatcatanangactgagacatatcnatctcgatnagatgcacgtcgtacagcgtgatacatcacttgacgtatcgtatagcatgcgagatntagtcatgctatctagtacgtacacacttnatatgacttctcagactcctagctagtngcgtatgtagcatatgtgngncntaacgtacgctatgaagnagctaagcatgagcgagcaagagtcgacgagacgcatcgagngagcgaggngngatgctncgtagctgatatnagctatgtctgnatatgtatagcatcactgaggcttcgatntcntcaactcnctacatcactaagncatacgtaatgntatgatnagtacgcacnagtcacggggtcgatgtatagtacgtngatgagatgagatgagacgatgcagcagcatacgcangtagacagcgatancngtgnntcatgatagattantagtgcagcttngatagnactntattagtagntgacgtgncagtcntgtcngtcgtacacttgctgagtagtcaggacantagtagtggatctgctgtgatgaggtcagtcgangatcgtntggatgaggacgcacattacgcnacgctaccagcatagntagcagtcagctcagcagtctattgtagcnacncgntagtgaaagcntagtatcgtagcactacgnctnacgaacgntcgctaacgtncagnnatgctatcctcggcagtagtnagtcanntaancgnctaaganctgcnnagcaatcagcagcatacncatacagcagtcagcgntcgtcgagcatgagtatcatcgnncntacancaanatg

SEQ ID NO: 19590 - DNA, 1141 bp, Homo sapiens
  misc_feature (1)...(1141): n = A,T,C or G
cttccactgatcctttcgtttgacgagcgcttctctacttaggcgtccgccgcctttcgatggttctacttggtagagcgttcatgcgtgaatgggtagtgctgtggtatgtgtggactcgtcattcgacggacctacatcagcaatcacttatacgcgtctagatctcctgcttcactcttgggcgctgtcgagtgtnccttgctgtggtaagcactggttaactcacgagcagctgtgcaactgtactgtaatactgatgaatctgtctctttctgcgtcggtttcgcgtgtggaggttgcttacagattatgctccgtnctcacctcgcgggagtcagtttgttactcgtaaattgactttcgctcgtctcgcgcggtgcgtcntgtttctgtaacatgggaggctgataacgagtaggngtgtgttgtctgtnggcttccattataagttaagtgtcaatcctctatactgtctaccctccaacgcccgtagtggtcgcatcgcccgtctctgttgctgtctgtgtgggtgtttgttgggtgggctttgtttggggagtgaggtaagggcggggtggtgggggtggggggtgggtggtagttcatgacgtctcgcttattgtgggtcctgtaggggtgtgtgttttaaggatgtgtggggtctttacaaatacgccgtcttcttagtgagttgttgtcgtattgtttgcgcttttggtgctccctcgtcttctgcgtgtgtctgtggtgtatgcttgccttgctgtgtctagtgtgtcgcttttgcgtgtatgcccttccctcntngtttgtcttttcctgttgtttctctcntactctctaccatatgattgctcgcttccctctctcctcctctctttatggaatgtctccttctcttatntcctgttaacatccactgagttacatatgcactagtaggttccctatgcttatcttgtgatagtgctgaagtgtggtcagcgatactacttgtagtcctgtcatgcttgtagttctccacgttacgacagttatcccagtccgtttnnntcctcaacgttttctntcttcccattatatttcnttttttacttcttccaactctctcnaggtatnnatatatatacctttcgtt

SEQ ID NO: 19591 - DNA, 1238 bp, Homo sapiens
  misc_feature (1)...(1238): n = A,T,C or G
ggactttgaaggacacacacgagggggggtgggggggggggcacccnaccgctttttcacccttgagcttcagcgcgcgcgcctctatgttaaagcatttagatcacgctttcgctgcatgatcatccgacgtgctcgcacatcacgcacctagttccaaacgtctacagactgaatnggttggacatctacactccatttactcacaaccggtatgaccgagctcctccctagagagttttatgagtgttgtgtatgagatcctccagcactagactaaagtcctcgtgccaacactaatcctcntgcccttagtaacactcccaatctgctaaaccacgaatgagaacttgtgacatagtggagtgacatgtcttgcgatggtgcctctgatcaaatacatctgggtggatagggatcacnctataccgcaccacccattgcttgttccgcaacagtgacgactggtggcccatatatgatattccctggtcacggtgatggtacgggtggacataataccctactaatatgtgagagactgtggtaggcgagagcatctgcacccggtggngagctaccgcgcttcatattactcatactgatcgtggcatccatgattacagtttgtacgaggtggcaataaaccacaatctggacacattatagaagacgatgtggatgtggtcgtccacatcagcataatacatggcaatatagtgggcgggaagaaggaacatgtggggggtcacaacctgtgggggggtcctcgacacccctacgaaccggtggggggggcggacataataaaagtgaacaatgagggggatacagggaactaaaagggttacaaacggacatgggggtgagcgacctaccaacagcaccggatactggtatcagggggacaactacactcttcatattgcggttgaccaaatgggtggggacagatacaacaataatggatggtggtgacgtccaccacgaacatgatcacaccacacttaccttaccatcttgtgcgtacacgaattgggactgtgagagtagaaacacacatggggggtgggggcaaaaacagggagtgaggtgggacaaacagggaaaaccacccagtaaatatgggatggtgggtaccaaccaacatgggatccgtgtggcttaaagatatgagcatgttaaggacataccacagtgacgtataaacgtgtaggcgtgcggagtggggaacaaag

SEQ ID NO: 19592 - DNA, 1139 bp, Homo sapiens
  misc_feature (1)...(1139): n = A,T,C or G
gtgggaggaaggaccaaccgcgagcgcaaacaaagggaaggancttatacgggaacccaccgacgccgattcgagctgaaacccgctccgcgaagcctagctaccgaccaccactagtctattagcgaggatgtgactctatcccttaatcaacggatacaggcctaaatagcgagtccatatgtagtgttactactcatagacacactgattgaatcctaaactggttctcgtgggaagttagatctagacctaacgagagggcgtagtagttatcaccagtggatgagttgtttgtaataccactacaacgagcaagaccttgcacagggcgatatatacttagaaatgcgtgagctctggcttgaataacggaaacttcgctcgaagaactagaaatatatcttggaaaatccctataaccaagaaattgcggcgcaggggcgaatcctataaccccccgacatctcactcttttagtgccgtctaattgaggaagagagtatgtggtttcgcttttatcaataaaggacggttggttatctttgctgattatttatttttcataaatctcgactctttcctgtgagaaaccggacaaaactcctctagttgttgtgttcgcccaccatctcccgagcgtaaaatatagggataaaaacacccacgtctgcaaatgatcttgtaagccgccctgtataagagaacatcctcctacgatagagagaggtcgacctaccccttggcttcgataggttgatgccgtaaaatgcgctaaaccaaacacagtgccttcttcatttatctaaccactctatatacatgcaatatgggggtgaaaaatgattggttgttactgacggactttcgttatgtctacttgtgtgataacaatatccgattcgatacctgccaccttttgtagaaaagactcgcctctcccgtctcgttcaacacaaaaataatcagacgacaagcatcgggagactattcgggacccctgggaatataggtgagaatacaagttggtgtatgtgaccacaaaacacccgtgtgcatccgtgtcacactcctacaacgcgcctgttatctaaacaatacgcacttaattaagagcctacgcgccactatgccgaccg

SEQ ID NO: 19593 - DNA, 920 bp, Homo sapiens
  misc_feature (1)...(920): n = A,T,C or G
ggacggcgaagcgggaaaaccgagagggggggaagggggaaaaaannnncctaatacggtagcaaactcgcgcgcctattacagctgaataccgcttcgcccagagcactagctactcgacacacacagtagtcaatctagcagcgggtggatgacatctatccaatcactccaccggaagcaggccggatgtgatgcttattcatttactgaatggtgccctgaaaaatatattaaattaaccgacatgaaagaaaagctcgacgacctgtgtgcaaaactacggccgcaagtggcttatgactggcttggaggatgcagggtgggggactacatgggcatgctcctcgaccgactgttgaacaggatatgaccaatcgaaccacttgtgcttgtcgccagggtaggataaaaaatggggacggctctacttatactaccttggtaacggctagataaaacgctgtaatgaataaacgagtggcgcaggagagcactatggtgtactagtccacttttcttttaccattagaaggtgctcaaaggaaccattctgaatgggtaccaaagagcttagactgctgaggccttagacccactctcaccagaggtgttttctctaccgccatgtttttcaaccgctaacctaggaggaacaaaaaaggggcctccttgattattttaattcctgaacaatactaccgggggtgcgtatgggtaagaactaaaaaaaagaaagggcgatgcaggcgtatggggccggttccttgatcccgcgatggtgaaaataacattgttcgcgggtggaggcaccagggctacaagttgtatgtagaatggaaaaataaaaagttggagagggcatttgacgaaacaaagtcagtggcctgtttcgttgaaatgatcaacactcgcccgtt

SEQ ID NO: 19594 - DNA, 329 bp, Homo sapiens
cagccggtatattagggcctaaaaaaatgccacgtactacaattacaagtgggatagaaagcaaccacacaacctctccctcgagcgctaaactaacttagcggcacctgacatacaaacacaaaagacgcaaacgcgagcactataaaaccccccatatatacttaaaaattcttttttggggggggggaaaaacacgccgacacataatgctcttttaacagttcgtttacttcttcgcacaagtgaccgcggaacacatccgatattgtccagcgggggggggacggggaagaagggaacacaacatataaaaaaaaaaaaaaaaa

SEQ ID NO: 19595 - DNA, 946 bp, Homo sapiens
  misc_feature (1)...(946): n = A,T,C or G
ctccttcatactcattaatgataatgcttacgatgatataaagttcaatcccttattcataataatttccaatgtgtaaatgataccaaaagaaattaataattcacggatatgagaaaacgtaatctgcataaacatacaataaagaaaagatacaattcattatgtaatgacaagcgaattggtagagaggagaaaatggattatgaaccacatgggaaaaaagaatgagagcaaaataataaagaatcgtcaataactagatgatatataagaagaaacttacaaaacatattggaagtatagaacgagtgtgaggtatgaaatgatgtttaattttttgtttattaaaagagctttgatgggaaagaaaaactaataaaaagatgcgggatagacaatagtgacgtttttgtccctttataaaataataaaaaaagaaaaggggggggaaataaaatagacgtaattagttgttaaaaattggcaacctaaaaataggtaacttattcttctgtttttgttttttatgttatacgccagtaaacatgaacatatgagttaagcaaagtgctatgcggtgaattgtaatttctttccgtatcacccctttgttgtaaaatgaacagaaaatgaagtgcaataactttaaatgttaaatatatgcatctgattttattagccaattagtgggattttatgccaggatgttaaaatgaacattcgatgtacccattttttaaaaaagcaaggcacagcctttgcccaaaactgtaatcataacgtttgtcattccagtttaaattaatgtactgagcgtttctgtaaaagaagctttgtaatatacctgtgagcctcgatagacaaacatacggtgnngctgttcgcgcgccagagaggaaaacattgtaatagatatataatcaaaaatactcaaaaacaacaa

SEQ ID NO: 19596 - DNA, 609 bp, Homo sapiens
  misc_feature (1)...(609): n = A,T,C or G
gtataactccaccagggaatgctccgactgtcacttcaatgagcagcatcaacaacacagttgcaacacctgccagttatcacacgaaggatgaccccaggggactcagtgtgttgaaacaggagaaacagaagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcactggattctttctagggaaattcatcttgtagagtgaagcatgcagagnngctgttctcttttttttttgtctcttgacaagaaaagatttgttacctaccatttattggagaatggccacggtgacattttttgtgggtacagagaatataggcttgacttaatgatctgtaa

SEQ ID NO: 19597 - DNA, 125 bp, Homo sapiens
ataagaaatatgggcctttgtccaaggttttttttgttccaaaagagtaaacaattttatcccagacccaaaattttttacaatgttgaaactcaagtcttggagccctcctaaaaaaaaaaaaa

SEQ ID NO: 19598 - DNA, 875 bp, Homo sapiens
caagatccacagtgtatgctggcatcgatggctattccacgtacagcagcccattccactttagagtgttagatgatatgcacctgggacacaaggactagtgtatgacatgcccgtagggggtagcacgctgcttcgacccggatctcggaacgatcgctctgccgaccataacagaacctgaggtgccggctcgaaaaggagccgtcaccaccgactggcacacccatggtgatcaaagttagctacacacctgacactttgagctatcgttgcctaatatgtcgtagttatgagaatggatctgagactcacaggagagaacggaatgcccaacagactgctcctatagtggtaccacatacagcttatactagaccttgctgatcagacacaagttgcgtgcatgagatcaactgcacgatacctgcctccctaattctgacagggtattcgccgtggaatggtattaagctagggactacgaatatgagccgttccaggcttaaggcttgatacatcgggaacctggttttagcatccgtgctgaagatacactcctttgattggaaaggcaagcctcccagggtacatgctccagaggacctttggtcaaaaaatgtaagtgttggagaaattacccgctggatccggacttcatcgccttggcccaattgtgttgtttcacattaggcgggtccgaaactaccctgaactgtaacactgaaagtggggcatacgcgggcccttctctgtccgccccgcaacttagggcgacgcccagtgggggggaaaacgcagtgttataactacgtggaaagatgtatggacggaaaggaggccctatggctttgcaacaactgatatagaccggg

SEQ ID NO: 19599 - DNA, 846 bp, Homo sapiens
  misc_feature (1)...(846): n = A,T,C or G
ctaggatccaagacagttctgctcagggaagcaatacttgcgtgctgtctggaaatggcacaaccaaggactactgcatgctttataancccttattcggacagcgtcttccaagtaccctagaagatgcaactttcattagtttgatgaatctgacttccacaccactatgcaacctttctgatattcctcctgatggcatagagagcaaagcagttgtggttccatggggtatctgacattttcttgaaaaagccagagttgcacagaaaggaggtgctgaagcaatgttagttgtcaataacagtgtcctattttctccctcaggtaacagatctgaatttcctgatgtgaaaatactgattgcatttataagctacaaagactttagagatatgaaccaggctctaggagataacattactgtgaaaatgtattctccatccgcggcccaactttgattatactatggtggctattatgggaattgcggtgaccactgcggcattaggcgggatcctggagtgacctacttgaattggaaaccttgcaagcagtgacgagctgaagatagagaactggtggaataaaaggaaggactttttaaacttttactcctttaccaggctgcactttgcggactcgggtagggcatgatggccttactcaatctctactcaaacagaaggtccatgtatgatgcaacttactgcaaacatcacaatcaagctggccatctgccttcgtgcactaactacacaaaacccaaggcccatgcacgtagctcgtctgagaaaacaggacaccgcctgattctatcattgcacggtacacgcagaagggcag

SEQ ID NO: 19600 - DNA, 834 bp, Homo sapiens
gggatcagttgaattggaaagcttgaaagcagtgcccgctttagatagaaaaatgaggaggaactaggtagaaatttaaactttagtcctcttacagttgtaaattggtggtcatctgctgtgttagaaggtctcactttatttttctacacatggttggtttatgttatgatagcaattttctgcatagcatcagcaatgagtctgtccctctgtcttgctgcactaattcataagataccatatggaccatgcgcgattgcatgtcgtggcaataacatggaagtgagacttatttttctctatggactgtgcatagcagtagctgttgtttgggctgtgtttaggaatgaagacagtcatgtgtgatacttgtaggccttctcctcctctatgatgtattttttgttttcatagcccccttcatcacaaagaatggtgagagtatcaaggttgaactcgcagttggaccttttggaaataatgtaaaggtagggatggcaatgatatagacatggctatccagtgtatgtatgtgtatccggttaataattggccttcctgtgtaattcactggccacatagtgcatgttaaggtaatgtaaaacttatttctcagacaatatagctcttttgttagttattttacattaataaatacctattgacgtgggtttcatcctagaatgatggaaacctggtggaagccaatggtcaaccctcagctccccatgagaaagtaaggagtgtattttagatatgttcattggacgttaaatcataccctctgagacaagactcatccttggggtaaaaaaaaacccagatctgccg

SEQ ID NO: 19601 - DNA, 686 bp, Homo sapiens
aaaagaagcctcagccatttcccaaggagatacgtcttgtggtgctgggagagcttacactatagtctgaacttctacagagccttttcatactgtaaacctcactcaaaaatgacagccttccatttcacaagaatcagagtcttgctatgttgcccacgtggtatcaactcctggcctcaagtgatcttcctgcctcagcttaccaaagtgttgggattacagatgtgagccacagtgcccagtctgtgtgtgtttttataattggaagtacatgacatcttttacacaatatgcaaatgcatattgaggaaggagggagagcaactatgtctaaaagtaatcacaataagtcttgacccattaactgtacagatcaaaatccacaccaattttagattcagagaacactatgtctttttaaaaatctatttagaaactacttacagtattttttagaaaatgcacaggaacccctgttaagaaataaaatattccttgcaatagtttgctgagaatgatggtttccagcttgatccatgtccctatacctaatgttaaatgacgagttactgggtgcagcacaccaatatggcacatgtatacatatgtaactaacctgcacgttgtgcacgtgtaccctaaaacttaaagtataataaaataaataaatattgatgcgtccg

SEQ ID NO: 19602 - DNA, 903 bp, Homo sapiens
  misc_feature (1)...(903): n = A,T,C or G
cggaacacgccgtgagtaggtgaaccgctcgcccaccgaacgcaaaagcgaatatgttaataactgggattattatttaccttcataaaggaacgggctcaaaattcaccatagggccacaggcccacccttgattgctacttaaattgagggattcgttgtcacactgggtagaaatgactaaaacggagcttattataatctgagacagatcatttataaagcaatttctttattaaaaagcttccactcttttgtttgttggtggtcaatttgcaaaccaatttgaaagcggaaataatgtgcacaagtctgcaaagagtgcaaatttaggatatggtaaatgctttccaattatttcgaggggctgtgtgccacaactgagcctttacattgtcatcttttttggtcaaaaatattttgatgccagcattccttccgctgccgaggactatatacatttttaatacgtgtgattaagaaaggactactccttctgcaaaaaagagaagaaagttctcatagtttgaggattaaggatccccccaacccaggaccagtattgtggtttaggttaggctcggactctggacagagtatgagcatgtgcaggtggcatcctttagtatcagagcttcaaagacccgtgagtgctcccacatgcataactcaatgtactgtcattgtcagttatctcactgctgagctatgacatgggcgactcattctaatatacagataaaatcgtcattatttctatatccaatatctttcgtggtaggcttcgtgctgaggacgcattttgatantgacgagcccctctanatagngcgantgttcnttcgncnaactactattatnggtattctattgaggcacttctctctncnaaatgtatacggg

SEQ ID NO: 19603 - DNA, 866 bp, Homo sapiens
attaatatcttacatagaaagctatatgccctgattagttcacaatatcgcccctttaagtctggacacaaaatttccggtgtatattcctttcccaattaaaagtgtatagaagtacatatacaggcctccagacgataaaataaaatattttggtatggttaaaaagtttcctaagtaaatacggggtaatagttcacctcatgtagtgtttattaaccaaaggacaaaatatttcaacacaaaaattccagggatttctttgggtgtatacgcccctttatttaataatataaaataatattggcagagataaaataatcctcccaatccccctgtattcaaataaatagggttaaatatcaattctacacaataaaatatggcctcggtggaaaaaaactgttttttttttttatcctgaatttccaaaagaaactgctgatcaattgtgaagaatgtggttgcaataaaagtcaatattaagtgaaggtgcagtgggggcagggagtgaagaccaactaaaccacagtacctcgtgagcgtgcagtttggggcctctcttggtggctgcccagtaccctttgaagtgcatatgctgcatggatgcatgggtgcctggagctcagatagaatgccaaatccatcccttcctctctctccctttctgttgcagagacagaggcaagggcaaaaatcgttgcagctctcgtattatgaaccaggatgtttattggtgatttctctataatttgcagggagaaatagaatacgatctaagaacattggattcaactaaatattcaagctttagggttaataaacttgaaaagattttatgtaagacataaatgcggatgcggccg

SEQ ID NO: 19604 - DNA, 559 bp, Homo sapiens
gaatagttttcccgcatagtaacctatgtataaattttcccacacaatacatctacttacaaaagtagaaatatccccgaattaagagatagcaaatacaagggcgttgtatcgtctggacttgtaccattttcaacaaatgatatttttattcatttctcctgatccaaggatggggcatgctgataggatgatgtcacacccccgctcctgtgacgacagttgttcgatgtatactaggatatggaaagggaatatacaacatataattatttaccccgatataagtttttgtatcctctacacttttccgtttatggacactcacgtacagataattaaaaaggggggcggggtgggaattttacatttaacaagacagtcaaatagccatagaaatgaccattgatcatccatgaatacataatgtcgcgatgtacatactttggacactaatttattaagagtaaattagagttatgtcgggaatttgtgtaacagtgcaaaccgcctgaagttaattataaacgattactacagtattacgtccgagcttatt

SEQ ID NO: 19605 - DNA, 127 bp, Homo sapiens
  misc_feature (1)...(127): n = A,T,C or G
atctggcccaacataaatattcccgacatcntgctcccggatacaacataatcgccaataacaaacaaccgataggccaactacagacgtgtccctcaccttattcagctcctccaagttataaatg

SEQ ID NO: 19606 - DNA, 1113 bp, Homo sapiens
  misc_feature (1)...(1113): n = A,T,C or G
cccttttttttccccccccaattcccccgtttttttttttccaagctgtctgtacaatgtgacgatttttggaaaattaagcccaccatatatttttatcaccctccaaccattattattccccaatgtattttgttttttcacaacacaacatcattttgtgtttcgaccacaaaagcgtgccgtgttcagtgtgaaacatacacatttttgttcaccacccccacgcactctagtttgttgtgtttactgttataatttcacccatagaataacagaaagaggtgttggtatctacattatacccaaagtattcatgaaataagacaacatatagactacatgatagacaccgagtgccttacaaatacatttaaatacggggggcggggacaaagtccgtatatatattttatctaaatggcacacgantatcgctcaacgtgtcacacccctattgtttgttaagtcaagtgttctaagtcaccgacaccaccaccgtattttttccaatggttcgacatgacgatgatgtgttaacgggcaggttaggggttgcaacaccccgaaagtaatagattcccccgtcacgtcacagccgattaaaaatatttcgccaaattaaattcccttattaccgtgtttgttcgaaatggtaatacatacgttctaactgaattgatataagtggacggattatagtaacgcactgatatttggagtcaacaggtttgctacccttcgccctgtaacgctgtttgagcgatgcgtatcactcgatgaattatgagggtttgtattgtagattaaataatgagactgatatgagagatggtatatgtgggtctgtgtggtgtttaaaatagaaacgcagatgaaagttatcgtgggtcaaagagtgtatcaccatttaatatcaaaaatgatgaattttatcatcatgtgatgtgatatagagtgtaaagatggagcgacatgtaacaagtgttgtacatntttatgtgtttagaatgatatcactgagtagctgtggcaagatgagcgattaacgttatgtggtgtatgaatgtcaaacgcagcgactgaggtaggtacattatcacatgtcgagga

SEQ ID NO: 19607 - DNA, 687 bp, Homo sapiens
tataaaagctcattcccgctttgttcttgtagaccttcttctagttcaccctggttttcatcattgcgtgaaattgctatcaaattctggatcaacttaataccaatgaatgaggtcttggactttgggaaaacaactcgaagccagagattccttatctgtcaagtgggaaaaatgatctcgacataagctttggagaagattctatgaggtaataaaagtgctttgtagattcctccatgtgagaattaaggtaaaagtagtacgacctgctaatgggctctcccaagaggtgctttcagatttggtcttccaaagaatgcatgaaaatcagaggttgaagattctttacgctgagctcaaatttagtacctctggaaagctttccaaactcttttctagtgttggcattgtatttttcaagatcccactgcctactgcagattcccagctctgacccagagatctgaaagaaaggaccatgctcacttctgcaacatgcagcaccatggaaagaatgggaagcctatgacacagattggcagggataccactgcacatctactgcttcatagtctagttctttgctttagccttctccctgttataaatgatgtctaatccatgtaatgaaagaaaaaaaagcctgcaaatcttaagacatctggtttttttcttggtagaaaa

SEQ ID NO: 19608 - DNA, 904 bp, Homo sapiens
  misc_feature (1)...(904): n = A,T,C or G
gttattattaaggtcggttgtatttaaacttgttgacatacttaatattatcataataatgatttttagttaatttattttctatattcattttatttaattatatattttttatgttttgtttctatttttatgactgttgtcctatattgtatatgcgtgatgaaacatatttctgtgtattcttttttgttctccgcctcttgtttactgctgatgttgtgtattcaatgtgtatttttatctatgagagatttctgattatatttttgttatatattaagatttacaatcttctatctctgctcttgattgatcttataggaatgagtggagcatactcagttgcttatgttggctctttttatttataanaaatatcgggggggggtggaatattttttatatcaaagataatatattagttaagacaatgagatatatgatattgatagcatattatatgttatgtttatttttgttattgttgtaatccatcttatttctcgttgataattaaatttacgcgtgcgcgacacgacaaaaggtagcaaaaggttaggaaatttgatagaaaatatattttttctctccttctgggggggggcgggggatacttaccccccgcggagtggggccgggtgncnnttttttttttttttttttttttttttttttttttttttttttttttttttttttaatagtaaataagtaattttacttttcattgaagaaatagttcatataagcattacataaaataattacattttaatatgcagtcataatatgcgtgtggacaactcattaaaagaagagaattatgtacaaattcaggttatttccaagggtgagaggtgagttgtttcatgcttctaactccccagaaagcaatgcaaat

SEQ ID NO: 19609 - DNA, 851 bp, Homo sapiens
  misc_feature (1)...(851): n = A,T,C or G
ccgcattttgtcacaacattgaaagccatacgaggacagattaaaatgcgagacggagaacactatgtgtctgtacatcttagtgcaggtgcttataacccattacaatacaaaaggggggtcatgctatgggcgcagtttcggtaactaaagttagattcactaagtaccaacaaggccatacataatgtcagcacgaatcctctttagagttagaatttcaaatgtgtatcttgcagcacccagggtttaaagggtttatggaagcctgcacgaagtgttcttacgttcgcagccgggcttcattccaagtcaaatgtgacccatgctgctggggtcctaatggaagccataagattggccttatgtggtgaacaatacatgctttcaacataaggtcaaccccgaggtgttcncagcacagagttggtatatccagaattttagttgtccagagaggcctatttcagttgaagtggtagggcagtcagtgttatgtacactgcagtataagtcctaggctgcagagactgtcatatttgtcggtcgatcggtaatcctcaagatggatgggatcaggtagtacagtaagaaagggaggtatgataaatagcaaaccttctatgagctcatgcaaaattatggatcgtgcagcagaatctcatttcatggagatggtttgcaagataaacttcttgatgctagaccctcgggcagatccagtgactggtctgattaggctggtgggtgggccaccctagagggagaccctcatccagtattctatccagctctctatgtatgagcgatcgcatttccagatccacttaagcaataaactcggatggccg

SEQ ID NO: 19610 - DNA, 579 bp, Homo sapiens
  misc_feature (1)...(579): n = A,T,C or G
cgcagtagctagttatagtgctcacatggattatactcgagantcgcacaaccctgttgcaccctcaaacaacactctccaccaatagtgcagatgagatatgagaatttcggtacagacacaagaagccccgacggagcactgttacgcacgattcatatgacctggtgattgtcttgcaacgggtagtgaggttgtcctagggccttattgagagaggcaatacatctgaccactcaatgaacttagtcacactgacataatgagagtaacgctcccccaccgagtccatgtgctgaactccggcctgcgagaaagaagagaaacccatcccgaagtgaaaaaaaataaaaaaaaaagagcggggggggggaaaaatgtaacaaatagaccaccagagcattaacggaaacggctatagagtatgactaaagagaagaaccgcaggagccgtctcactctgggcactcatactgaatacaccggattagacaagaaaaggccgcaagcctgcaaagacgtccaattgcatggacgtcttccgcacccnnnncgccnnnnccccnnnnnnnnctncnt

SEQ ID NO: 19611 - DNA, 1162 bp, Homo sapiens
  misc_feature (1)...(1162): n = A,T,C or G
taatgtttaaattaataattaaaatatagagagggagaggaaaaatattttataaatggtagattcttgggggaggggggggagggaatttagagaaggaggggaattgtggaatggagtgtgaggggggcggcggacatagaaaaaagcctgtgagttgcggtcgccactcgggaggggcgagcgtgactcagagtacagaccgcgagggcgtcacgataccaccggccgggccggcgcgagcgaggggagacccgagccgcccgcaacaaccaccacgggcgaggcgggtggagntgtcgtgcagagtttattcttcctaccctcgtgaaagtcgctctaaattacaatacagccagttcgcggcgccgacggacagaacgcacaccatagacgccgcacaacaccacacgaacacncatagaatagcgccgctgctgtggctgtgcgagcgcgttcagtgaagaagtgggaggccgcgccgccatccccccccgaccctactcgaagccagcacgcgcccacccacactacgcgacgcacaaccacatactgccacacacaccaccaaggacccaaccacctacgacgancggatgaggagagaagacgatcggtagcgcgtcaccatacgctaatccgcaactatagaacgtcggacgaaggatgtggtcgtataantatatatttgtatggactaaatatgagtagaatcttacagattcaacgacagccnttcagtacgtgaatgggttattantcgatcgatcgtccgaggtcgagaaataggataacatagaagtggtgtcatgacgntcangtcaagactggcgctaagcacagcgccactgactgagagtatatcaagctcagcggcgcgagctggtctgagtcgcgcagagctgcacgctgacgtcacgtagaagctgacggacagccgagccancagcgacatcacgacctgaacaatgatacgaagtaatcatgtagagctggaggactcacatgatctncaaagtggttaatacccgcggagcgaggccgcgagcggagtcgtcgacgagaacacacgaatcaccgacgcacgtcgcccgcgcctactcctcacacgtgtcgtaccgcaccattataacagcgtgcgtaccgtagatacgaccgatat

SEQ ID NO: 19612 - DNA, 953 bp, Homo sapiens
  misc_feature (1)...(953): n = A,T,C or G
tttaatttaggtttttattaaggttttgtggttttagtgatatataaaagatgaagttggagggggcaaagggggggttaggnggggggggcccgaagggggggggaagagggatcaacgccgaacatatcccacccgacaagaaaacaaaagaagagcgcacggctgtcaggtatgttctcgttcgttcactatacctacatttctcgtttgtcagccgcggtgttggcaagggaggtaaagaaaggccagagcggttaatnattaggggtggtcggcttttttctagattttccccattcttctctcgtcccaagcgggcgcaccgcaagggtgtgcagggggaggggagggggggtcggccatacataagacaccctgtttcgcgccgcccccgccctatcccttttccccggcggcggacacgcgcatccgacacgaccgcaggccgcggttgggcctggagccttcgcccgacatggcccctgccctcgtagctcttgctctcgccccgcgctcgaacaggttcgatctcttcgcgtttatattcgtcatacagagacaattagaaggagtatagaagtcgctgatttagtgtggtagtcagagggagcgagtgcggggtttgtggtgatatagcggtgtgatgtgagcggcagagtgtctagtgagacgtgtcgaggatagtgtttgtctgctcttgatgcccgttaggctgggagctcgtgacggtgggccgcgccgttggctgcctgcattaatctatcgtattgcgtcacctatcgtccggagcacgagcgagttaggagaggaaacgatggtggctatgtagagctcagatttagtgtccagaccgaactcgtgcagagagcacgcgtgtgttggagggggagcgagagaacgcggggagcaggggggaccagaattttctcgactcttctttatcaaactac

SEQ ID NO: 19613 - DNA, 1637 bp, Homo sapiens
  misc_feature (1)...(1637): n = A,T,C or G
ctagtcagtctgacacatacgaattctctcaggagcatgatctgccacaccagagaagtaagcttcgcaccacgagataccctagagaanagagcataaggtcttcgcatacacagcaccgtctgagtaccgcagtacatcgagaagataagacacagtcaggcgtacgagactaccgcatagtcgaccgagactaaaagtagtcatgcagccagcgacagacgctctntattgtatatctatcagagagcgggtgtttgactctctgatcacctacgcgactagtatataatattcgtacacgtccacagacactaattgcaacacgtnagcatcgcaccatgcgacctgacaacgacgacgactcctctgacaatcacgtcctgcgtgccgttgtcgagacaacgtgcacgtatagtcacgtgtagaacacgacaagagagataatactcgcgtcgtaagacgcacccgaagaatgatcatacgtcaaagacacgagagcgccgatntgatgcttacacatatataccaatgtacacagatagcgctagagtagtatagctgaactatacatacgaatcactgtgcgaacgaccagttattaaacaagtaattagtgtcgctgtgaccacacggcaacatttccatattataagacacagaatgtgtgattcacaggtatgtaagatatattatagatatatggtatactgatgaacagagagatatataggcaganaggtactataattattactatgcccgtatgtattattcagcgcgcgttctaccacagcacgtgacgacccgcgctcgcgagccttaagactgacttccnatattactacacacacgagagaagagcttgcgtgtactagtatcactacatgctaagctaatactagntgcgcagtctcgatgtatacggtcacagaagatcgactagcgtagtatacagtcgngactgagcgcgagtaatgtcagagactcgagatgcatacgcgaaganatgattcgacagagtcagatccactgcataggcaggatgtgctctagatagcttatatatcacatcatcgtctctcgcgcactatactatancacnatcgtatcgcagctacatccaatagtgnacgcctcgtgtatattgacgcatcgcatatacgctcctctactantaagatcatagcactagtattacgaactctgagtcacgctgtgcgtcgattacgtgagcgtacgtactacacacatcatcancacacaccgacacactcagcgtgtcgtcactatngctagctagactatgactgtatctcgncgtatcctaatgtgatatcattccggatgccacgtgcgcagctacagacttactgtactagagagatacattacacgcacagcgcgctgagatgtcntcgtgattcatgtaggtganntaggagaacgcgcgagctcacaatgntagtggatatatagcttcactccatctcgctgctatcgcacatcacgctcgctagatccgtcacctatatncatcgtgctnaatncgctctgtatttcgcttgacctgatncacagtgacgagacaacgagnacgcatagtgtgtcgtcgctctactcacctatgttgatag

SEQ ID NO: 19614 - DNA, 1846 bp, Homo sapiens
  misc_feature (1)...(1846): n = A,T,C or G
cgactatgctctccatccaacggcagagacgcgagactgatantagcatatatgcaaagtcctaggacgtctggancggtcgtcatngttcatctgctttacatcntgagagtgngaccacgacntgagtctacgcagccgagtacttatacacatgtcgtntcagcgagcgagcgcagcgtacngattcgtacactatngnagagnatnagatgncgagnantgnacactgagtntgacagcatcgactgcatctctcgnctgacgtagatctgctgatgatancgcttccgacagcagatntntgtcgatatcaatatgatacgatcatgcagacncgctatccgatgagactantaatgtagacatagcgtgagtctacgcatgaanctcgaatatgagagaatgncgtctatacgacgctgtagaagtcagncagtgctatgtgacncgtacncgctagctagcacnctncngcgtccgaacacagtgtgacacngagatgagtcagtactctgtacatatgtcgcagagtctgatagatagcngtacgctccnatcgatctgccgtcccagtgagatcngtgctatcnactatgcacncgtgacagcactcncaacgacggttgagcatnagtanantcagntagacgaggagactataccgcgatctcctggaatagtcgacgctcngctgacgatcgtccagcgtgcgtctgcacntcncagtcgtgnctncgcgtgncnngcatacatatgatcgcacgcgcgctactgcagatactgantctcantgtcgtacgctcacgcgagnatgatgntgtcacagctatcgagacgtcatcagnagagcngntanatgtgacgctctngatgcgtcatnagcngcacncgccacgttacntgcgtngnangtnntcnctgtagcagcgcgagcgtgatattagtcacgcgacgacgatgcacgtgatgcgctgcgacgcgtantccgatcgtcgcgcacacgtctcantcgacatactcactacagccagacatcgtcacgacgcnntctcnagttnccatatttcgccctcncgcgcgccgacacgcactagagcatcgcgtcgagtcggaggcatcaactcgattgtagtacgtncgtgtgtcgtanatntatatgatgcacgtatgtntatagcacgnacgtcgtcacacgagacagcagcagagatagaataggcgngctgcgccagtcgtnactcagaccacactagtaaangccgtncagcgcgtgtgtgatatatagtgtcgatctagcgcagncgnccacgagtntcgcgtcacacgaatatcagtncgcantctagtcattactcttcagatcgtactcatgatcnactactcataagacttatanagtcgccactgtatcatatgatcatgtcgnctcgcgcgagtcagttngatagagtatgatatcgagtatacgacgcgtatatcagtctggtcgatcatgatgtanccgcggacgcagtagcggctatgagatactagatgtgtatcagtagtatccagcagagactccagacgacgcgcggctgcacacagtgatgttgccagcagtaattgcaagtgtcagtaccatgtcgcgagcctatgacctcgtctgatatagtcatgtcgataggatgcgcccgcgcgacgcgcgcggtccatcatctgctagacaactgtagtaaatatatatacacgcagcccggagataccccttgaatcgcaacagcgatctngcatatatatcgacacctgacgtacaaccctcccacagcgcgaatacgtcgcaaggccactaataattatacaa

SEQ ID NO: 19615 - DNA, 1136 bp, Homo sapiens
cgttgacagatagatcgcagtcatgtcaaaaaccgacaagccgaaagggtctcaccgggggaaacaaccgcgagaaatattcttgggcgcggtctagaggccgagggtggagtacgtcacattcgcgggcaccctcacacccagaacttctacgccttgatggcacagacggggccgcccatccctccgaatatatacgcgttatacagcgcgcagacgataagtgtcgggagccatcgaatacaccccaccatcccgatctatccgccgccgataagtgtccgccgaaactatcctcccacctttgtttcggagagaattattaccgcgggacgcaggaggtgggggaggtgggatcttatagcgctagagcacacgaactgaaaatgagggggggtgaacggtataggaggatcatggccagcaatagatgaatacccggatttgctgctgtgttacagagagtcgaggcgggaagctatagtgatgggcccgggatagatacggagagattatgtagttcgcaagcctacgaggcggtacgcgggtgagtagattgtcacccacgtggcagcattccgataggtgcgttagacaggtaacacgcgtggtctggcgccccgccatggtagtgggaggggcgtgagttgtaggatgttgatacgaatgcacaaaaccaggagcgacactgttaaggaatatagaagggggcgggggaagagatgagcgacaaaaaccaatagataactacttatggactagagggcactttgcctaagccaaggagggaggggttccgcgatgtagcgacggaacccgtgtggcactcgagacgtgatacttgattccgtagtgaggtggagccccgcagatgagggaagctatagtaaaggagagtgaggatacgaataggtggacggggagacgggtgagaacagatggataggagtggtggacaagacgaagattgagtcgcgaagacagtgggacgtatatgcgatgctcagatcgcgattatggtaccggttctgaaaggcctcgcaatgaccatttgatgcctcagcaccccccacatattttgtcaaagcggactgataggcctcgcatgacatcggcgattgtacgagacaaactag

SEQ ID NO: 19616 - DNA, 1174 bp, Homo sapiens
  misc_feature (1)...(1174): n = A,T,C or G
cctttctccctcgctcgtccnctcgtatccgtctgactcttcctcgtggactctccgcgtctgatagctcgcgtgtctgcgccctctctcgcttctggccgncgccggttcgctctctttcctatcctggtgctcctcccgtacttcttctacggtgtctcgcgcacgtgcgcggccgccggttcttgcggtctgctgcagttcctcttctcgtccgttccttgccttcgcgccctgtcgcgccgttctcttacttttattgtagtgcgcatgctctgctttgcgtagatttgctgcggccctgttgctggtgcttctcgcctgttcgtggtctgctgtgctgcgtgtggtgtcgctgctctatcgcgtctcggcttctcttcgtatcgccgcccggccgccgccccttactcatgcctgctccgccgcgcgcgtctctagttcctcgcgtttctcctccggccttcacataacctcctcgtcttggtgcgcttcgttcatctcactctttctgttcttattgggtggcagttagcgcgtcgcgctcttgtcccttttcgccctgagggcgcggtgcgcgcgggtgggtttttgtgtggggggtgtagtagctaggttcgttgttggcagcttcctagccgcggggcgtgtctttctctcctatccgtcttcttcttgtctccgttttctatctctcttctcgggcccggctcctccccctcgggtggtctgtttctctcctcctggtgntttgacttttgttgtttcgtgttcctctacctcggtgttgtgtgtctcggcccccgccgcgggttgggggcggcgtcctgtcgtcgtgctggtcttgccgtctctcttgggcccctttgggctggggcggtttgtcttgcgcctcgcggtcgccctgggcggtgtgtcgtcggcggggcggggggtgaggcggggcctcgcccgcctgcgcgtacgcctgccggcggcgggtgtccccgctgttccccgcccgtcccgtggggttgtcctcggttggcgggtgtttgggtgnccgcccctcttctgcgttcctccctctcctaacttttctcttttctgtttccccttctaaatttttttttttttttanttttccccccctaattattttttttnttttttcttcctttattctttttgtttc

SEQ ID NO: 19617 - DNA, 1156 bp, Homo sapiens
  misc_feature (1)...(1156): n = A,T,C or G
atttagctatttattatattatattttactttatgtcccttctttatctacttgagtagtgtatcgctctgttcggataggctttcatatttatcatatctntgttcctcatagcttaatttgtgtcgagtatcatcctaccagaaatataccagatcataacacgataagaaaaataacggaactttcgctgcttctgcaatctgagatgcgagtgcttgcgttctcgtttgtgtcgcgcttcgtatgtgtcttgctcgtgtgtattctacgtacatagttccttgatacttcgtcgtgtgttcgcttagacgcggtttatatgataaatactggtgttccggagttgttgtcagattgaagattcagtatctttccttcatcgtttaactctctcgttagtagagcctcgaattgcgagactattataatattagtaaagtacgtgacaatataagattatgttagggtacagcggtgactacaatacactccgaggataaagtgggtaccagtgatgcctgcgcgcgtgagtatcgttaagtcttgtactattgctctactagcaaatgttctgctatacgtagcctaatttcacctatgcactattccttctgccgtatgaattattggattcttttataggtcttactatattatgttactatgtgtgacacacgatttgatttcgcactgtgaagattactgtagtcttttgctggtagtttcgtattgatctatattagaatgggagccacaccctcatttgtcgtagggtatcatgggtgtcggcggtgtattattattattgaataacactcagttttagaatcatgttgagttatatgacaatatgtatttgactagaatatttgtcatgaaatatgaattagggtcgttcaaattgtggtgctgattacgaggtggttgtagcttcagggtggtcgacaatagtgttgttacttaatactcgccgcaaccccagatgtgtgtgatacattcgttggctgggtcgttcgtgaagtttcattaggtgggtaggtgcgagccccgttatataataatgaaatgagcgtgatcgcgcgccgtgagcctgtcttcctctcgttantggtacttgtaatcattgtactttgttttactatttgcaaatctt

SEQ ID NO: 19618 - DNA, 1373 bp, Homo sapiens
  misc_feature (1)...(1373): n = A,T,C or G
cttccgccgtttggtcctctccgtgcgtcgccctcttggttcctgctcggtccgcggtgtgtcgcgtctcgtgtcgcgtgtgcgtgcacgtttntgntatgtctccgttcgtatgccgctcctctccgtcgctntgtccgcctctagcctcgttgcgcgtctcagggcgtcgcgtgcgtgcccggcgttgctctcggcgtgttgcatgtgtcgtcgggtgtcctgtctcttctcgtgtggtgtgctncctcgcgctatcctcgctcgtgtggcggcgctgttggcgctgccgtggcggtcggcggctcgcttcgcgtcgccgtgttgctgcgtggtcgctctncggcgcgcccgcctgcgtgccggcncgtgtctcttgcgtcggtgccgntaccggtgtgagtcgcttcgaccgtcgcggcgttcggcgcggcgactctntgtgtttcggtgggcggcgtggttcgagctcggcgcgtcgttctctgtgtcgtcctcgcgatctctattngtcgtttcgttcgtcccgacgcgtggttcctcttccctcctcgttccggtgctcgtgangcgctgtcctgtgcgcgcgtgagtgctctcggtccgccgttggttcggtgtcgttctgcgtgtgcgtggctttctgcctcgcgacgcgtcttntcttctcggtgtcgcgctgtgcgcgtgggttcctctgcctgccgcgtactcgtgcgtcgtgatgcgtgttgtctcgtggggcgcgccgcggcgtcggcgtgctgctcggctgtcccgctgatcggtcgcgtggcgcctcggtggntccctgcggcgcctcggcgcgttgcgcacttggctcgctcgcgtgcggctggcgctcctatcgngcggccgtggtcgcgttcgtgttacctgcgtcgcgccgtcgtgcggtgtgtcggaatacgcatgngtctcggtgctgttcgtgtcgtcctgtgtncctgtcgcgcccctcggcggtgttgtgccgtntgttcccgctggttctgcgtgctgtcggtgccgggctgttgtcgctgtcgtcgtccgcttgttcttgtgcgtgctgtgcgttcgccccgcgcgcgcgcgccgttcgcgcggcgtgctgcggttncgtcgctcgcgtcgcgtgcgcgtgtttgtctgtgtggtgctgtctgctcgtgtggtctcgcgttactgcgctggtggtcttgtcttgtcggncgtcctgcgcntgtntgggnngngcggtttgtntcccctncnntcaaaagccttgtggntcgncagttccttcgactccgagcggcctctgcgctctggctcgtgtccctgtggctgggccccgcctctcgctccgtcggccnccgtgctctccgcct

SEQ ID NO: 19619 - DNA, 855 bp, Homo sapiens
tctaatttcaccgctacacatggagtctcgctgtgtcgccaggctggagtgcactggcatgaggtcagctcactgcaacctccgtctcctgggttcaagctattctcctgccttagcctcccaagtaactgagactacaggatttccagactgtattaccatcatttgagctcttctcaaagtatggaaaattatattcaaaagctggacatattgtataaagagagacagggtctcactctgttgcccagggtggaatgcagtggcgtgatcatagctcactgcatcctcgaactcctgggttcaagtgatcctcctgcctcagcctcttgagtggctgggattacagaaaacaaaagatgaattgtgaaactgaaattaaggtgggaagtgagtgtaaaataaagacccaccctgcctggagccctggatttttccacctctgatgaagtgaccttggatctcttcaaccgcgctaggggtctgcctcttagggcgggaaaaaaaaaaactgaagcgctctgggtgtctaaaactgaccagtggcgagagggaaacaccggtgaaggtccgcggggaaatatactgggtatgaagggagagagcttgaatgcgggcttttcctttgtggggggtggattcccgaggctgtgtccacctacacgctggggcgcggggtgtcgctcagagaaacgattccagcacactcaagggggggatccggtgttcgcacagatcgggggggtacggaggattgaactatgcgatgaatcggcggcgcacgggcgggagagccgggagaggggcggggggagggcgtgagtattagggtcgtgcgcagtagggagcggatag

SEQ ID NO: 19620 - DNA, 1696 bp, Homo sapiens
  misc_feature (1)...(1696): n = A,T,C or G
atgtcacgtcatgtagatcgccggtgtattgtttgtcatgcacggtctatgtgcttcaccttctccaagcgcagaggagggtataagctgtctttagcctgggtgtgccggtagtgtgttgtgcatcggtatcgttgacagacgtcccagtatgaattcatgtttcagacgctttgctctgactcgtcgctattactccatgcgttcgtactaacgtaatacacgcatctctcgcgcctgtgtcgtgctgcttgcatgacgtcctcgcgngcgttttcgtggcgccatatcaccgctcttgctgattactcagtattactaattccgaantatcanctgtagcttgatcgttctcaatctcaattagttantgtagtccatcatctcatgcctatncttcacgtgatatcnacacggtacaataggntctactaccctcgagangcactattacgagtcagctgtcagtgtagaattnctgtgcgcgagcatccaactatcatangtcgtatacaggtgtgcgntcatccactcgtgtcgacntcgcctcagcagacaacacgngcgtgtgtcgtggttgtgntgcaatggagagagtctcataaatattgtgatgaacacatgacagtgttgtgcggtgtgatactaaactaggtgacaacgtgcgctatcacgacataatgtngngtgtggtgtgatgcaacaatgtggngctgtgcagcacgttccacttggtgtgattcttcatatctacgtacactatacatacacataggtgtgcatcagacatatcatcacagtggctgccacaccctcggnacgtgtatgagacagagtatatctctctgcactgtgcgactactcactctgactagtctctgctgctacngcttcgntgcgacgcgtcgcccatcgcgngctaccangctccgtctcgcgcacctacgacagtgctcctcgcaatctctcgcgactacgcatccntgcacggtgcataacagtggtatatcgtcgcgcacatatcacaagcttcgagggtgagtggtgggtgtggagacaccnctcatgataactaccgcacgtcatatacgtgcgggcacacacggtggacggagacaacttacaaactgggcgnggacacacaactacaccggtggtgtgcattggcgtctagacacgatgagtaggtgggagcgatgacacaatcacgatcactnaactctcgctngncgtggntggtgaataagcgctgagtatcactggctcttatcgtcgcgtatcgctatccatccactngtggggtcgcaccgtatgggtgtctagagagctatcgctgtcgtggatgccagcgtcttcnctacttcgcgtatngcggggcgcgngtgcacacntacacttgtgggatcatcaccaccgcgcgtgtggcgcacgcggatagatttaatataccatgggtctgtggtgtcacangtgttggctctatagtaaaacaacnttggtgtacatacaccactgtgctacgacacactgttgctccacgctcacngtgtgtcgtaccacgtcgtgtgtgttcntgtcgcgatgtgtagtatgtggtgcacactattangaattcatanacgcgtcggcgaacagtgtgctgtgtacancnatacatatgtgatgacgagtggttgtgagtgtgcttgcgtgtttg

SEQ ID NO: 19621 - DNA, 1030 bp, Homo sapiens
  misc_feature (1)...(1030): n = A,T,C or G
gactgctgagaacactctcttaattatccccgctacagatttacagtgaagaagaaaaatcaggcgctcaatcttttagtcattctcccgcccctacgcattactaccaccccccgtcgctcgacgaataaacaaagagtgtatgagtgagcggacccaccctaatgtcacgcgcatcgacggctgcagttttgtaatagatcgccgcgtgggatacagtgccgatgatgagcccatcccctaacataccagaaccggcgccggcggttgttcttatatcaaaaaccaagacacgcccaacagagcgagcgatcatggctagactcagaggaggttcagagagtgtcgccagaggaatgcgtcgaatattatatgccgctgcagtttagccttcgtcccgcgcacgcgctgcgttctttgctagtctcgcgacgcccagcagactgccatacccgccatatccccttacatatcgcaccgccattctctcaataacctgattcgcgtactaaccggagacccacgcgcctgttcggtccctcggtcaagtaacccacacggcaaaccgcccgggcggagatgatgcgtcgagagcgaccgtgacgcagcttcgcgagtcgcgtacaactaacttttctatatattaatcataccgacgaatcgcactcttaataaaaaaattacgtacaagtgcgncgctcgattagttctcatatcggcacacggaaagagagaggttgagctgatacgcatgcgcgaatacatagcgagagccctagcctcgcgcgagagtagcccccgatactactattatgtaatcggcagaccgcgaatcatgttctccccacccagtcgcgcggtccggcggatcgcagacaaactaaagagtgtctgcgcagtcacgttatggacgctgctcagcttatgaggatccaggaacgcacgacccgcctcattattagctgcgcatcgctgccgcctgcgagtgctgctaacaaaccgccggcacaggcgcgacagtagaggcgag

SEQ ID NO: 19622 - DNA, 1513 bp, Homo sapiens
  misc_feature (1)...(1513): n = A,T,C or G
gaggtcgaggtctgtgtctataattgttagtgttatatatatggtcgcgacgcgaatagccttcctctcgcgtatgcgctcacggacgcgccgtgataattattttacgcatgacttatattccgctcgctctcggctatagatattctcattatcgccggacactatatttattattctgcgctgcgaagtgcgcgagtagatctcataaatcgtagtcagcggtatcgcggcgttataagtgcagtcgtatcagttggtacggagtntatgtataccgacgcaatctctgtgagaagcctggtagatgttagccataagagacgcgaacaattcaatatagtatcgccggcccgtcagcatatttgatgtgtaatcgtcgattatttgtattctatcagcantcttatgtatctgtactcccgtacgcgccgcgtgcgcggagcntctgcgntactagtcgatgtncacagttcgctgtatgattctcaatcgcgtatactcgtcgtctgatatacagtagtcgtaggtcgagacgaatcggtnttatgtgtgacgaagggagtgcaggtnacattaacccgtcgagtatgcgcgatcgacagttgtgctggcgtctntatagtacctccgcgccgcatgcgtantatcgttgtctagtgagatggnggtatgatcagcgtttcgttgaagcgccacggcgagtatgngcgcgtatatcctctcgcgcgctgcaagccgctagangatggatcacgctnagagctgcgagantcagtgtatcgctcgantagcactggacacgcgccgtccacgttctgctgtgacggcgtgcgacgagtgaatctaatcgcggccgatagatagcgcagtcngnccngaggacgatatcgcgcgatcgngnatcgcagctgtacncggccgatanacgaacgtcatatgataataccgagcgcgtctcttgagcgncgtgtgatcngntcatgtcacatctgtgcatgtttatatcgagacgccgcacgacgnagacggtcgcattagccgatgttgttgtagatatcacgtccagttgaattagtattatctcgcgcacgatactgttcacgtagccgacatctncggcaggtgatatgtctcacgcacgcgatatgtctgctatgcgcgcgttacgatgtttactatatcggtctatcgccccgcgcccgccgcctgttcgcagcatctnattctatcgctctgcgtattgtattcttcgtgtatgcgacatcatagttgtatgtattgttgtgccgctctccgtctgtgtgctatctcctcgaccgtgaggtatatgtatgtatgagaatgctctctatgatctcgtatacgaccagatgtatcgagcgccgacggatgtattgctgagcgcgttatttcattcaatattcgacacggcgcctcctaatgtncgctgcattcgttcgttcagagtgttgcatccgtcatcgactcgtcaagcgtagatcataacgta

SEQ ID NO: 19623 - DNA, 737 bp, Homo sapiens
attcgctttgcggcttttgtggggagggggggactagctgcacacttttattttcccgtcagcattacaggaataagaattgggtatttttttgaggtttgtttggaaggcataccgtaatgggcatcgagttcaagtaccgaaataatttgtgttgaatattatgatacgcccgcttactgggtgttattgtgtggtagtgattgcgtcgtttatttttgtttcaggacggactacacgatagcttatatagtgttgtcgattgcctcgatttgggattttccagagaatatgcccgaattttgatttcccagttggcgacctgatcatttggtgttcgaggagtgacacgtgatttaatctcacgcgtatatgtagccgactaacggttgggtggctgagatacgagagagtatattccgaggtatatgatagtgaccactaactatagtaacggttcgggttaaagtgatggtgggaggaagttataatatggcggccgtattgtgttcgggcgtggcaatgaaagagattatgggttcccattgtatcgtttataatgtgtgtatcttcagtgatgtcctccttgcatcgacctacactcgttttggacatgtgaggtatacgacgttagggagtcggagtaacctcggcttgtgccttctgcgtttttggagtagccttttatttttagggcgagggttatcaggggatatacctgcttagcgccatgtatg

SEQ ID NO: 19624 - DNA, 842 bp, Homo sapiens
catcttaggcatcaacgcattgcaggattaaactgcatataacagtacaactcctccttcgcacatctcataatcgaatgtcgctcatctatcaatgcggacattaatcgcgaaaagagtaagtagataaatcagcgacatactacagcacatggggtatatatttaaggtgcgcggctgtttatactgcaattgtgaaatgggggataaatacttgtaagagaggaataatactcaactccgcttgcgacgaaatgatccggtagtataactaatacatgaataacgaggagaatttaggtacggtcttgtaagatatcgactcgattcatcttaaaaaagaacgcgaacgaaacttaaagcggtacggaacagatagaaaaaagagataaaacacaccacgatggtataaaatagaccgaatgtggtcgcggtcaaaattatacagagatttgtaagaaatatcaacatatatatataaacttgtcgaaacacaataattcactccgagacaggggcgtgatcgtaactaaagattcaatgcagtaagagcttgaaccatcaccggtattagcgataactggcaggactctgtataaatagccgccgctcgagatttacagtgaagaagaagaatcaagtgtacatcccaatctgaactactgcattcaaagaaaaattaccactgctagccactctacaagaatagcacaagaacaagaaagtcacctaacttgaagacttggtgaccaaaactcatccagcaaagataaataacaaagaacaatattgctgattaatctcttcctaggatgtacaaagagaaaacacaaggaaaaaca

SEQ ID NO: 19625 - DNA, 681 bp, Homo sapiens
ctcagcgagtacagaacagaaattcttatattctattctgaaagagagtcacactagtagggcccaatgacttttgcagaattacaaaaccataaaattaattcaatgcaggaggtagggccttttcaacaaatcatgttggaacatttgagcattaggaggaaaattttaaaaacccttccaaagctaaatactcaaaaacctttaaactaaacctcaaaccttgtacgaaagttaaattgtgaagactatagatctaaacataaaatgtataaaagtttaaggaaatataagagagaatctttgtgaattattagttttttaggatgagtatgagtacatatataatggatacaaatctctccttttccatcattttttatagagacttacttcctctctgaagttttcctgacgttgaaatataccacaacaaactcagtactgtcaaaagtactggttcttaaatacagagcacatgtgggtattgtttccatggaggttccatattttctatggtaacatctctgttttaatgtctgctgactgtattcatgaacgggactggtgttctgtgtgtgtgtgtgtgtgtgtatgtacaagtgtgtatgttgtgtagtgatgttgggcagataaaataaaaaccagaagactgagtgaataaaccaagatgctgccagg

SEQ ID NO: 19626 - DNA, 1442 bp, Homo sapiens
  misc_feature (1)...(1442): n = A,T,C or G
cggaagacaaagattcgacgcgtgatgcctacaacagccgtagggtgtgtgggcggttggtgtgacaaacaacgtgttgctcctgatgcgcaggctacagcgcaatgtngcggtcgctgaagttgcggatacaatacagggcagtgtggaaccacgtactacagacacggagtttgaggacatgagaggggggtagtgaagcgttgataagcaacgtaagctggtattanattgtngaaataatnggtgcgtattcggtgtgtacttctgcatcagtgatggcatatgaattcattgtactcgtcgaataatcgtctacacatgcaacacacgtaggcgtgagctgtggtactaggcaacaaactggatgtccgggttgagcaagttgtatgtgcgtatgttgagatacctgataaattggtagcacatagtgtgcacggagtgcgggtaggtctgcgctatgccgaatctctgtgtgcccgcttcgcctcctgtgtacctgagtgatggaaagaatatgagcaaacagcaccggcgaatttgaatcagcgcgactgctgcgtgtctctagtcaagacactgcgggtccttagtctcgcgcgtgatgcgcacccgagacgctctcattgtccgccggatagaataagtgacgggcgcgagactatnacagcgatgacaggtatgagcgttgtggttcttgcctgttgccgctcggatatatgaaggtaanggtgtgaccgcagtatagtgatcaccagacgtgttgtggtataacagcggttatgggtgcttatgagtgttcgcgcggattggtattcggtatgcatatggcggtagatggctagagacagatgtagcatagttcgagaaatcggtagatgtgtgtgtgctgagctgcctgtgtggggtgctcagcgactgcaatcatcgactattgggtcgtcgcgagaggtgacggtgtgtgcgtaaaccttctcntgctccatctgtgaaggtcgtgacgcatagcagatctcactgtcttggttacgtgcgaagagcactcacgtctgtcgaccgtgaagtatacgccgacgggttgaaccaactgtggccggtgccagcgtgtaatagtaatgcagacctacgcgagattcagacctaatttacgtagcgatgagccgtcctgtagtcgtccgatcgtacgccagcgtacctgatctaactatcgtaataacatggggagattggatggtgtacgacctcagagactgtgaaatattgatgatagagcagatgtatatagatataaatctgtacttggtcgcggaccgcgtgtgtcggctctgatatcttaggtattatgcgtgtcgcctgtgggctgagagctagatagcgactgtgtggatttgtcataatacgaagatggtgctcgagtgttaataactgtccgccgcgcctac

SEQ ID NO: 19627 - DNA, 886 bp, Homo sapiens
  misc_feature (1)...(886): n = A,T,C or G
aacaacagaccgccgcactaaaaaaaaaaaaagaatttttagctgcacaggctctcttatttaccaccgctacagagtgaagatacacaacagcaaatcatcagggagactttccatttggtatctaaaagagatgaaaatgtttgtactcccctagaaggacgattattaatcgcgaggatctgaccacaaactgatttatagacattatgcaacgttttattttgtcttctgtgtgcattctacacaaagcgaacttgacatttttttttttacccaggtattccncgaaacattacacaaatgctccgagaactgcccgtagctgtaattcatttcccacgcagacagcgcgcccaatcatcttggagacatcaccgtccgtccaatgttatcccacacaatattgactcctagcttacaccataagctacactacatatacagaatcatccaatgcttccacaacaccaccttcactcctgtgttcaatcaaatggcaagaacacaactccgcccgcgatccgcgttatataaaaaactttgtggatcttctaccaatcactctcctcctggcccatactaaataataaattcgcaccaataaccttcccaactcgtcaaaacaaaacataacacattaatttaaaaatataacaaacaccgcaacaaaacgatgccaaaaccnacccccaacaccccaactcttaaactcaatggcattgaagcagctggcagacaaagagtaaatagagacacaaaaatggtacgcgcaaccgcgaaatcaacagcagacgaaacatcccaaactcagtggtggaggcacaaccgccccccccaccaccccaccgagcagcggggtctataactagaaactcagctcacg

SEQ ID NO: 19628 - DNA, 822 bp, Homo sapiens
ttcgcagttaatttgttacccagtcagtggttttgacaccacagtttggaactttaagctcagtggattttttaattttcccccggctccagccaagtatagataaagaagatcccaagaggtgcttgaatggaattttcaggtcaatttttgctgtgggaataatagtaaagaaatggtaacaggacctattttttttggaacccatattttatgggaagacacagtacccatcccccaaaaaaagccaaataaatatatgcataaaatgactttacatggaattttgtacaaaaagcccaaagaagacccgaagatgaagaattagaatgggggaacataatctaggtagtttgtcaagattagatctctatagggaggtgacatttaagattgacaccaaaaggatagaaggaattagtcacatgacatgtagggagaacattccatttagagggggagcttaggccgcgaccatgaggtggcaatgtgcttggctcatttaaaggactgaaaaatgagcagtgtgactacaagatggtgggttaggaacaaagtagaagtggagacataaatcggggccaaaggatgcagaaattatactctgctctagtgtatggattttatttcattgctatgagaagccacagaaggattttaagcaaagcgttgacatgattccatttgaattttaaggtcacttttgcaccttgtggagagtggattgaagaggagcattgaactgacgagacccagtgaaaattctgttccaataatgtggatgtatgatcatgatgatttaataaaacgttgatgcgcccg

SEQ ID NO: 19629 - DNA, 1791 bp, Homo sapiens
  misc_feature (1)...(1791): n = A,T,C or G
acgacgacgagtcngccagctacttaccaccacgtccatccaccgtacgactatcctactctattaactcacacagtcaaatacaganactcgtcgtgccccctacttcgtcttacatctcactcatacgactcgtgccgtacaccagtttagacaccgagtgtnattacgctactagatcacgttctatatgtacngtctacgaccgtaagactcgtctccacactgcgtgtactctaccaacacccgggaccgcacctcagaccgacataacaaccttagcctatgtgttcgctctcaacatcgcagcatgcttatatctcatacgtctcattatgtgtggtggnctgntgtacagacccatgatgagcgctacgcaacatgtaacacgtagcatctcgcacagactcacctacacggcgcaatacaagcagtataacaatatctgtcaatatgatgatgttcacaactataatcacgcactgtgagactcagcncacacgaccgcactaatcatggtgcaagctatgtcgaacgtcttgtgacgagtgtatactgtcatactacgnagcagntatcactcagtagacatagagtacgtctctcacngcgctgaccttntctcctatgaacaatcatatgacacagtacattaatcgnagtacgtgtntacngagttntgtgcgatgcagtgatagtgcctcgtangatttagaataganctcgtgatctgtggcgcntcatgagtntgcgttnangtgtgtctacagtaactgagcattatcgtcttcctgatacagttacgcgcggcgacgtacgcgagagactagcttncgactagcgcgcnacactagtgtgtagtcacacgacgcacgcgacagtcagtgcagttgcgcgnttgtgtgctgtgcatctcatccatgtanacacgcagtgagtntgttgnantntacgtgtcgatgcgaaacgtcatatcntcgctagactctgatagctctgagacgcagtacctcgcgctctgcgcataagnacactatgcntgagtggatgtcgtcantagtantgcaggctcaagacancncanagtacaanctctgantatgtatgcaacagaagctgatcgtacacacgcacgctcgtctaacgattgacgcgcgctctgtacgaccactgcgacagctccacactcgtctgactatatcgtcgccgtatcatcctactaatctctactcccgtaacacacgcctagaggactcatgctactaccgatgtctgtcgtgcactacacacacgcttactaacatatngaacgtccctgtgggcgcgtataattcggtaccgatcgcgtctgctacagacattcactagacagcggtggtagcgcncgtcggctctcgcttgacacaacgatgctgtactgantctacatgtgtcatgctgcgagggtcacacggccgggngatgctagagagatagccactaagcagccatcgtgcccacgccgtatgtcctcgccgatcnatagcacaccacggcccntcccagcatagtacttcacatgctgtccaaccatcatccgagnctctctcacccgcgctgagaactactactntagcctactacagntgcactcntcatctcgctgcacctacacttatctgaatgngttgggtgcgtgcataatgtgcggtagaaataccactaaataatggtgatgcatctacgccacctcgcgtggtggcgctactaactcatcatctgagagctggttgtcggcgatgcactcaaccc

SEQ ID NO: 19630 - DNA, 911 bp, Homo sapiens
attcgcttggatgtggagtattggggggagaggggggctagtcggcaacgactctcttaatctaccaccgttacagcggacttgccattcccaatcccaaagcttcagggcttaattatcgcggggggtggcgggagaagtgacaaattcgtctgacaaactgtgtcataaggtgagaacgacagcgacgccacaatcatcgcattcgcgccggggctgattgttccccggctgatgattccactggtcctaatgcaaatagagactcgcgccccacaacttctgtggggcgaggcggggacctgtacggcccaaatcatttaactcgtatgccttgcttgctatagatacgagtgatcagctgtcctatcccgttgcctttttatgtagcagggacacttcagatctgtttgtccatacagagcctcgtccgatgaaatgcgttaaggttctgccttagtgggtgcaccacttcgtctgggtgcaccggtacgcacgctgcatgtctgctgatcagttggcgctcctagaaacttcgcattgtcgtctatcgtcgcgcgctccggtgcgttgtgttcgatagctgagaagatggagaggggctagagtggacctgacagcggcttggccgtgggcatttcgccccgtccaatcctcgcgcgcgcgttatctccgcgccctgtggatgacgggtaagattctgtgtgttcgcgcccgcgcgcacggattacagcacgcatctgatcgcgcccgtaggagagtgttgcggcgcagggcaagacgaccacagaagatgtgcgggcgcagcgagtttaggggcggttcgcgcggaatgtgtgggcgtgttttgacggccgttacgagctcgggtcggagcgctttggagttggcgcgtcgtgtgtagggtgtat

SEQ ID NO: 19631 - DNA, 872 bp, Homo sapiens
cagagacacgagcgagaacgagcgaagaagagaagagaagggcctagtgggcgacgactctctgaacctaccacggctacacgaggctcgccacacagaaaccgaaagccagaaggcttaactcgccggggggggccgggagaacgcacaaagcagggaacacaacccgcgacaaggagcaaagacgcggcgcaaaagaacgcacaaggcgccgggcggggggccagcagaagaagagagacgcacggaagccacaagaaacagaggcccacaacgctcgtcgacggggcgggacctcgcagccaaaccagacaagcccaagcccgccggcaatagaaccaccaacggaggaaaacacccacgcacccggcgacccggcacaccaccgagaggaccagaagaaacagtgcgagaggcgaggcgcagcgaggccgaagagggaccccacaagcgagcgagacggggccgcggacggggacggcggggccggaaggaaagcgagccgccaacaggggaccccccggccggaagagggaccggggacgagaaggagccgggcaacgaagcaacagaaggggacgacgcgcaccggaaacagaaacaaggacggcggggcgaggaaggagaaaagagacgcacgccccaggcgcgcagtcgagaaggcgtagggcagcgggacacgccggaagcgaggacccggggcggcgcccgggcgcggagaagagagggaaagccacagagacagaaccacgcgccacagcggaacgcgcacgagcagacgcgacgagagccgaccgacgatggccgaaatcgggctcggggcgacgcggagcccccgggagctaggccgacaaagcccccgcgagaacgag

SEQ ID NO: 19632 - DNA, 851 bp, Homo sapiens
ctgccgatctttctttattaaagcaaataactggacataatcttaaaggattccacctccatcgtctttcctaacttagatcttcattgagaaattgggcaaggttaagtttacttttttctagtgctgcggttttggctcgtcttggtagtctcatcttcatttctgattctggttctggaacttcatgatcgctttcagagtcggcttcagcagtctgacacctcctgttcgtcctagctgaaactgtcacttttctctgtcctctgttagtctttagctgagtagactttgatgcttgggttgcttttacacccctgagtggagtcatatatacttctttattcttttcatcttcattttggaaagtagttgtagtcaaggtggcatcctgtgctgcttcagcttggtcaccaaattctttatttcctttttctaactgaatcttgattttctccaaagctctcagacatgtcctatcttttacttgctccagaatctcattcaatagaaccagaagatctttttgcagatggctactgagttctaaagaactcaaggcttttgtatagactcgaatttctggcgagcacggacttgttaagatctcattgcaaatttcatagccaaattgtcatgtactgttaaggcctgataatcttgggaagtcttggcccgagatttaatccacttggtcctggcaatctacaggtactcagcacatttgtgatttaatttcagctaaaggaaagacgcaggcccttgggccatgtttgcagggtggaaaaaacctcttcaagctttctgatggcctgcgtgctagcaacccgggaaacccgcctagcatgtca

SEQ ID NO: 19633 - DNA, 916 bp, Homo sapiens
ttcatgcgtgcaacgactctcttaatctaccaccgctacacgttttgcaaattgatgatgtcacaataaaaataattgctttaaaggcaatctttgaccaactgatgacgttcgggattgaaccatttaaaactaaaaaaatcaaaacacttcattgggaaggtacacaaataaacaggggtgatgagcaagaatcaaaagaagttgaagagactggctcagctaagaaaggtctttttctccttgtgtgattcttagaaagggaggtgtttgaacttatgactgggagctgaaaaggaatacccactgcttttttttttggggtttcaggaaaacaaaaaaaatttttctcgtcttatttttgtcccgggcaaacgctggggggggagaggagagtgcatcttactcattggccgaggggtggttcttcccccttttttcgttttgacaacgagggccaatagatggagttggttctttagaaaattttggttctcaaccgccgcaatgccgtgggaaaagtgcgccgatttctttatcttttagccaggaaaataggagagacggtggaggcgagagagccgtgagagataaaggagaaaaagggggggtaataatcttgcaggaagaagattgcaggggtagcggcgggcctatgaggagataggggggaagtgtggggttaaagagagtacgggacgagtgagacgtgtggtgggcgcgtggcgagtatgctgctggcagacggccggcagagtggtcataaaacgagtgagaggcagtgatagaagactctcggtagtattagcagagaagtggcaggatgggaaaagaattatagggtgaacgattgagagcatgttgagtggtgttttgaagcaagatggaggaggttgaaagaataatggaggagaag

SEQ ID NO: 19634 - DNA, 1441 bp, Homo sapiens
  misc_feature (1)...(1441): n = A,T,C or G
aagagggaaaagggggnggaggcngaagagagcaggngatggnanagcagaacgcgggagaggtcggncaagggagacgganagagcgcgnnanngnggaggactttancgagaggaacaaccccagaaaagacagacagggtccttaantgtgnncggcgcagcgcgacagggtgatgtggcacaggcatcggcgcagcacacagagagaagagaagaaaaataaagtgacacccaagagcaaagagagagacatagnancacacgcccgcacctacgtcatgccaacacgcgacatcccagcgtacgcgaagtgcgtgaacgagtgacacgggtgagcgagaatcgataggagcgagagtcgaatgaatagagtgaaatacagggagggtgagtgaggcgtgggatgcgggcgtgngcttacagcgtataggttcgtgacgtcggttacgtcgactgtgcactaaccgaagcnacgcggcgcgacccgcgcagcgccgcacgccactcccgacgagacaaanagataccaccctgcagcccctcaataccgcgcaacaagaataaaaatacccgccgccacactacccggccaacggccccgccacgttagtaatataaggaatccaacgggagcgcttcgcgcggagtaaccgntcatgaccgcaggcgcgtgcgcggtgccgcgggcgcgtggcgccgacgcgcgagggatggaagcgcatggtacgcagagacgactaggaagcgcaccagacaacgcgtactgagactcagcatattaactaacgaccagctctcatgtgccattcctagtgcttcattacgttcctgcgcgcgctnacgggagcgcgccgcgagctcctcgtctcgtgtaagacgcaaacgagacgacgtccaatnactaagcgtcgacataaatcgagtgctaatgaactantgatctgatgacgcaaacttgttacagtggtggatcgaaggaggtagtaccagtcatggagagtgaattgtagtgccgcagagaatatgattaatatagcagtattatgtacgacaagatagaaaggcggatctgcaagcagtgcgtcacgcacagagctgacacagatcggacgccgccctagagttgtcctgtatgtgatgttcgagggaagcgcacggatgatatctgttgaattcggtactccgtcatgatattgtaatctgagtcaggtgtgagcgatggcgcgcacgcgnantatgcacgagtngcgtatggtatgcgctccatggcgcgcgtcacatgcagcgaagatgaccacactcacactagacccacaagcactagtacttgtgatatgctatccagacgagcacgacgtcnacgatggaaacgtacaagtgtgtaggtngagcgatgtgctgcctcgactcgagtccgtcgtccgtcgccacgctgcgg

SEQ ID NO: 19635 - DNA, 409 bp, Homo sapiens
acctcccagtgccaagtgtataagtgtgtctggaattggtgggttcttggtctcactgacttcaagaatgaagccacggaccctcctgagatggagtctttgttctgtcgccgggttggaatgcagtggcatgatctcggtccaccgcaacctctgcctcctgggttcaagtgattctcctgcctcagcctcctgagtagctgggactacaggcgtgtgtcatcatggccagctaagttttgaatttttagtagagacgaggcttcaccatgttggctaggatggtccgatctcttgacctcctgatctgcccgcctcagcctccctaagtgctaggattacaggcgtgagccaccgtgcctggtcaaacataaacttattttcttacctctaaaaaaaaaaaaaaaaa

SEQ ID NO: 19636 - DNA, 1227 bp, Homo sapiens
  misc_feature (1)...(1227): n = A,T,C or G
aaaggccttcgcgggggaaaaccgcggggggggagcgtgtcgccgaggcagacagaacccacagagaagacaggaaggggacagcagcgggcaggaagagaaaggagaactttgcaggcgagcngcgggagagggaagaaggcagaacgcacagcgacaaagangcgcgccggaagacacggacaacccgcgcgcacaacgccgcagcacgcacaccagaggcgcgagcataataaacggacggcgagcgagcagcagagcgganaacgagcgatagagcgagagatgagagatggagagcagagagaggagcaggaagtgaggcgngaagcgcagcagcatcatacacagcgcgagaacaaccacgcagccgcncgcncgcagcacacacacagacacgcacacaaccgcaccagcnacagacacacccaccacgacaacacacaaccacaanagnggacgcccaagcgcagaaccaaccgcgtctgacagaggccgngcggagagaagagagaagcagcgacnggagagagggaggtcgagaggtgtggtgagcggggagtatggagagaggggagcggcacacgcggacaagcgaaggaggagggagaggagaggaggagaggaaggaagagcgagaggcagaagggcgccgccacaacagaacggggcgcggcgagggcgaggacgcagcgccggcaccacccggcgcccgcgagcacgagagcgaatggccgcacaacgcagcccacccgcctcacaaacaacaccagcaccgatactaacgcccccccgaagccccagagaggacggaagagagaaagagagagacggagaaaggggaagagaggagagggggaggaggcgccggggagacggaggagcaggagagggacgcggaaggagggcgagaaggacgatacaccaagggaagcgacgcaggagagagacccgcagaacccagagcaaggaacgcggagcgcgccacgccaccgtcgcgaagcagaaacagaagaggcggcgggcagaacacggcacagccggacaagaagcacaggaggacacagccgaggaggaaggagggcaggggggagagaggagggggccgagcaggcggccaagcggcgggcgccgaccgcgcagagggacgacgccgggggcaggacgggtcgcggacgaggcggggcgcgcgagaggatgcacggcacacagtcacgggaagaagca

SEQ ID NO: 19637 - DNA, 637 bp, Homo sapiens
gtatattttgtgattaatacgttcgtattatttatataatttgtaattcattttatttctggtagagatcagtttatatgttcgttcttttaggtttcgttgtgacgtttatagtggtatgagtgaatatatgttgtaaagtgtgtgtgttatttcctatagttttgtattaggttgaattacttttgttttgtctggttttggttcattggctatttttggttaggccatttaatgtagtttgtaggccacgggtaaaactttcggtggtatatcaggtattgtttgtgtcatataggcctcctcttgtgctgtctagggtcttactttattctaaattgctgtagtcctccatggttagtgtgttgcaggtcttcccttttattactccggtgtatttcccgcctttgttgtttttttgtagctcgttaatacgagttcgtttatagagatcgtggattgtgtcgccagtctagttcgatccgctatattgttgtgcggatgaagttgtgtttgtggtctaagtaccgaaaggtctttccggaaaactcgacgcaagaaaaatcagagagatcctcataaaggccaagaagggcggaaagatcgccgtgtaattttagagtcggggcggccggcc

SEQ ID NO: 19638 - DNA, 2024 bp, Homo sapiens
  misc_feature (1)...(2024): n = A,T,C or G
gaaaaggagaganaagaaagtanntgagaangcagagatgagagaggaacganagnaggcgnangagcgagcacganctagggaaacngagtgnncgangncanggtacgactcgtacangncagtncngtnggnagngnagtgcgagagnntcttctacagagacgagcgagcagtaaaccanagcagcagagcagcgncgcacaganatgctctttaacacanctagcgccggtactacnacaaagcccacagtcngatgtagtaaatgagcgcagcccantnacgcaacagagacacacgcacaggacgacagaagaagtanagagctatttctatcacancagcagagcgcgggagtgcngcgcacagagacgacggccggacacactagacgactcnacnatgtcacgctcgagacgcacagtatcgtcgcagcngcgactctgtagcctgcagcgctgcgtgngtgntacgattgngtgcatacaatgactcagtatatatgntctgtatatgcagtctctcatctgctcgtgacgtanacatatgatagnngttacnangtaagntnatagacagcgcgtgangacgagtggggnagcgaggatgtgtancagacgagaggcagcaggangatccggcgngcgatgtcgcgtcgctgatganagcttggagacgcgcgtgtgcgtgtgctcgcgatcgcacagtgatangctgagacgcgaagcatagagagcgagagctatgagtgncgcagcagcagcgcgcannancgnagctgccgagtntcgntaacgagcagacanaantatacaacagcagtnagcgnngnagntcgagntgngcanacagcgcatcgaganacancgcagatgagcanacaaccacgcagtaacgaagactcaagntcgcacacgncacacagtgncgagtcggtgacgagaggtntaggatagtaggtcagaggcgcacgacgcgacgcaaggncagcgangacgncgcagcgcatgacgcagngcacgagtgatgctgtgtgcgacgaggagagcgtggagagtgtgggatagcgtagcgcgcgcatcacgtccngctctgcgcgaagacgatacgtgagttatncgtggacgagcaagacacgagagagataggtantagggaganagnacgatgcacgatcacagagagcgtgcgacactngagagtagcgcatcnanaccgtagtgcagacagacacgggagntcgtcgacagctcacggcaatacgtactagtaggctcctacagnaatcctctcctgcgttcnctctaccgatgctactgtncgtccgcncgtgagaccgcgcagtgagcgatncntcctcgatcgctcgtntgctgcgcactgagactagtgtgcgtagcagtncgacaggagtanatagtggtactgntgctatntaagctctgtatcgcgagagagctgtgcagagcgcactgacgttgattacgagcgctggagncacataggtatgcagcacnagcaacnangagtntcatagagcgacgnagcgcgcagcgagccgnaancntacgagtccactgatagaagacgaccgcgtcgtaagtcgcgtaggtgaagctgtgcagtcactgcagactcgcagtgccgtgtgactccgtattcggactgcgcggngtgtgntgagaggtcggaacaggtgcacactaggatagtacgctgtagacgcgagtccgtactatacgccgggtcagagtcacaatgagtccgctgtgcatccgacgatcgacaacgcgtgatgcatgaccaccntaggtctatagtgactgagacgtatgactataacgcangttcacagagagtggcgcgcacacgcgtgttgcggnagtcctcaggcggcgattcggatgtgggaggagagtatgtgcagcgacaagcagcggagcgtaagatacgcgncnagaagcagatgacgagcgaaggacggntacacgcgtagaccgtacgcattaggaaaagataag

SEQ ID NO: 19639 - DNA, 1859 bp, Homo sapiens
  misc_feature (1)...(1859): n = A,T,C or G
ccccccgggggcggnccggggggnnnnccnnnnccncgcgcncntccccccnnnnannggggtatttttttctttatattccccaaagtatcagtcccantcgntatgngtcgggcgggtgttcgtatcggcgcgccgcgcgcccgcggcggccgaatgtgcattacggatatattaataccgagatacgacattacagtctacaataattcgatcncgacgncgctgtcggggactagtggtgggtatgtgtgtgtgggaagcagcgtgtcaccacaaactacttccctccacccgctattttactacctattattcatcatacgcgaccggcggggcgagcggggagccagactgtctttcacgtcgtattaagaagaacaggtagaagatattataataagcccaaagacagagggacacgatagagaagacggcagtgtagtcactcgaacgcccgataatcgcgtgtcactagtgagctgtcgcacgatntacgatnagcacatctcacacgccgcagagttgcntactgagcagcangtataataagtgtgtagagtngtgacgaataatcgnagccaacccgcagagttgtggcacagagataacatcaatnttatcacctaatagtagtgtgtctggtagttctatgaagcacagcacgcggtcacaaccaccattaactatgcactcgctacctgtacgccagcactgcantagcggtacgccgcgcgtgcgcncgggctccgtcacgtcgtcggatntggcgcttgggtcagtcanctccgctggagtcgcgtgtggacgtgtgcgtagtcgtcacaccagcgtgcatatcagttgaggttagtaccgcgcacaaccancagacggtgccnctgtgtattacgttagtccgcgtctattcgatcacacccctaacactatgaaagcgctgcgaccgtcgtcacgtgaccgtgctgtcactatatgngtgttctcncgcgcctcacgccgtcatatagagtgcgaatttctatcacgtcgactaggacacctccgcctcgttatgtgtatcggangtgtagcacgcgagancgacggttgtcgcgacgttgctgttaagttgtccagtgtagcacgacttacagccgacacccgccaatcgcgtgagttgtacgccttagatcactagtctttanagaatcgtaacagtgcggcggcggtattccgtgcccgcgcgtggtcggtacgcaagttacgtatgttgctccagtcccctcatgcctgtaacatgtagcgtggcgtgtgagcgaccctcgaacgagctgtgtcgagtgttgcgaccgcccccgcngccaccatctacacttgtgacgactgagtagcgcntggagataaaacacctgtgatcagtctcttatgctcaatcatagattagagtgatagtgagctagtaaaatatcccgcgacgccacacaccgatgatatacatgtgcagacgacgtactaacgccgagagtgccacgccctcaagcgcangcacggcgtgatacgctgtagtgttacacgcgatgtgcgtagtcnacgtgggcggtgttagccggcattatagcgaggtgagatgagatgtgagcgcagatcgagctcgcacacccatacgggtatagacnagcctattcggagagntaggacctgacgcacacgcgacnctccgtgtgctggatgtgtgtctgctctcacgcgcacgctcccgtccacatntatagctcgcacgagtcttgtcgtttgtgcgacgccacacgcggcgaatcgtgagtatgtatgtcagcacatacacacagcacgccggggtatgagtgggcgtgcgacgacgt

SEQ ID NO: 19640 - DNA, 703 bp, Homo sapiens
agggtgattatgtgtatattcgcactgatagttaagatatgtgacacaaacacaaatacagtgattgtagtcactgcaacggggagataacatgttacggtgggttatgtgtttcagttttcacaccaatcttgttgggtgatgaaataggatcaatagcgcggggtaatcccaaaaagtgatatgtagtggaagaggtataatgatatgagggagatggtgaaccatcatggaggattccacgcctttgataccaaaggggaaagaatatattttaaagacatagattcctgggtgtggaggcggaagtttatttaatcgttgcccgccagcagtatttttattaagctcaaagctgtccaggtgggttccagtatgaagggaaaacattcttgtttcaaacaccccaacattctttgcgcagggtgttgcaggtattcccaccgatgaggccggggaaaatactacccgccgttgttgttttggagcacggaaaacacgatcacggagaaaagagatcgtggattacgtcgcaagtcaagtacatcccgcgtataaagttgttggaagaagttgtgttttgtgatgaagtaccgaaaggtcttaccggaaaattcgtcgcaagaaaaatcagagagatcctcataaaggccaagaaggacggaaagaacgccgtgtaattctagagtcggggcggccggcc

SEQ ID NO: 19641 - DNA, 1071 bp, Homo sapiens
  misc_feature (1)...(1071): n = A,T,C or G
agcgaacatgtacgcgaatcgtatgcgtgtgcatagcgtgtcatacatcggcaggcgttgcacgcataatgaaggcgatcgtcattctacggctattacaatcggantcgtaaacctcacagacgcgtatgtaatacaacgagcaacgaacgaagagcaacgcgaccagcatactgggcgcgacatacatcgtggcagtagagggactctgtgggatatatgctgtcacactattgtatcgaatgatgactaagatgtagctatctttaagaatggcgtcataataactatcgcaatcgatatctcatgtctcataacatacataatctatctgcagttataaatttcagactctttgatgacataactgtcaaacggggtcgtggagagcgaccagtaatgcagactgatctggcgtggattacatgttaacacgtagaggaactctatgggacgaagtgtaacttatacttacttttatagtgctgtgttaatatgggcaatatagngcgcctcacgacgtagaaaagcataaaccgagggagtatcggctcagcgtctaagaacgccgtgaagtgcatatatggcgcgatatcttagactcggcggggagttatagcgcggacggcgaaaatgaataacatcggcgggccacgcaatcgtactaacgtatactctgaacaactagtatgttctaaacagaggtgaacgtgtccaaaggataagataaccgaaagggatttagaaaaccgaatgcggcgcgagctcatcaatcgctacttatcgttcattaaaatataatagccacacatctctggcgttgttagtttacattgggggttctcggattagatatagctcggccggcagcggatggtctctcgcactataatcgatcgacgcgtgacggtaggaaactatgaactagatgaaagatagatagtaaatacatgtgaaaggatgatcgggaacggatgtctaatgcggcaaataaaagaaagctaatcggactccgaggcggcaacagtgccgatccgcggtggcaggaaggggctctcggtnntttttcgt

SEQ ID NO: 19642 - DNA, 1061 bp, Homo sapiens
  misc_feature (1)...(1061): n = A,T,C or G
aagaacggacagaggcagcaataagaaaggagtaggagaaggagccttaaagtngacgcgcccggggcctgggaggngaaaaccggcccgcggggggagggggggaggcaggaaagtttagagaggggagaaaaggccaacgcccaaggaaacagaaaagacgaggaagcgaccgaagaaaggacgcgcaagggcagacgcggagccgcaaggagaccgcggagcgaggccgcgaaggagagacggcagcaaggagagggacaaacgcaggcccagaggggaggaggcccctttttttcccccaggaggcgcaggcaccagcggaaggagggcgggcgcaacggaagagcaacacggaaaaggaagaaggagcgaagaggcgcacaacaccaggcagggagaggaagccaccggccaacaccgcgccccagccggcaaaagagggacgaccgngaagcggccgcgaaagagaagaggaacgagaagcncccgcgccacaacagacaaaagacaaaaaaagcacccccagcagcccgggaggcgaagaacgacacgaagagagcgccagacgggaagcaaacggaagcaccaccgagcgggaaaaaaagcgagagaagaaggagaacgaggacggacgaaagaggacgcaggaagggcggcggacgcgagcgggcgcggagcaagcgacagccgcccacaaaacgaccaccgcagcccggagagaagaaagagaggcgaagaaggacaaggccgcgcgaagaacgcagcacagaggaaggccgcagaaagagcgcgggcgacgcgcggaagaagcgcgaccaaagagagcgacgaagaggaagaagcgagaccacccaacaagacggccaggaggacacgcgaacacgaccggcgaacaaaacaaaacagagcgcaaaggcagggcggacgaaagaagaagagagagcagcagagagaaaggagagcgacgagagcgaggagagcgcggcgggcccggcggcgagcggcgaagcagcacacgcaggagcggaggagcggcacggacagacagagacccgcag

SEQ ID NO: 19643 - DNA, 1257 bp, Homo sapiens
  misc_feature (1)...(1257): n = A,T,C or G
gggttgtaagagganaaaaggaaacgaaagaatgaaagggcgtgggagagagggtgtgaagaaagaagnnnaatacggacagagcggcgacgacgganacgctgtcaaagttaaagtaagatataatagagtacgccgaagagagccacgagtaggatgtaatataaatatggtnacagttagtataaggaaaggttggggcctctggttgactaatttctagacttctaacagtagagagacgaacgcagaaggagacttaggagatagtggtttgaggtgaagaaataaggtatgagatggatagaattgacggtagggtggtgagaggatagtagagattgttatatatggtgtgtgttattgtaagtgacatgaacaatatcaacatagtgtatatgagtgaatgatcgaatatgacatatatgtcacaaaaatgcnacgattcaatatcaacagttataaccataaacaaaaatctatcacacactagcaataatagatattgatagatgacgacagacagcnagcggtggagtaaggcatagtagtatagttaatatgcgatgttagaaagngagcgtaataggcaaacacatgtgagagaagcgacggagagtatatagtagccgtcgcccgtcttacttctcctatcgtactttgtatttagtgtttcttctacatcatataataacgctctacattgagatatacgatatgtcacgtagcccgtcctactattagtnttaatagatgacgtgtttagtgagagttatattgttttnatacgaagcgattatttatagatttgatatgaacaatgggcgattatacggtgaatatgtaaataagtgtagttagtttacagngttctttggatgagtaagtgtatagatgtgaagagaggtaccattgtgtatcatgtgtatgtgatgtggcaatgtgtgcggcgctgtcgcacactgaataaggtcgcgtatggttgattttgtgacctatagtagaanagttcatagtgaagatgctagttagtactggataactgcggtgtggtagatgagcgtagtgtgaccttactacatgtcatactatatgttccgtatctgttaacgggaataatagacaggtgcatctaggtaaattgaattgtccgtgcgttgngtaatctacgattcactcgctacagtatagtaattatgttcagcgcttgaacgtgtcttcaagngtgtatgggatgtacaagtgatatcatcatct

SEQ ID NO: 19644 - DNA, 826 bp, Homo sapiens
cgaagaatgcccccaggaagcctttttaaattttccgcttcagaactggggaaaggtaaaggcagtgaaaattatatatttcaagatgaaaccaaataacagggatttgagaaagcaggcaaatgaatgtactgtaatcagagatgacaacaggggtttattaagggttaaggtaccttttcaaaaattaagtgataaaaaaatgttatccaaatcagtactttccttgactcttggtctttaaggactaggtacagttattatctcgaagtcaagaaaagtacttagtttatacagatgcttctagacctcaaaatggcatttttaaatgaagacagcacttcaaacaccacttcatgtttcaatactatctctgactttaggaataatgacacacataacaatctctaaatcatgtatatgaccttccttatgtacagtactctaagataaactcctaccaaacaatcaaagataattttttcacttacaaaggttcctcgtggtcggctaactcctgcaaagcctgagtattctttcatttcatggtgagttttaaattcttcttctctttccttcttactctccttttcttctcgagaactgggagaagaaggtgatgctgaagaggatgaagatcgagaatgatcttgctctcttttatgtttactgcaaaataaagaaaacaaaaaatgtgatacttttaaaaagataaagaccctgctgaatcttacaacagaagagatatttttcaagtcaacaacactatcccctaataaaattatgtaaataaaataattgggtgttaaaaaaaaaaaaaaaaaaa

SEQ ID NO: 19645 - DNA, 610 bp, Homo sapiens
ggccgggagtgaggaggatatgggagcatcctccagaaaagcagaagaaagggctccagcaaccatggataatgagattaccaagctcttctgggaagacaatgtgttccaactttggcccgttccacatgctttctttatatgagtgacactgctctttacccacaagctagatccttggaccgcatcttagacctgtctctcttgatgcgcatgcttaggatgggggccgtggacgacaacagccttgctctgacgatacactatcctgcctagagcgtcgggagggcacgcccaggcccacacggggtggatctggggtgggtcacgtgtgacaataggtgaggtttcaccctgagttggccttccctacgtgtgttcctcccctccacgcgaggacgaccagggtcacgacccactcgtccgtaacgacgcagatcgttggacgcgcggaccgagtccacgatgaccgctcccgaaccgcgggtgtcaggcgcgggtggggtccgagatagtcccccgcccgcccaccacgactgtgagacgcacgaacgtaagagcgaccaggcttggaagtccgcgtggggtgtagaggaagaaagagagaaag

SEQ ID NO: 19646 - DNA, 629 bp, Homo sapiens
aggtggggtgttgctgagaaagagtcggggaacccgaggattaaaaaaatatctaagagatgtctcaaaccatttacatactgaccttattgggatgctgattaaaacaaactacagtcctttagattcttggcttagatgtgagggtctgaggagaagactttcctgagctctgaatctatattacatgccatcctcttttttttccactatacgaaaagttcctataaatgattttttgttctgtccggatgaggcaagtcggaattatcagccgagtgctcagcctccccgcttgctacaccactagcacatctcttttcaaagtcgttatatgatttctaagatttatgcagccgatattgaatatgctccttcacagctacctcaatccctttacgcctcctcccctcatctatagcccaaacgagctgctacgctagtttgagtgtctcatgtgcaagttctgtcagtgatgggtaaattattatgttaactcaatccccccgctccttccatctcctgctccaatcaacatcccacacttccaccatatgcacaggccaccactctccttcgacacatgatgctgtgagacgagagctgtggtcaactcgtcgacggcatcg

SEQ ID NO: 19647 - DNA, 382 bp, Homo sapiens
  misc_feature (1)...(382): n = A,T,C or G
agatagagtctggatcactgtcctcagagatggaagattctacagccttgaacaaaatctgaatagctttagaatttttcacgttagacacagcttctgtactttttaaaggaaagtaagcatgatggcaagctgttgcctcttctagtctacctgacaaagtctatggactttaagtgatcnnaaaacattaagtttgacctttaaggaaaactgaaatctacttccaaaatgaaattagttttactttctagattgcactggagaaaaaatatttccagcctcactttcaagacttcttttgtcatatgaaattcttaaaacaacattgttttctatttattttattaaaactatgtcacgagacaaaaaaaaaaaaaaa

SEQ ID NO: 19648 - DNA, 1084 bp, Homo sapiens
  misc_feature (1)...(1084): n = A,T,C or G
acaataaccatgtttgctattcagaataatacatttgtggaatattctgggggattctttatacactagataagttaaatcctcgctttaatataagaactggcacataaagtgacctctatgcgtgaataaataccgagatcaccataaaaacgctgtggtcatcgcatacacgtgttatagcatattaacgtaaaccgaatcccactaagaaacgtgtgagaaaacaaatgtgaacatgcgggactgactgggggcgtccangttatcaattcaccctctgcaattatcgaatgattggattatgagtgactctgtgacaaaaaaaaataaataaaatacaattttgagtacaacatcactgctgcaacaatagtgatactataaacaattctgtcgtcaccgtccgcacgaaaaagttttcaacagattttcaacaaaaatcttagcgatgtggggcgataatacattactctgtcgtacactctcttatttcgctatcttctcatatacctatttgctgccactcctgtttttcgtcataatattacagacctattttatttcttaacccaacatattaccccccccttttgtgtcgggggcacaaaatcccaaaaataacaaaaaatgggggtgggtggaaaatcttatatacaatacatttttaaaggtataaatgttctgtcgaaacttgtagtgaacaaaaacaatgagaaaaatgggaagaaaaaaactatctctcgtcatacttaaaatttcaatttatttgtgtgtgtattatattaatatatataaaaggggcttgccaataaatttttaccatttctttaataatattcttcacgtaataaataacgtttttatagcagcacaaggaagtggaatgtaaatataatttacacttcaaaaaaagcgaagcagagtgtaattaattgtgcttatcgtcttagtaagttagtaatgaccctgtttaaaacatcgtgctatgaatcacaatatagggtaacatgcccggataactgcttagtgtaataataattataaatttattgttatctatacacacactcttcctagtaca

SEQ ID NO: 19649 - DNA, 807 bp, Homo sapiens
ctcaatctagttatttgtagctgcaccctatttaaagattcccaagcgataattttcctcattcactgtctggatgtctatatattcatcgagcaatcgctacaccacaacttactaaaccatgagtaaaagtttatgttagtaatgacgcaatgaaagttcttaaaataaacaataaatgatgtacgtgtctcttctaaacccctatatatttgttaacatcataaagacaggtttgaaatcggcacattccggttcttatccaaaaagcacgtggactatagtacacaaaattgtaaaaaacataattaaataacatatgtaacgaattggtgacatgaatgatataactaccatctaccttttagcaagaactctacttccacctcacctgctatcaattggcccacaaaagtggagaaaactggggagttaagatttgtaattcatagtcacatcaaggtcttcaagatctgcaaaaccaacaaatacatactcaatcctgattctaagtatggtatcttccccagactttttcttctaaaatatggatgtcattgacgataatgtttatggagataaggtttaagtgcctaaaaaaatgtacatatacctggttgaaatccaacactatacatacacacccccatatatactagctgttaatcctatggaatggggtattgggagtgcttttttaatttttcatagttttttttttaataaaatggcatattttgcatctacaacttctataatttgaaaaaataaataaacattatcttttttgtgaaaaaaaaaaaaaaa

SEQ ID NO: 19650 - DNA, 1650 bp, Homo sapiens
  misc_feature (1)...(1650): n = A,T,C or G
gcgactacagccacgtccaccctccgcactgtntctgttctgtctgtgcgtactcgccgattatctcctcatcttttcccgcncgcgcgtcttctatctcacgatttttatgatgtctgtncactccgagctcttgtccgcgcgantagagtcactgctaccaatacacatacatgcacagcgcagccggctgagtngcagagtgtgngntaatctgatgactactacatcacagaatacgcgctatcacattanacgctttaccttatcgtacgtcatactcaatcatgtgtttgacgaccatgtagtgtgttggcncgaacggcgttagtatcaagttcacaacctcggtactaccagttaacagctaacagncaagattcaccagatataccacccgctacgctcactacctatacgctactctcgctgctcacctgcgtcgacgcgcgcgctgcactagtgtacctgcgcgtgtaaaantatatattngtcttnctgctgtantgcgcagtgacttgcgtcntgacacatgtagactccgcgcagctactagntagcaatgatatatagatatgatctctgactcatgtatgttctcctcagtgtcntcacgctctcccacgcgtgatatagcaccgttccgcatacacgactctgtctctggcgcctcgagcgtcgcgctatctagtnttcatcatatgccataattggcacaccgggttgtgcggctgaggaatcntcttgacttgagcctccgaacatgccagcgcgatattaagaatcgtcgcccgcacgtcgcgtctatacgcggtcttgctcgatattgcgacctggtgttcttgatagttagtcggcagagatgtactcactctcgttgtcgtattcgtgagtacgtagcactcgtgcctgtacacggaactgctgctatgcggagtgcggtacgacactatttctccggtgtcctatttcgcatctactcntcgctgtcttngtgattgtgacacaatgctgcgatacacacgcatcctactagtgtgtcgccacgtacgtccgcatttttgattattcgacggacgtgtncaacacacatacgctgtagtgtatagacgtggtgtacgactcgcgactgcgcactacgacatggtatctgtttaatatcgtatattgtatataacaccgaccggtgactgctccgtatgttacgcgcgcttatgtagtnctgtctcgatactgctctctctagtntacacttatagcgtctgatgttacatccnactacatatctctgcacagatgtcnctcgccgtgtacgagctgtgttccttcgccgtactcaatctcacgtatatattgatggagtagtcgactcgacgtatataatacccgattatgtcctgtcagtacatcggatagtagatcatcaccgacctgggcgtcactatcacgcttatctttgttacggttatatatagacggacccgcgtctcttcgtatgtcgtctgtcttcgtatgatgtcgactcgacactagacgtgagcggcgcgatcgtagtnatagtcgaagacctccncgcttcacctatgaccgtatccctcgatgctgaacgttcatgtgagctacacgcatgaggtgcttgttttgtcgttg

SEQ ID NO: 19651 - DNA, 832 bp, Homo sapiens
  misc_feature (1)...(832): n = A,T,C or G
ctagtattcacaaacacttctactaaacataaatctgtgattgtgatctctgaaagtcagtccttttatctactcaaaagaagacactaaggttttcagaaattaaattgctttttggaaaaggtgggagattctgggaacatagaaacttgaatccagttttcttcaactccacgtcaagacagttgcattgtgtgagaaaatagctacggccatttgtggtaaaatcacatatatgcaattatgtgaaactaattgtgtatatgtatctgtgtatgtgtgcgtgtacaatatataaactatcaatatttatcaaagtccgtatagctgctagcaatgagggggatctaggattctatcacatgatacctttttatgaggcctttgttctttccagtacatttgtcagctcgttcatgaaagagattcttaattatttactgaaatatcacaaaagtgatggtgagctaggttgccacattgatcctgataggtccttgacaaattcatattgactctccacaaataaaactataaggcagtttttcccattgtgatgcntttgtctacaatcttaatttgtaacntcttccaagaataaacacaccatatatcaattttttaacccatttaggtagaaatatgggtatatagaaaggaggaagcaagggtaacggtgagcagtggctaaatgaacaagaaacattcagtaagtatctcatcttccaaatgtataaactggggcagaaagtactttgttgaatcaatagttcgaaacagacatccagtagggccatcgaagggtccaaataaagcactgatggaagattgg

SEQ ID NO: 19652 - DNA, 788 bp, Homo sapiens
aacccgcatatctccactttttaggaaccaaaggcctgggcaccaaaaccctccccccaaatgatctgtgacgcaacaatgcatgtcagcccctgtaaagtccaacctcttaccccgcgaatccttcctatttaagatagaggtggtgcaaataaacaggttttcaaactgcagggaccgtaacaaacaatattccccctccacgaaaatgtaatttataccttccaaaaataagaatcatataccatataacacactttatagtaagcactcaagtaaaagtccccaaaacaagcccttaaaaaaaggttaatcttttaacaatggggtcatgacaccatttttgttaaagaatatttttatgttcctccttgtaccaatcaggattaaattttcaaatattcataccatttaacaacagcctgaataaataacaaagttgttaacacaaaatgaataaatgttttgtatacgttaaaaatagaagatagaaaaaataacttggtaatgtgtttaaaatattttatggcctctaccccattatgttattccattttctcataactgtagacctttagctaccaaacagagggaaggggcattgtacactagttacctagaaaacaaatcatttataggtcttatttttggaaaaggagatatcttttaattcaactaaaatgtaaaacattggaagtgtccccctatcaaggcttagttttactattgcttaatatagatgaagaaaaaataaatcatatactaaactcgaaaaaaaaaaaaaaaaa

SEQ ID NO: 19653 - DNA, 1216 bp, Homo sapiens
  misc_feature (1)...(1216): n = A,T,C or G
cgtccctgtctctcctcttctcactccgtcgtgtctctctctgtgtgtggcgggctttcttgtgtatgnttccttctgtgtgcgctcctcgctgcctngttgtcttgtctttgtctnctntgnttcgctgctgtgtgtcgttatgttacgtagtactgctctgctatcgtggtgctgtatctctcttccctgctcgcccgtcgctctatggcgcgcgctcggcgtgctctcctgtcgcgcgctctcgtcccgcgttcgtctcctcgcgtccgcgtggcgggtccctcggcgatcgcctcgcgctgctgcgcgtctgtatgcgcgctgttgcgcttgcgtcgctgcttctcctttcgttgtcgccctcttcatctcttcgtcgcttttctcgtctcgtttccggtctngtgcccacccgtgcgctctcctgtggcgttttgtgcccgtcccgctctctctccgtctattcgcctcctactcttaccttggcccttcgtactttcctgtatctgtgcctctcttcccgctgccctcgttggtttctcctcctcttgtctccgcctcgttgcgcgcgcgtcgttgtgggctgttcctgtggtgcctcggcgctcgcggcctcgtcgctggccggtgtgttgtgtgttgctggcggttggtgtgtgtgtgttcgtgtcgtcgcgggtggctcggactcattcgtgtggntcgtgttcgtgccttatatatgtgggcgcctgcgtcgtgggngtctctcgttcgtgtttgtcgtgggtggtgtgtcttgcgccttccctctgtgtcttttgtgtnnggcncgcgcttgcggctacgtactctcctcccgcttcggcgtcgctgtgtgccgttggtggtggttcgtcctgcgggctgggcttcctttcccactgcccgttgctgtcgtcttgttgtgcttccccgtctcttctcgncctctcgcccccccctgctcgctctccctttccctctggcggtcgcggctcgctctttgcgcggtgttcggctgtcgcgtatgtgnnggttaaagctcggccttctttttcttctttcgtctccgctgttctttcctccctttctgcccttgtaacctttttttttttttttttttttcntaggtttctctctatctcctctttttctttatctttcttctatctctttatctactcctccctactccctcttcccccntcttctc

SEQ ID NO: 19654 - DNA, 789 bp, Homo sapiens
aatttggtaatcaagccaaagagaatcataattacgtctttatttattagtaaagtttaagagataagtgtttagataaaaacaaacaggcagctaatccaggatatatagaaattgagtgatagtaaagatcgtagtatagagaaaaaaaacgaggagaagataattagtgaaaagtttgaattttttattagttatataattctatattagataaagaaattgaagtcgtttttatattaagtggattaataataagaattaacaatagaaatgtataaaataaacatatttggggattatagagcatcggaaattataaaaatagaatacggagagtcggtagtatttaatatatatgctattagattatagtatataaaataattatattatttttgtggtaagaccccaataggttttaataggagaaaaatatggacaatagatgataggtgcgtatttccatgaaacagagaatagggtggatatgttttgtaaccagcacgatgtacaagttagatagtaaattttaccaacagaaaaagaaagttcacaagggcagactggtaaggggataaagccgggaaaaaaaaaatgacactatttagatattgttttcttttatacttcctttttttttttaaaatattttcatgaaccatacatgagccttaatatacattgttttaaagctccacggtaatgctatttatatgcacaaatataaagtttgagaacaaaaatataaaatgagaaatttggttttctccaaaaaaaaaaaaaaaa

SEQ ID NO: 19655 - DNA, 1531 bp, Homo sapiens
  misc_feature (1)...(1531): n = A,T,C or G
gcagtgtcccgacccacccgatactttatctgtcccgcgtcatcacccgtgcccgcccctttttgcatgtctnttaacagtgcgccgcgtgtgttatcagactacgtcactcccacacgttaccgcgcgcacaaggcgttacgatgttattatgtcgcttagattagttaacctcatcgagacatgataatggatgtgtcatgtacttgcgcccatcaaaacagcgtgtcgcgtgtgagaaaatatactatgcgcctcacgcgtacagcagactcaatgattgtaagcatacgcgtatagtatgcgagctcggctatctactcgtcgtgtacggantcgaatcagcggagagatagagtagtattgacgtcgctcaccgcgttcgtcgcagacatgaacgagaatttgatccgaggtatgatagatgttgtgagttgattctctccgccttcgcgacctggcggtacacaacaacccacgttctagcttcgtccaactgtgtgatatgagtgagagtacagtaggcgaccacacgtnatgcgccaccgtctatacgagntgccaagaatataatgcaatatctactctcacaatagcgactacagtactacgcnatgagcgctaatgtactatgcgctgncagattatacgtcgactgatctcacacacagacagagacatgcgtgtatgttaagcgatcatgctcanatcttagtcgatgagcctgtgagacgtcgatgctgcgtctattcgtgcttatgtgcgatatcaatgagacgacgcgtgatctntgtcctngcggcgtgtgtgctatngatcgtattgaacgagactagtgtacgcatgtcgtggagtagcatctagtgtcataagtcatcgtattagccgtgcacatgcatcgcaatgtccacagcggcgcgacgagtatttgcgtcgcagcgagagcggtgcagctactagacactanctnattactcagcggacgctgacccacntcacacaacgctnctaccattctgatgtttcagtgtacgatactatactcttgcaagcatgcctcttgttatacactccacatttatctgtgactgcgtgcgcggccgtcggnagtcgcgtctagcgcgatcgntatattgcgtacgttatggctaagcagcagngacgccaaccnattactacgtcgtctcgcgctcacaacagacgctcggcgagacaacgagtgctatatcatgctgantcgcgancnagttccatcgtacgctattgnatagatcgtacgataagagactctagccatcacgcgctcagatgagtgtccanctatatncttnattatatactttgtggtagcgatcatacacctcacgtctattgctcgactgtggttatcattattctacacacagctgactcgactctccggaggacgatatgtgtgatctcactcagcgcgatatatgtacccgtcncattgtgatgacgattgacacggagctcgtgancgtgagatnagataacatacagaacgcag

SEQ ID NO: 19656 - DNA, 705 bp, Homo sapiens
  misc_feature (1)...(705): n = A,T,C or G
acaaattattatgcttaaganattatatcaccatatttaaataattctgtgaaataccttggtataaacataattccgtatatgcaagtatttagatcagcttgaattactcttcatctagctttatctattggagagattgaaaataactccctgtagctctgaatattaacctttgttggatggatacattgcaaaaattttctcccattctgtaggttgtctgttcactctgctgatagtttctttggctgtgcagaagctctttaattagatcccatttgtcaatttttgattttgttgcttctgcttttggcattttcagcacaaaatctttgctcatgcctatgtcctgaatggtattgtccagattttcttctagggtttttatagttttgggttttacattaagtcttcaatccatcttgagttaatttttatataaggtacaaggaaggtgcccagtttcaatattctgcatatggctagccagttctcccagcaccatttattaaataaggaatcctttccccattgcttgtttttgtgaggtttgtcaaagatcagatggttatagatgtgccatctcatttctgagttctctattctgctccacggtctaagagtctgattttgtaccagtatcatgttgttttggttactgtagccttgtagtatagtttgaagttgggtagtgtgatgtct

SEQ ID NO: 19657 - DNA, 864 bp, Homo sapiens
gtcatgtattaagacgagcaaattactaatggaagtttatcccggatcatcgaactatttccgtattcacgcgaccgtctctgacagttatttcataagacagattatgggtataagatggttgtacatttagaaatgtcgtgggtagtacggctaaggtatatattaataatactactacgaataattaatgctgtgtgatggtggatagatataagaaattaattgtatatagtaatatttattgtcacgtaggggagggataggggtgggcgcgtgtggggtagttgggtgaggttttgaaatgtttgttgagtttgtgcagtgtgatggatattggtaggggcggtttgcccagtggagttggtgttgggacgcggggggcggtgtggcgcgggggggaggggctcgaggaggctagagtaataaggttaaagtacgatgttgtggcggtggtttatgattgtcgtgtggataaaggtaggtatggaatgtgagtaaggatacaggggggatgcggaagtttatcagataaataatattgtgataatcaggtaaatagcgggtaaaggtggacgggacaagagagcatggacgagaagaggagtatttttctaggaaagtgacgatggttagttggatgtgctttagatagggtggagtaaaagggggatgtgatgtcgtttcacatgaattaagaagtatattttataaatttgttaatgagagtaaaagtaaatgaatgtgtatagctcagtttggatagttggtcaagcgattttttatccagtagtaaaatatgtaaccattgtcccagtaaagaaaaataacaaaagttgtaaaatgtaaaaaaaaaaaaaaaaa

SEQ ID NO: 19658 - DNA, 1663 bp, Homo sapiens
  misc_feature (1)...(1663): n = A,T,C or G
atgcgcacgcgcgngcgtgtgtgtcgatcgtcgctagcgtgagacggtgatatatgaagagatgtgctagagtggtcgtcgctcaggatcagtngcgcgcatatgtgcaacgtnttccatggtcatgcgtcatagtctcgtntacagtagtncagcacancaagattggtcctgaccggngcggcactatagcgttcacgagacgcgaccggcgtcgagacgccttggcatagtcgtnagcacgacgctcgtactcgctagactcatcctccgncgcgtgtgcgtctactatatgcacgctctcgcgctccatcgtagcttctnactgtctagtagtctcacgtcgttggcacacgcncgtggtttgcgctantgcacntacgtgtgcagtgtcgtcatatgtatacttcgangatgantcaccaccanctcttatcgtagctgtgatgtgtgcgcccgtcancaccgccacgtgcgtcacacataatgagttctggagcgcgcgcgatttagtgacacgtacagggtgagcgcccactgacacctcggtgnctcacgtgtgtgtcngctgctgcgtggcacggctgcgggtgtgcgtatgtcgcgcatatactctattatatatagtcacacttnttttgatatcttgatatcccagcactaccacacacaccatccaatatgcagagtgttgggtgtcagacacacactacatacgcggatgccgaggtgacgtagctgatcggcgactacaatgtagagcacgcgtatggtggtgtacgctacatggagtagacaagatgatatacgtgtatatacgcacatagtcggcacatcgactcgcggtgtgattggtggatataggagtgacatacacgtatctattcggtaacagccgttatctccangtgattgtgtgatctagatgtatcagaatncggctatcgattcgtgcagcacgcctccacatgtgtgacgatagtttggtagtagtagtctgtatatgctccatacactaagtcgcgggcacaccgantgtgaggttgtgcacgttgacgcagtcacatcgaccacccgagtgtaacttctaacacggcgattgatgtgtggtgtctggtagaccatgatgcaacgccgactcctcctctcacccgtgtgagacgtgagtacaccatagagtagtggttgagtacgtatgccactaagatcacacagcacacaactagcacacaactacatggtccctcctagttgaatgacacacatcggtgtgtgtgccggtttcgtcgtggcagcaccatccgcctcctaccatagcacaccattatctacagtatagccggtaggaccagcaaataccaagggtgcggttcgcattatccaccctctgcgtctagagctgcagatggttgagtgatgtacgcgcgcgtcgcacagtgcgaatatgtagcgtgccgatgtgcggaccacacgaacgggtaggggtgtcgttccgaccctagacaccacggcgttgtagtatagactgctgtaaagtactcggggtattcgtctcagtgtatgttgccctctactaaacatgtttgtctccagcgtgctgcgcggtgtggctgcgctannatgctctcttttgccacactagtacatcgcacatatagcagac

SEQ ID NO: 19659 - DNA, 291 bp, Homo sapiens
  misc_feature (1)...(291): n = A,T,C or G
cttggctcttttccagaagtggattgtcattcaaagttttttatccttctaataagacagtagaagatagatcaagaactgttggtctgggggaaatctcaggccanctgtggaggtgagctagttctcttacaggccaactcctgacgatggtctcactcttctgagagcaaacttcaaggcttttgagattcttaaagatcatctgaagaaaattcatcagttttctgcttaactctatatggtgtgtgattctgatgttacaataaaaacatggcctcgttggcctca

SEQ ID NO: 19660 - DNA, 794 bp, Homo sapiens
  misc_feature (1)...(794): n = A,T,C or G
acccttgcacgatgccaagcagtggcatgacatggagctccagaacctgagcactgtattggggcgggtggaggcggagctcacggaaataccatcgtaggccctgcagtaccaacagtgaacacgcgcatctgctggcccgaaagtgccagctggaaaaagacgtggcgccctaccacgccctgctggacaggttggatagcggctgcttgacaaacttactgggtgtaatgaataaaacacacttactcaacagctgaccctataagtcgctagaggagctttctcctgagctccagtccctgctggattccctggataattcagcttgaactgactaactttctggaagtggagaggatccttctggtataaagcgaaaattctggcgcttgagcaatctccctggtgctccttgcaataacacttgggcctgggtggcctcatcggtgaagcgcgggggccgggtccttnnnngccggnnnttnacgatgctatctcactgacaacgtgcgctgggccgatccttaataaaaacttatgtcggntggggggggggnnnnnnngggggnccaccnnggcgggggctagccgaagaagaaccttggaggagagggccgccacggctatgaccttaaaccggcggttgccggtatactccctatggtccgctcctgacaaactcacagattcgcgctagggaacaggtttctaacccggaagctattccttaccaacgttatcccctggaatctccttgagggtttacatggcgcccagcagttcacagatct

SEQ ID NO: 19661 - DNA, 1352 bp, Homo sapiens; identical to SEQ ID NO: 6330
  misc_feature (1)...(1352): n = A,T,C or G

SEQ ID NO: 19662 - DNA, 1445 bp, Homo sapiens
  misc_feature (1)...(1445): n = A,T,C or G
tgttgtgtggtgtgggggtttntgtgggaattgnatggantatgtgatgtnntttttgttattaataataagaaataggtagttgtaantatgtnnncttcgtggagggagagaggaacgganangagagagaagcgtttttattgangngngnanaantagaataagannancnacgaggagggagagggacggnnnacagaaganagaancngccanaancagacnacacaaattctctttnccncnctccagttatattattagttatnctagtaagtttatgtcgntctcatgttctagacagatgttcgtcgctcnctctctttattttctctgtgtttcccgtagtgcgtgttgtgagtgcgtgtactaatgagtatgttgtatgtttgttcgacattatagtctactcantaccaccgtctccgctctcctcntacttgattttctgtgtgtataaccatgactagtcactantngttgtgtatatgctcttacatatgtcactcgttttttgttattatatatctcatcactatctatgtgtattctgtgacgccagacgtgtnatgcgnngatncattgtatatcttactatcaatctttcagtctgtcgttgtgtgtcggaggatactatgttcgtgagagtgnagngagagtagtcatgcattgtctgctactcttaatttatgtcgctctctgttctgccagctcatattgctttgtctgtgtatcgtgtgacaggcgagcgatcgtgatactatgattagtagatgttgctcgcgaactgaggtcgtgtaatcacgtatatgtataccctgcgaggttgagatagtgtagtataatcattacaggaggtctgttacgatgttcagccgctcgcccgccacgcagggcacccagagaggaccggcggacaggtgtctgaaagattgttatgtcttgtacattagtcgtgctgttcacttccagaacgacatatcacttcaagtgtctcagatgtgtattctagttgtgtgtatgtnactaattacgaagcagatgngctgttgatatgaatatgagtgtattggcggaaccccgatctcttggaacgctgcgtcactggatttcattggattangttattataagtagtgtgtacgtcgtgtcattgttgtatcactatattgtgtccatctctgtctactttagttattagtgtactaccaaatcgatctagtgttgtgttgtgcagacgtcgtcgcgtccgtggtgcctctctctttgtctgagaatgtgtatactacgcgtcgtcatagggtctgcatagctagtatgtgtgagagactgaccgccgacgtactctgtcacaaacctacttctgtggttattggtgttccaacccctcatacacagctgagttacatctcttttttttataaaattttttgtaatattgt

SEQ ID NO: 19663 - DNA, 848 bp, Homo sapiens
attacctcgtcaccccggaacgaaagggggggctattgtaacactccttaatctcaccggtcaacatgctcttggggatcttctggaggcccagactttatgctggatgtgctccgttcttgtgcgctcatcatggtatcacactcccgagctgctttgaaccttaggcccagggcagaggaggacaagactgtgttactcaagatgtcctaggcgaggatactgctttaatcgggacctcaccaccgaaatatttttttgagacaaacaaaactcattacggagagaaagcaagtcaaaaccatgaagagctctctgctgactcctaatagagtgacatagtgtcaggaggtcaacagataaccgccagtagaaggacgcggcaaacatgagattcttttgtacactaccgatcgtaccatataagcgtgttgttattccgacacacaatcgctggggctcccaacagagcgttttgatggaattaacctccgaccagcatttctgccttatgaatggctgtcgaaacctacctgcacacttatgttcccgcgcccaccttctaatggatgtcgcctcgttgtgctgtatactcaagcgtagaactccaaactctccttggtgccccttgcgtaaagatagacctccgaaggggggtatgccgtactgcccagagcaacactatgctctgctatacgcatacgagacactcctttttcgtattatatatccccatacttgtttcagtaacgcaccgcaatgtgtaaccgcgtatccctaactttcgcagataattcctttgattgtttggtatcattcggaatacgactaccgtcgcagaggagatg

SEQ ID NO: 19664 - DNA, 1189 bp, Homo sapiens
  misc_feature (1)...(1189): n = A,T,C or G
aaaccaaagtatttcagcggcagcaagcagggagcggggggaggagtgagcctaggctgggaaacgactgtcctgagcgtttccacgcgtctacaccattgagcgcattgcgggaccggctaggaaggacataaaactaccctaacctggactgcgagtctgccatacgtgtgaggcgctccactgctgcgcgcaccgctacgtacccgcagacgggttcgagaagccattaggcaccgagggcccacacgatagttagcaacgacggtcgccgcacacataagagacgtacacgtgccaagagagccccgcgactatatgtcgggggaagctcaagaaacggcagcgtacaacgaacccaacacacgcaacaggcagcccacccgacgagatgacagaccgccacggtgaatgagctgccctgctggagcagtagggggctcgtcactaccctacacccgtaatcgtaaccacgcacgtgacgagctgacagaccaaggcagatcgcccacgtagtgatcgggacggccgcgcgttaaaatcgtgggccgtgtctcgcgcgcacaacataaggtgaaaacgccgccntcctcatactgaacgacggcgcagatcgagagcagcaagtaggggcgaggcgtgtgctgcggcgctgtgcctatagtgagggccatgcagatagtgatgcgaatcacgtgaagccatcgaagctcatatagcaccggatcaaagtgtgtatatntacttgtgtggcaggtgactgcccgtgtcgcagtgaaaaaatacacgcagtcccaccaccgagtgcgtcttacgaactacgcggcgcgcggccccgtactgaatcacatacgatattacgtccactgcggtgcagacataaccgcgcgaactagatgtcacagcaccacaatgagtgtgacgtactccgcntactaccccctgatagcaagaggtgataagcactacttcagcatcactatagagagatngtaacgcacaacagatgtcgagataagatactagacatacacacaaacaccgctgacgctgaacttagactgagatgaccagagtcgatgcacagcgatcggcggtattttagtctcttatgcctccgccgcgtgagagatcgacgcgggatcacactataatcgcgacgaanagcgcctgcgacagctgagagagt

SEQ ID NO: 19665 - DNA, 117 bp, Homo sapiens
aacccgcgattctaccacaagtgaccatcagattatatcttcaacaccacaccccccaccccatcgtgggtgagggtatcccctgtggtcccaggccaataaaacctgatcggcaag

SEQ ID NO: 19666 - DNA, 575 bp, Homo sapiens
ccagtcacatcttctatgcctatctcagctgctgacacgtgactcagctgctcccattttccttggaaaagtaggagctggaaaggacctcagaggtcatccacatcaaccatctcatttcactgatgaggaaactgagacttggaccaggggaagtcagctgccatgttgtgaggacactcaagcaatccgatggagaggcccatgtgatgaggaactgaagcctcctgccaacagccatgtgagggcaccatcttggaagcagatccgccaacttcacccaagccttcagatgaatatagccctgaccgacatcttcactacaatctcatgagagaacctgcgccagcactacctagctatgatgctgcaaaattcctgacccatagaaactgtgagataataaatgcttgttgtgttaagccacaagttttgtggaaatttgttactcagcaataactaacatgagagttagctgaaggtcacattcttgttgagtagtggaaagggttttgttaacccttcacccactgtggttcacttgataaatgatagatagtaaagagtatcggcag

SEQ ID NO: 19667 - DNA, 1129 bp, Homo sapiens
  misc_feature (1)...(1129): n = A,T,C or G
agttatatatcttccgcctatttgctttcgtaccacgtatctactgtttaactgtactaataatgccgatctctagatgctcgtaaaacgttctgcattcaccaacgactgactccctccattagtcagtggtatagatgggtacgcatctctctcccatctctcactccgataagcgcgcgcgctgaccgtcagatgctcgaggagacccagttagatctgagtctgtcgcttctgaataatgggttatagctgtgtgattagacacaatgcaccactgagtgcggatttcaacaggatcatgacacatatccgtctacggtacggagtatccacacgccgctgctcttcgcttattttaattaaaagtcgattctgtcgagttggagctttatcaatcgtatgtaatctgaagtgagtcaaaagatggcggcacattcaaaggctgattcccgccatgcccgaacaataaactcatgtcgcggatgttggacgaacttgagtacatatagagtgacatgtgaacagagagaccagcttgaaactttcgtcacttcatatattattctctgggaccgggtgtgtaataaggtatcacaaggtgtggtctgtagatctgtggtgcggctgtcaatatattttgaaagtctattgtgttctatagtaatcccgtggtcaacctggcagtctaatgggatcactcctacagacctcatagaatggtggagggcgcgactggttcatgagctatatcaaagagatcctgtctgtagttctgggtcgtgtactattaggtcatactgacactgtacctatgtctgatagatacatgacagctgtaacgcagacaagtaatttgtatacgcgcgaacttctacacgcacacagacccgcgttcgcaccggcagttgttagtatctgtacactgtgaactcgccacatggtgacacatacagcatctgtgtgcgtggactgtatactgtgtagtacaagtgtgaagacgcacacnatgctcaacacaattgtgaggtggtataaccaggcatgacagggaagttgatagggttagagcagacacactcaaacaccgatagacacttggacgcgtggtgaggcaagttatatgatg

SEQ ID NO: 19668 - DNA, 1941 bp, Homo sapiens
  misc_feature (1)...(1941): n = A,T,C or G
ttagttatattatctcacacatagatttatatcagatgcgcgccgctgagtagcgcgagntcgggccgccanacgcggcggtcgcgatatacttatgatgtcgcgcgctgagaagtgnatgtacgtaccgctcngagacccnctcgtatgtcgtcacaatacacgtgacgtagcactgtagtcgacagcatatgtttcctataatgantcgctcgattccggcgcgcggcggcgcgctcacgcgcgatcagctcgtctgttgctgatgcttgatgcgcctgagatgagtataggacgataccgaccgcgagccgacgagtcagatagttgatgatgagagattatgtttagcgcccgagacgacttcgcagttagattacacatcgctatatanacantgattcgctcatcgtcgccgcggtgacatcaacncatagatgcacacgtacggttatagtatgataacgtcgtcaacacactatgaatgccgcaggacatacagcaacgctttgacactagaatgaagcgtgcacgtatgcactagtcatgctgcgaccgccgtgttcncgagcgcgccgtgctacatcatnancnatgtaggaantatgaccatctntgtatatcgtattcagtgaccagcgtcatcaatacgatatatatnatatanattntagtcgctcgcaatncagctacatgtcagtagtactcgcgagncagcagcgccgcgtntgtngctccttatacgcatgctctgcttacntgactaangatcgcatgtgagtgtgtgtgtcgtntggtgacgacgcnacgtaatgctcagatcgagtcatctgcgcgttgtgcacaccgtcggatgatctcaccagcacacagcaatcgtcactcgtacagtgagactggntgcggctagnattcagtacacatgagtaattgttctactcgacacgcgtagnggcagctcactggcacngtgnatgtatatcagtttnatntctgcgcgacgcgtgnatcgagattgtacgagctagcgcgcccctacgtatatacgtgatgtaggtctgcgccgtagccgtgcgcatcgagagccggagcgcagctgtgcggcattcgtatctgtactactatatgtaatntagttacgcgagcgcgtctagcgcgcgcagtatgctagtngncnactcactcgcagcactagcaatatatatgtcagacagcgncagacaccacacactctcgtcataatcacatgtcgnatgctctcgcgcgatatanagacgaagantangccnangacggactccggtcacgtctctatagatgattagctcgatcttgcgcgctacgcacgctgcnaatgtatnatagatcgagcgtgcagacgtcgacagtacgagacgcttcgtntgcgcagcgatgcatcgcgatgcacgntcgcacgagactaggtgtcgacatgcatctatcatatnacatnaantactgctgtgtatcactntctacgacccatactatgtgtagatcanagggtgtcacgcgtcgatccgatgtatgcggactcgtancgatctcgncgcgcacgacatgctgcantcatggcactgactacaccgactanagcgcganacagctanctngtacacgcgactcgcgagaccatgacgacgccgcatatcatgcatattanattatntntctatccgcatcgcgccgtcatncgataatgatatntgtgctngtgtcgagtacacaccgngcgcgacggagacgcgccgtacagcngcgcatcgctnatgcgacgnacgtcattactacgtagtccgccacgccgttacgatacctactcgcagtgtattagttagacatcgcacgcgcgcggttctcgatcatcctatgagtggatcgtgattncaatagcctcgcggtatatatatcgacagagat

SEQ ID NO: 19669 - DNA, 1581 bp, Homo sapiens
  misc_feature (1)...(1581): n = A,T,C or G
cgagtcgtcttctcgacagcacagtgagacgcaagacggctacactgtctgtctccgncagtcagaccacagacgacgaactgactgtgactgacgagcgtacatcactatatgaacgtgagcaacacacacgatctaccaagatatacacattgtactatcatatgacataccctgcttagttaccagagcgtccgcgacgcgancttacgcactctcactccctcatcactgtaataggccctggaagacaaggacatctctctatttgcgcatcgtgtctcgatctgtgcacctacagcacacactagagtgagtatggaagctgacaaacgcgcacgtttacgagtggtccttcgtgatatatgcggtctgctcggactcgctcgttccaacactgatcgtntcgngcacgttgatccgtcgtgcatcgtagtaagtcctacttgcgcagcagtatctgacaggacgcttcacagcgacgtagtgcctctnatcattcgctgttacgtgccaggtgaccgcatcgcacgagatcactntnggcgatatatccgattgtcaacctgctgccgcgatcgaaccacgatgatgtgagtngcggatcagtacatatcgtgangctggtgctcgctcggacagtaggaatgtgcgtagagccagatttatcgttgtcaaaccntagcgcgcnacgcagcactcagcgacgaccaatcgnacagtactccacgccgttgccgttcgaacacactcacacgcatcagagcactgntcattactcgcggtctcgtcatgacgcgcacatctcatacacgcgtcggatgacggagcctacacggagacgcgaactctggtgaacggtacagaccagacagatgcgccagcaagccgagacgacactgcatgcagactagctgcgcgatcagatatcctaaggtcaagcactcgattattgcgagatcgtagcntacgcagagagaggcggagagacgccacacaacantgcggcgaccanagagcgactnccgtgccagtgtctcaacacgtcactatagtcacgtgtatgagcacnagcctgtgtactactgctagtatagtggacccgacaccatatggacagaccaacactcctccnacatcgcgcgagaggcgcaccaacgacaacngacactacaacgcacacactactagcgcagatgacggcatcaacgncgatgactacatacacagagccaatcacgacacagaatangatggccatgacgcaagacagagaattatgtgcatnancangtggcacgctgaggcgcacggtgacgtcgtaggaacgattattacagagtgtgtataaccgaaggacgagtcgtcgcgaacatgtatcatcttcgtagagcgtcgcgcggcgtacacatctncnacgttgtntgtatagtatcacactgatcacttcacagacgtccgtgaaggtcctatcgaaataacggtagggtataatagtacgtangattgatacggctgtgtgaaatggtgaaccagcagcatgtcggcgccgctagntngtgccgacgacctcatgtcgag

SEQ ID NO: 19670 - DNA, 1082 bp, Homo sapiens
cccgccgatagaagtcaagcgccgcagcctcgcaccatcaacacccagactgccacagcattctacttaaattcaaccaccgcttcaggttaacttatctcacctacacgtctggtccatcgcgagtctgacccatgtagcctctattagccgcttgggctgcaacaatatcggacaagacacaaaggccacagggcatataggattgaggacctacagacccgatagcatacctactaagtctcatccagataaaagtgcagccctggggacactgaggcccgatctcgcaccgtatcgagattccaaggcacggcgtcggcatgcaaaccaaagtaaaacactgaacgtaaaccggggatgacagtcgcgcgatgaaaaggacacctcgctgtgaggcacaccctttggccagatctcgcgcagggagtaacgattagcgaagtagtctgcgactagtggatggaggcgacagtagcacaatatcattattagacacctgtggcgatgcgcacaaccagaaagcgtacggtggccgaacgacgaatgcaatatagtgctaaactagtgagtacatatagagggcgtggacggggaaagttcccgattcaccaaagagtgtcgagaagcgacgaaccgtaggtacgacggatgagcactcaattaacttcgccccgagaaaagtaccaaggtgtgattcacatctcatatacatacgcaactattgacagcaacgcttacgatctgaaacgaaaaacggccggagctgctaaacgcgaaggatacgaagctgtagagttcgcgcagaccctagtagtgagcgcgaccatacagtgcgggtagaatcgggcagattgcagagcttatggcatcaacatatatggtatattggcgacttgcatggtaggaggtgcgtcggctcgaacccggctatctaggacaatgaacagaggtgctgtgtcgcaccacaccctcgaagtcccgattatgcagaatcacgagagctacttcccggctctgttaccgtctcacacgccacgtccgaagaatgcgcagaatatgcttctgcatatatcaccacg

SEQ ID NO: 19671 - DNA, 780 bp, Homo sapiens
tgtgactattctccaactacaggtctggagatggagtcctgacacgggaacctttttacccgctgggctgcaatgcaatggcaaggaaaaggccaacgccatcatggaggaggttatgagcctgctgcagcccctaagtatcactcaagacctgagccatggacaatggacagacatcaacttttgaatccaagctggagtgcctgtagccagtctacttgacgacttatacaagcatttcttcttccatcactcccactgagacaccatgactgtcatggatccatagcaaatgattggtgctgatgctgattgtgctgctgccactgatgatgatgcagacatggaaaaaatgctgtctatgtcctagaaacacgtggaaagaaacgtttccatgcttctggcatggaatgctgtgtctgcaactatggaaaacttctcttcacataacaattacatccaatacatcttaaaggcacaactctatttcatgcttgctgaagtaccaatattgatactttccaaactctctgattctatgaggaggaatcattgtcccctgcctactaacacatagaattaacatatgggaggtgatacagcgggggcatttctttatatcacctcttaaacacatttgccgcactttagaagtaaacactgaaaaaatcttgtgacgatcggccagcaaaggccagaacccgtaaaagggccggttgctggagttttccaaagctccgcccccataaaaacttattccctaggggctatttcttttag

SEQ ID NO: 19672 - DNA, 198 bp, Homo sapiens
aatctggggcaaaaagagaaaatgtcggataaccccggccgggtgttattccggtcttaagagggccggaggagccagatgccgggcctgtttataggctcggtgggccacttacttgacatgcataagaatgtctcttcttggccaggggtattaacctcggggcacccccaagtgaatttatgggccatagaggcc

SEQ ID NO: 19673 - DNA, 501 bp, Homo sapiens
  misc_feature (1)...(501): n = A,T,C or G
gccagcacccgcggaagcaccgcccgcaactagaccacctcgcagactcctcctgnctaccacacaacccccaccccaggatcgccactactcctgaaccaccagcctcccctatctgncctcccccgtcccaccacttancccacccttaagtactcctgcgctaaaacaccacagccctcacactcgggcagtacacctactcacctcacgtctctcagaccgtaaccacacggacaaatnaacacgacgccggagaacccgcccacccccgcgcgaggcccaaccgccgaccccaacccacaacggctnacctccgccgctcctccctccgtcctagtcaccccctatcggccggctnacagcccactcaacagcgtccggaaactagagcgccgcgcgaccggaancacaaccaccacagnccacncccctcctcggcccccggaactccacagactcgcttcacgctccctaaacacactctccagaccccacaag

SEQ ID NO: 19674 - DNA, 897 bp, Homo sapiens
ctatctactttatgcaaactccttcatctcccttattcgaaattggtcggcttgcgccctcctcaaactcactgcccataagatcgcgcagtctcaacgattctccgcaatacgcggtcggcggccgaccgttctaacactgtgaaaacatattacaattgtctacttcgcacgggctacttcagtctgtgccgagagtcactcgcttcccgttgtctttgctttactggccaccgcggcaactcacgcagttcgcaatcgcactgataaccaacacttcttccggcgctctacagtaatggtgccgagatagcatagcccgtgagcgggtctctgtcccttcaatgctactctctctctcccgctctcgagactgccgtactccacaacaggggttaacgaaagtcttcgcccaggagccccgggtgtcagcaccccctctcgatttatggtttacgtgctgcgtcgcggctacttttttggtgcctcacatctacccacgcccctggtgtagataacaattcctttgtgcggggacgagtctatcgtcttcttcccccctgttaggtacagaaagggttcttgtgaatattctttataaagtgtgacacccgtttcgcttgggataatcaatgttgtgaggtttaccctctcgaggtatttaaaaaataaacaccaccagaactactctcccaaggtaaatattacccccttttgtagaccacgtaacctccaagtatgtgctacttttttgtcccctgtatctaactcaaatcaggacgtgtattttttttaatgatttgcttttgaaacttgaagtcttgaaaccagtgtgatgcaattactgctgttctagcccccaaagagttttctgtgcaaaatcttgagaatcaatca

SEQ ID NO: 19675 - DNA, 810 bp, Homo sapiens
  misc_feature (1)...(810): n = A,T,C or G
cggaataggtggagggggtgggggaataaagtcgtcatgagcgtgggggggatttaccgggcgtttatttacatagcgggtnagggtgggtcacgggtgatattgaagtctgggatgtgggtgaatatgggatattcgcgcgcgactccgggggacagctggcatcagttgagcagacagatggtgatatacggatctaacccaggatcacgatctctatgaggggcgtagttggggaatacctggggggggctctacggggacaacgtggggggtgcttgggatggagggcggggattgatattattagtgggggtaggggcggtgggctacttatgtggtgggggcgggtctcgtcgcgcatgtccagtatctttgacggcaggttatcaggcgttggagtgatacgtgtagggactgcagtggtagtcgctcatgtcaatatggttgggagcgcgatctgggaaaagctgggtaagtcatggaggtctgacacggtctataagacattaggcatccttacaccgggatatctgtccttaggccaacagcatatatagctgacctgacacatcgtgacattttttcaactgtacattacctcagcaacccagaaatcctacaaccatcttggagagggtgaggcaaggattctaggactagaagtattagtatagtcatatcttttaaaacagtggaaagaaataaactgaaatgtaaatagtggcactgggtacatttttattctgcttttccttattttcaaaatactttaacaagtgtgctattttcacaattacacaaatttaa

SEQ ID NO: 19676 - DNA, 252 bp, Homo sapiens
agacaaggtcatactatgttgcgcaggctggtctcgaactcctagccttgatcctcctgcttcagcttcccaaagtgctgggattacaagcatgagccactgtgcccagctgtatactggatatctgagacttggtaccaaaaaaaaaataattaagaaagtaagttaatattttcatattgatttcatgttgaatattgggaatatattgagttaaaatgtattactaaaattaaaaaaaaaaaaaaaaaa

SEQ ID NO: 19677 - DNA, 514 bp, Homo sapiens
agtgaaggcaattttgaaggcatgactacgacctgctctggccacaagagctaagagttgccaggtgttgtggctcaaacactttgagatgccgatcccaacactttgagaggccaaggcaggaggattgcttgaggctaggagcttgaaaccagcctgggcaacacagtgagaccccatctctacaaaaaataaaaaaacaggccaggcgcagtggcacttagggaggccaaggtgggtggatcacctgaggtcaggagttcgagaccagcctgaccaacatggagaaaccccgtctctacaaaaaatacaaagtttgccagggtggtggcacatgcctgttatcccagctactcaggaggctggggcaggagaatcgcttgaacccgaaaggcagaggttgcagtgagtggagatcacgccattgcactccagcctgcgcaacaagagtgaaactccatctcaaataaataaataaaataaagttttaaaaagtcaaaaaaaaaaaaaaaaa

SEQ ID NO: 19678 - DNA, 939 bp, Homo sapiens
ttgtcgagcgcgtggggttaggatcttgttggtagtgatgggagatgggggggtgcttgcgcgcgagcgctgctttatgcctttatttaatcctccccaagtattatataagctgaggtatataagttgtatttcagtaagaagtagtataggcacaaagtttacttacgcgatgacatgtacgtggattaccactatttgtaactaatagacctgcgtgtgagaattattaagaggcatagataattagggcgggtcaaataagagtggataggtcgtcgagattggagaccaagaaggtatttaatgtacagggcggttttgcgctgtgggatataggactttagatgatgggggaccgtcattaagtattgtgggggtgaattattaaattattctctgcttgtttactgttgcaggagggggattgtgtagacgagcggagggattacgtgtgctagctatatatctcatgtgaggatatatagtggtttgcgagataggcgcggagtagatatggtatgaagaatcctatatatttctcatttagcgtttgaagtatttgtgtaaattcattctagggttgttatatgaatagagtgttatattgaatttgtattatagatattcctcgatctgggaaaatggaggtaataggagtagataattaaaaactattttattcaggtcaggcgcagtgagtcaacatagcgctgtcacgccggcaatattgcatttgcgaatgtcgttgctccgttgtaatgcgagaaaggaagggtattgtgatattgagcgtgggacgtttcaggaagtaaatatttattagttatcggcggttcgcgatcggagcctgatagcgtgtcgacgcactgataattcaattcttgctgtgggatagtgatcggggtgtacagcagtagcgtcgataccgggtgggtt

SEQ ID NO: 19679 - DNA, 899 bp, Homo sapiens
attcacccgttcagaataagaagtggtggactttgaaaagctggatgactacgccctctgcctttcaaggtcatgatgttggattctgttgcctgggtaccaccaagagggaaaagctgggagcggaggtgattaagttcctagtatgaccgaaattatattgctgaagtcttgcagagcatggcaaaatgctggaggctgcaaacattatcaacttacttattcctctaagaggagcatgacaaatgaaagcttttttcttgtattatacaaggtaaaggtaataagaagcaagccaaaggcataaaaaatttaaaattcgttattatatatgtccgcatcttaaagccattcaggtcatgtcgatatagactaagccaattttctcgcgctaggtagcagcggtcagaatgtaattttatattcgtccatataagaaaatcacatcagaaaattcgattatactagctacaccaactcttattttattactataaatttaacaataatctccgatcggagccagaatcttatttatcagctgatttctttttttaaaatagaatttttcattgatttcacgataatcacattatatctattactacccctatcccccccaatttaaatattttttcatatcttcaaattcaaaattcccttcacttaatacattacccaccattccggccccataaactgatcacaccaattcgagaatagtttgcatatatttacattgcatatatcgcttgtgctacacattatcaccgttttatgctcgcggttcatctttgctcttgtgatatatattgtatctgcggtgccttagatgtctttagatatattttccccacacccgctctattcgttaatattaacattatatgttatatttg

SEQ ID NO: 19680 - DNA, 892 bp, Homo sapiens
  misc_feature (1)...(892): n = A,T,C or G
tgatatggtggacagtgagagagtgagagggaggggggctagcggcacgacttcttatctaccagcgctcacctggtccattctgatggcaaagatgatccattgtagatctaaagacagtatatttgtgaagatcttacagaaactttggaaagatgcatttagctcagcgagtgctgacgcggaggtgaaagacctgctacaagcgggtcaactatggatgcttatagcccaatcctgatttcgagttggaggagtaaacaattttttgttatcatggcgttgggaccgatcttatcatttggctggaatggacctgtgaccatgagaagcnaattacgaggcgttttgcggcgggttcggggcgtttatacgagtgtagtgacccccttttctggtagcatcggcggttggttctactcagccgcgtgatgtggtatttggtggagggctttgcgtgtggtgtttggcaacgatgactcgagtcctgagaatcgttgtcgacgtcgtaacgactgtgcgcggcatattagtaaggggcgtatttagtatgcgctcggacgtatagttctccgtttctcactcgcatttttcgcccgcgttccgcgctatttatgatctcgcgcgatatcaggctgtaatctcacgtcgaccccgataatgcgatcgtgaatcatcctctgtgtcgcccgggtgatagttgtggcgacggccgttgtttttcattccgcgttatgcaccgccgtctgcgtcgcttcgttctgggatttcgcccccgcggctgggcgttggcggtgttagcgttcgcgcgcccccgcccccggttttttctccgcttattctccgagcggcctccgccgcgcgtgagtacgtctatggtccctccccgatt

SEQ ID NO: 19681 - DNA, 557 bp, Homo sapiens
  misc_feature (1)...(557): n = A,T,C or G
gggctccatctacatccaccgctgggacaagccatcttgtaaaatgtgcggagaaggagaaaactttctgtgtgaatggaggggagtgctccatggtgaaagacctttcaaacccctcgagatccttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatcccccctcagattccacctagagctagatgtgtcttcncagatctaatgtgggtgtgggggaacctttaaaaaagagggggtttgtttttccttcccttttttcccaaaaaaaggggggttttaaaaaaaaaaaaaagggggggggaggggccccggtttttttcgcggtttttatttttaagtggggggcccccctttgtgtggccccctcccccggccggtgaattatgttttaaaaagggggccttttaagaggggttccccttttttttttggaaaaaaaaaaaaaaa

SEQ ID NO: 19682 - DNA, 1006 bp, Homo sapiens
  misc_feature (1)...(1006): n = A,T,C or G
cgggccagcgccttcctttctcccccccccgccggtccccccccacctctttccctcaaacgcgctgccgccatgccccccctcccaggcgtggttcgcgccttccccccctccccccccctgtaacccgtgtggcccggccccttgttcccccctgccacccccctcccgcgcggccccctcggctccccctccccgataaaggtttctcccaactctcccctcccctgcagggccttgggtccccccccctgggccgagccccccagccgagtgcccggtaccccccccccccgggggctgttggcggcctcttaatggcatggttctggtcttatcccccccccgccagccaaagcacccccccccagttcccttccccagtttttccagcctgccatccggatgtgggcctgtcactaggcccccaccgggcttttggtagcctcgagctccccttcatgtccccatatgttgtatggtaacgagccctgatctcatgtaaatagggtagatggaaagtgcccccccatanatatgccgccacgcaanttttcaggaagaaaacaaaaaaaaaaaacgcccccctttttatgccccccaaagaaacccaaaatatttttttttttttttttccttttttaaaagccggggggggctcttccccccctccccccatttatttgggaacaaaaaaagcgcccgcccccttttttttttattttttgtccccccccccccaatatataaaagaggcgccccccgcccccccccccccccccttatgggcgccccttttaaaaaaaaaggtgtggggtggggggggagaaaaaaaaagaagggggttttttggtggggggttttttttcacaaagtnncttatttataagtggagggaaatgtttctatggaatttgatagattttatgtttggccatatcttctatgctcacatttgatttgtgacggcctcctacatccacttcaataaacgtggatcgccaag

SEQ ID NO: 19683 - DNA, 782 bp, Homo sapiens
  misc_feature (1)...(782): n = A,T,C or G
gagggggggtgcggccaggcgagcatgccgacaagcagcgggatgggcagcggagnagagggcagaggagggaggggggagggaggaggggggggggaagaggcataagggagcgtggacagggcttagaggagagagaaaggaggggggagggacaggggggagggaatggaatgtaagaggtaggcgtgtgagaggaggaggagaagacagggaagaagagagaaagaggagaggaggagagggagaagggagggagtcgagaataagaaggaggaaaacaagagaaggggggaggaggagggggagtggaatgatgagggaaagtcggtggggtaggagagggccatcgggaggggggggagagagaaaggggagaggggagatgtgtgggagcggcgagcgagagaggaaggaggggctatcaggggcgcggggaagaatagcagagggaggggagcagagcggtacccttcagtaacagcgacctgacaccttgtataaacaggacctacacagggttctttccctgtgatgtcccattccaccataacagttcatgctaaccagtgtaattacccccagagaggaacagaatcagcataagaacacagcttcttcttcaacctgtcccatgacttcaccctgcactctaaccaatgaatgatatctacactttggcccacttcaaaacctttaaacgccctaaccccacaaatcccttagggagtcagatttgaggtttcctcatgtctcgtcatctaagggccctacaaaataac

SEQ ID NO: 19684 - DNA, 1374 bp, Homo sapiens
  misc_feature (1)...(1374): n = A,T,C or G
cctgcaagcaggttcattctccgccggtacgccacccagcagttagtattctcagacacgtgcacagccgctacggcagcgccgggatttcagtgcgagcctggattacgggagagtgataccagttgcctccgacgcagtgacatgacgtaggtacgcacatttgagcgaattcgtcttgcatccgtgtcacgccaaacctctcacaatctgtacctgatatgctaattcattgtggtgtggttggcaatcgtcaccccccacaacgatagcgtgaggtagtgcggatctcatcatcgcctcaattcacctactaagaaatacggacaacccgccgcgccccgcttacgtaattcctatataaacgagacgagatgagatggagaacagtgctgaatcaggatgacggcgctagtcacaacctcatacacacaccttgtcacagcactttcgtagacactgtcgctcgtctccgcgagcgctgtgtcgaggctgcgagccgagccgcgacataaacggacgcttcactaaacttatataatcgcggtcgtccccaatgcgactttctgtcacacttttgtcccgcgaggtcttcatcgcgcgccgctagaccttgacatagggtcgcggtacagtcgcacaggaggggtagcgtgcgtccgttgaactgactatcacactcgcctcctctttcagtgtctgtaggtagttgattagtagcgagctccgcgcacctctgctactgcgtgtcattcagtatggttttctgacccacagctgtctgctcgcgagcactcccttcagcagagacacgcgctcgatggttgttacgatattgcgncagcacgtacgtatattgcactctgtgcgttatataaaagtgtcagtngtagtgaganttaggagcagacactcccacatctggcgttcaatcgcaccacgccacgcacatctncgcatccggatnaggccacaaagagaggagtgataagcttcagccagcgcaacggattcgtcccgacgatgttcacatggatacacgatccgaatcgagattagtctgcctcacgttcacctcggtctgtcgcgacgcgatacggtacatcttatctctnctacgaatgcagacgagactcgctacggncgacgcgtacctcgtctccacgctcgctcccaagcgctcatnttttcccaanttatatgtgctaccatgtattattatattcacaccttatttgaatatccatgcttnaagccggctaatatgncgactgtanataatcgctacttactctcgcgnggtgacgtgcgtagcaagaatggtattatgcgccggcgtcactgtaccatgagccgctgacgtatctgaagtat

SEQ ID NO: 19685 - DNA, 1118 bp, Homo sapiens
  misc_feature (1)...(1118): n = A,T,C or G
ctttatagcataatcgtttgtctgtcgtgttctatcgtatggttgtgtggctgtatagattattgtgtgtgtatagagtcgagagctcggactttcgctgttttcctctcttctagttgtgctcgtgtgggtgtatagggtcgtgttacaagatcactgtatgtgcgatagctagtagagtattgaggcggtggcgaggaggagggatcgacgggacgagtaggtnatggctgagaggagttggtcgtggctacgtcctaggtgcggattgatatcgcgaggagtatgcatcattatggttgctaggtgtcaatggttgtttgtggcgagtattgaagttgatgttgcataaccactgggaatggagggggtgatatagctcatttctggggtagtatgtcgagatattggtgtaagttgattactctgcgagtcgtgctgtgtctgggtggtgttgaagagagccgtctgtggaaggatatattctagtgggtgtaacgcggtgtggtgtaggtagggttagttgacgagtatatgaggcggtggaagtttgatgcatctattgagtgagtatgatgtgggtgtgggttctgcagaggagtgtgtgcgttggttatggtcgactgtggaggggaaccgtatgagatttgctggatgtcgatggctatcgttgagtttcatcttgttgaaaggagttgattttgtttgagaagtcaagattgctcgacacagggccgcggggagggttgtgtatgttgagttttttcctgaggtttggaagactagaggctgcccccctccattgaaagaaataattgtgggtgctccagcatagcgtgtggattgatggtggttacggtagatggtattctgaaaggattagtgggcgaatttttgggtgattcgatggttaatggtgaagatgtatttaactgtaagggtaagggaaaggatttttttcaggcaactaggccacgcgtgttattgtatagagaagaagattgtagaggtccgatattgttatttgttcctgaaatggatagaataagcgaggggtttcgcgccgaagctttttctttctttgcgttcctctggtgttgattatcgagggtcttatt

SEQ ID NO: 19686 - DNA, 510 bp, Homo sapiens
  misc_feature (1)...(510): n = A,T,C or G
agggaacagctttcctttgccgccgaggaagtattattggaatggccggcaacatccccttttttgcttcacccttagccccctttgcttcccagccctgaaggttttacccggctatgctggccccctttgcccaggacactcttccctctcgggatgtgtgattaactcccagaaagggaaagagggagccagggcaaaaataggaagctctgcctgagcttttcattaggcacgccagccagaccaataaaaagcgtctgtcccactctgctaagcctggttttcttgagcagagggatggaacagagggtgagagaggcagtggccgtctccacctcagctcctgctccctctgtatcagagcccttcctttcttgggggatgggccttgccctcttctcttttcccttcctgtacctttgactaacgntcagcttccgggcctgcatttagtaggaaaaantttttttttcccccttttttttttataaaaaaaaaaaaaaaaaa

SEQ ID NO: 19687 - DNA, 776 bp, Homo sapiens
attgtctgtgggggtgtggttttttttaacggagtggtagtgagtgacggagagaagggaaggtattgggatggtggtaggagggtgaggagaaggtggtggggatagtgtggtaattatgaataggaatgcgtagggatgtcgtatagtatcgagattaaatgtcagtaaatagggagtatgatgttacgttattagggaaactgaaaaaattgtaaaagtttaatgggaaatggttggggattgaaaattactaaaatatttattaatgatgacatttttgtgatttgggtttatattatttataaaaggaagtggaagaaagataaaaggggagggggggtaaaagtaggcagaaataaggtgacgtttcatttcttttatggcgtgctcctccttagtgtatatttatatgtttataaattatatgtgtttattttagttatagtagaataatagtagtccatagatatctgtctaattaaatcttccttttcttaccatatcccatccattttttaagaaagttcaatattaagcagatcattacaaaactgtctcgttcttggccatattcaataagatgggggaccataatcaataaggcctcctaacaaaatagacgcaggtgaaattgtgtcaagtgtccgttttataaatagtatggttgacctaaggagctattcattctgccattttgtatgcttgacacgcagtctaagaataaacgttgaatgttatttttatgtgattatatagtacaatacaaatttaat

SEQ ID NO: 19688 - DNA, 464 bp, Homo sapiens
  misc_feature (1)...(464): n = A,T,C or G
atcctggtgatgcggcccccccaggaagcaaagccaggnnaagcanaaatgagaaacagtatnnnagccgggtgggttctaataattgtgtaaagggtgtgttaaaaaggggttaagggggaagtttttggggttttgaaaaaaaaaaacccctttttttatttcccaaaaacgggggggaaaatttcctttttaaaagaaaaaaaaaccccctcttaagggaaaattttttttgggtaaaaaaaggccaaacgcccggttttccaaaaaggaaaaaaaaacccccccccccctttccctccgagggaaaaataaggggggccgagggggctccccagacttagaaacttaaacgggaacaaggtctaggacagaagttaagatctgattatttactttgtttattgtctatatgccttttaaaaaaataaacttgctatgcacaaataaagaccgatgcgcag

SEQ ID NO: 19689 - DNA, 1029 bp, Homo sapiens
  misc_feature (1)...(1029): n = A,T,C or G
cgttgtattggtgctcgcggaccggttgttgatagaacacgagtgcggaacaccgagcggtgacggtntgggtattgttctccgcggctgtcgcaggtggagtggcgtgggggtgactgggantggtgaggcttgtgttactcgcgctcctcagagcgtggagtagtcgatcgtgataggtagagtctcctgantagcaccgacgcccgtggcgggatgcgctcgtgatcgagaactggcgtcacgcggtcgagtcgtcctaggggtccacgcgccgactgaagcgggtgttggtgttgtagtgaatacgcttcaccgcgcgagcacgcatggccgagtggtacgatatccggtctagttgctaggtggttagcgaactgagcggtgtcgctctagtggtgccgaagtgtcgtgagtagcgtggtcgcgggagcgcggatgcggaacgacacaagcacggcggcggcggcggtaggcgcattcgataggtgtactgcggaggcggctgccggctgcgcggtgagcgcgggcggcggaggataggaggaggaggtcgcggtggggattgggtctgctgaattatcctggtgtaatcgtttatgttatgctgtgaggctgtcgcctgagttgctccgtggtgcgtgtacgtcggtttgctgggtagtccggcgttggtgtgtatagcgtggggttagggtttatatagttaatacattagtcttgagttgtgatctacggtggcataaggatgacgagcagcaggtgatagattcagacactaagacagagtacagtggcactctgtatgcaagcatgaccgtattgattgtaacatacgaacgtgctgcagcgagacgtagaagcgttaagcgggaggcagagtcgtaggagcagagatgttaggatacatgatgtaagttactgttgtttgattgtctatgatgcctgtttggaaaangataaacattgttataacttgtgtggcaccacagtttctgtgccagcaattttccttttttttttccaagc

SEQ ID NO: 19690 - DNA, 378 bp, Homo sapiens
cttgaagaggagagtgcaaggtggttctggatatactgatatgtatcgtcgtatatctatgtgcatatacggcgtttgggcgtatgcgaattatgggcgtccggattggagaatatgggagagtgggtggatctgtgttgtgggaatggtatgtcggatgtagggggaatatgattcttgtgtggggataactgagtgggggggatttgcgtagggaacctgttaggggatagggggagggggttacttggatgagtgcagcatcgtgcggaagaaatggttgtatatgagcgggatagtagtacgggaatacaactccagggcgcatggagcggtacatgtgggggcagggggaccggtgtgtcaagggtggcgggg

SEQ ID NO: 19691 - DNA, 1186 bp, Homo sapiens
  misc_feature (1)...(1186): n = A,T,C or G
gcgccgccgccccgccgccttcttttgctgcttccccggttctctcaccccccgcttttcccggttttcggtcccccccgtgtttcgatcccccgctacttttaccggccgaggcggggtggtgggttcttctatgtttccccaggctctgcattcttctccacgcagtgcgggccgtcgcggtccccgtctgtcaacacctcgcctgttcagtctgatgtctaatcgcacgccctcctatgctcttcctgtcttctctcgcgccgccttcttccgggagcgtgctcgccgtctcacccccgcccgcgcgcacgacccgtcactctggcgtgtcgatgtggtgtgttgtttgccttcttccctccatctcgtgtctgtcctgcttcatccatctctccactcctcttctctgtagtaggcctgcgtcgctcccttctccttgctctacactcgctcgtgtgcgcgcttgctactccctttccacctcgccgccagccgcgtttttcgtccggcgcccccgcagcctagcgcggcgttatagtcgagtacttcgcccgctcctctggcgtgcgccgggccgtgccgtggtgtttctgcgtagccggtattcccgtccgcgtgtgtggtgttcgcgtcgctcgcgctgggtggcggtgcgtgtggcacatatggtgcgcgagtctcttgttctggcagtctcgggagttgttggttggtcgcgtcttgccactcgcattgtggagcttgcactcgcgtccgtcggcgcagatctgtgacgtttgaccggtgttccngctacgcatacgcgacccgggaagcccgcctggtcggctgtattgtacgcgcacgcagccgatggcagcttcattttccggtttggtgctgcggtctcaccgctgttgcacttctctcgccctatcgagcacttcatgagaatcgtatgtcgccgttctcaatcctccgtccctcntcgatcaccaagacggcgccggccgcgtccgccactgcgcgttgggagtggcctgtggtgctactctctcgtctgtgtcgtcccggtctgatgtgtagtgcgctccgtctcccgtttgcgcgcccgccgcgttgattgctactctcggtgtcgcgtctcgtacggatgtgtcgtcgcttcatggacgtccggcgccggtgtggtctgccgtagtgg

SEQ ID NO: 19692 - DNA, 1436 bp, Homo sapiens
  misc_feature (1)...(1436): n = A,T,C or G
ttattaaaataangnaacaaaaangganggngcgncggaacggnacgcgccaacgtcgcgttnacgcgnnnnnntcaggttttgcggtnatcggncncgcccncgccgtcaccccacagtcccagccgtgggtccntattgnattcntcccagccttcaccacgcgtggatccntgaaatganntgttctgggtcctcgccagggtancatgttncaagataaccagctcgccgngcgaatgaagagtagagactactcggttcgacggcgaccagccgttnacncatagataatgatgactctgagagaggcgagggatngtgcatggtnatgtatcggtagatatggtgcntgttgatatgatgtatgatagggaggtgattagggtgggtaacggatgtgtggagggtaagcggtgatgtgccagtggtgaganggagagtagggagatgggctcccgagagtcctgtaccgaagtctagcgnnaatgctcgagccggctagagcnnacctattaaatataatatacggtncaaattgttcggagactggantctcttgtaatcaaaattaagaaccggcacgcgagtgtgcacccaggagtgatgatcagatattgttcgtagagatagtgtgtaactgaggtgtgatgattagtggtgtataagtgtagttagtgtgtgatgagtgngtgcttatcgtatacctcgccattatagaanctctatgcagagaatatattttaagtcacgttactatcggagatctattgttgtgtgttgttggtactcgtgtgattgtggagtgctacaagatagactagaactgcgcacggtgtcgtgttggtcgcggtgtcttcgtagttgtttgcctgttgtgttgtagctattggtgtgtaggaggtacgttaggttgattcggtagtggatcgcattgagcgcggagcttgatgcgttacagtgggtatctgtcgtatatcagagcgagatctagtagagtatacgcgatgcgaagttgacatagtagagtgagagtagatgatacacgatatatagtgataggactttgcaatnagcnccgattcgcgttntcatctataattagaggagtacgatcatgtgttacttcacactctgttagagnagagtcgttnagcccgcttacaatgangtgngatgcanantagaagtgattcatcacngagcgagcgtacgatctgatattgaggtgngtatgcatagaangtctgtgcgtacctagtctcgaccatnattgagatcgatnanttacgtagagtgagtgtgagctatacgcgtcatggttatcgacgctctcgctagatggganataggtgctgtactagccgtgatagagataagacgataatgtatgacgctaggagtgtccgtgaggtatgtaggaggtctgacgatag

SEQ ID NO: 19693 - DNA, 821 bp, Homo sapiens
agtatgcctctgcactgtgaattacatgtgccttctggtgggccagtagccatttccccttcacagtgggactaaagacacttggcatctctcatctggcacatcattccaagaggggctgttgttctcaaggaagagcacttggaagaatgaatgaatccatataaatccatgactgattgaacgctcaccctgtgccaggcactgggaacacagtggtcgacaggcagatgaagcccttgttcttgtggagactccatttctattaggaagacatggacaataaataatacatattgggtattagatgaaagtcagcttccagactcttgctgagcatgactacaaaaggtgagagaaacagtgaacaaataaaccaataaatcttttaagagcaagaaagctacaatggctacacatataataataactgggtcccctagcttgtggggataatgaaattgacaggtttttttcctgcgtattacattgatgaataatgacacatgtgactatgatcacggcaaggcgtaagaatgtgtagtacccgctatccctattagacgctggggaaacacataactgtatgtaatatgacagtgtaggtttcggaaaaatcaatccccacgctcacattggaaactttgaggtacgtactacacggagagcctactcaagtacgagatgagcttgcagattatgtgattagtgagctatgaatatctgaacaacaacaataaacataaaataacgagatcgatatacactcgcatgcggggtgcgcagtcatcatgagggtaacgaaatagcccatcaacatg

SEQ ID NO: 19694 - DNA, 1204 bp, Homo sapiens
  misc_feature (1)...(1204): n = A,T,C or G
ggaagaaagagaggaggaaaaagcaggacacggcacagagacaaaagaagaaaaaggatgagagaaanagaacaaaaaactctaaacnaggagaaaccaaaacaaaaaacacgcttacaaaggcngagcaaaccacacaaaagggaaagaacacgcgacaacaagaaacgaacgagagagagctctaaaaggagcgccgagcaangcggacagcagaacccacacccgacgaaaggacccgcacccacgagggaaaggagagtatgaggaaggagagggagagatgcgcgggggggggcgggcggcgagcgggcgacaggaaaaggaggaggatagagagcagaacgacggacaaagaacaagagggactcaaagagcagacaacgacgacggggcaggcagcagaccccgccggcgacgcacaggagggcaccagagaaagcaccgccggaaccaagagagaaaagagagagacacaaagagacgcaacaagagaaggagagaagagagaaggcgcgcgggggcgcggcaacgacgaacgggaaaacaagagggagagagaacagagggaggaagggaggacgagaagaagaagaaaagaaaagggaagagagaagagaggcccgacaagggagcagaaaaaagagaaacctagcgaaccgcgacaggcacaccgcacgagagcgctctgaccagacaaagaacgagagcgaggggaaagcgagacacaacacaccaacagggaggagaagggtcgcggggaggcggggaggccgagggaagagggaggacggcgggcgaggaggaggacagtgaaaaaagatagacgaaaaggaagcagagacagaaaacagaaagagacgagaccacgangcgagaccgaaacagacacgacaaaggaaccacggaggaaaggcagcggggagcacagacagagaagcgcaagagcgacgcgcggtaacgatggacgagacgagcagcgggcgagagngacaagaagagagcacgaagagagaggcaaaagaggnacagcgaaagggaggcgcgcgcgacgagcgaccacacggcaagatacagagaggagaccgccgtaatgggatattcccgagatcgagaacacagcgacagagaaggacagcacgcgacgactacaacgcccaaangagcggcaagaggcgaagacacagataaacagtagcagtag

SEQ ID NO: 19695 - DNA, 840 bp, Homo sapiens
ctcatacgcgtgctccttttctcccagtttcacaaacctcgcttaatccactcctcaggcctgcaaacggctcaaagataccctccttctcacccgtatcaaagtttcctctctctctccgtgggtcctactcccggcgggcaactcgaggcaattttttgcccaaaatagggcctcctccagcccctgtcttaggtcacaccctacgcattttccccgcatcaccctagcgaatggtcatcgtccacaggttaatcttcctggtcccggcagcacccaagcccaagggctcgaggaactcgttcccctatagggcgccaagagcaggtccccattgtcatctgtcccctcccacaataaatcccagcattttcagcaatgggcagcatttggcccatacctgcacaataacaaattatttactaattcccaaccaaggcaattccatcgaaaccagaaaagcaacccctattttaacagtattcttatatgttgaagtatgtagccttagtctgaaattttattattctacaaaacatacaagaacacgcagcacaaccctccaaaaccaccaatggaaaatgtaaaccaaacacatacaatttatttctgaagctgtccgttcagctctggcattcctgatagaagatctaatggtatgacgaatgattgcatggggctgtgaatataagcataatatatatactttaacaaatttcaatgagaaagttaaaaggtcaaactttcttatcatttattgataaatatgaatatctactagtaaattataggataaacataaaacaaatacaatgaacgctacaataaaaaaaaaaaaaa

SEQ ID NO: 19696 - DNA, 825 bp, Homo sapiens
  misc_feature (1)...(825): n = A,T,C or G
tgtaggggagagctagagtaaaaatatcctctgtttctgaagccagatattaaattcaaacgatggtcactaaggctaccaagcctcgttaggacttctttaaggccctctccatagaagatatccaggggcctattctggccctgtgggctcaaatgattaccaacaaagactcatgggtaccagttgattttgtacaaagcgtgaactggtcttccatggtgatgttgaccatcactgccatcacatcacctttgtttaagtagtaagaataaagccactgtatgattctctttatagctatacattaatcctgtttttagtgctgactgggtcagccttccgggaattggagtctgtctctttcagtgctattttgtttgtttggttggttgttttttgagacagtctcgctctgttgcccaggctggagtgcagtggcgtgatctcggctcaccgcaagttccgcctcccgggttcacaccattctcctgcctcagcctcccgagtagctggcactacaggcacccgccaccatgcccggctattttttttgtatttttagtagagacggggtttcaccatgaggcacaggatggtctcgatctcttgacctcgtgatccacccaccttggcctcccaaagtgttgggattacaggcgtgagccaccgcgcccggcctcagtgccttttttaacttgagggtgtagaggtcctccacgcttgtttgcctgaaagtaatataataatgctgtctgaacaggttttactgcttgctttccaagtaaagcttactagtgataatacagcnggtacctgaaagac

SEQ ID NO: 19697 - DNA, 249 bp, Homo sapiens
ttgtagggcaacggctatggaggctggttcgcttcaaccctgttgctctacaatgtacagctgatgttttactataaaaacatggagtcatgctaactcccacatgccctaccattcactctccccaagccagtaacaaagcaggcaacgcagctaatataatatttagactaaccgtgaagaaaaagatctttctcccttctgtactctgaataaataaattagtctgccttatgaaaaaaaaaaaaa

SEQ ID NO: 19698 - DNA, 703 bp, Homo sapiens
  misc_feature (1)...(703): n = A,T,C or G
cttcagggtacagctcagcaagtgtcagatgacactcggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattacgattctactttaacagtctaaaaattgatagaagaatatcgatataaattgggataaacatcacatgagacaattttgcttcactttgccttctggttatttatgggttctgtctgaattattctggctacgttctctttanaagctgttgtacgtactacggagaaactaatcatttttatacaggacactaatgggaagaccacaattactaataaattgacataaccaacattaaaactcataattattttggttgaccattttggttaaatcctactcttcaaaaaagaaaaaaaaatgggcttggttggccttagcggga

SEQ ID NO: 19699 - DNA, 818 bp, Homo sapiens
aaattaattaaaaggtatgtagctttttggtttggattgttccagggtaaggcattaagattggcccatggttctgtgtgccttagtagtcaatccctttcattgctgaggagtacccattgtatggaggtatcacaggtgttttatccactatttggagaatatttggtttgtatttagttttggacagttatgaatacagtttctataacattccatgtaccattttttgtataaacatcagtttttatttctcttaggtaaatacttactagtagaattactgaattatatggtatgtatgtttgttcaaacatgtgaaaaacgaccaaactgttttccaaagtaaccattctatttttcagtctcacagcaagtaggaacattctagttactttatatgcttaccagtcttttgtcaaatatatgattcacaaatattttctcccagtctatggcttttcttttcactttattaatagtgtctttcgtagtgcagaagttttttttacaaagtccaatatagcaacattttcttatataaattgcacttttggtgttatatgtaagaaatctttgcctaatccatgattacactgattttctcctattgtctctttctagaaattctatacttttatattttacattttaatatatgatgcattttgggtttttttatatagcaggagatatgagttgatattcatcttttacatgtgaatattcagtttttccagtactatttcttcagaagactctccttgtcaattaaaatacctctgctcttttgtcaaaaataaataaagatgcgccag

SEQ ID NO: 19700 - DNA, 1295 bp, Homo sapiens
  misc_feature (1)...(1295): n = A,T,C or G
ccatatacctcccaccttatacactccttacacaaatattgtgaggaaacgccgtgtcagcctnctcgtcgatttattaggctgtttcgtagcataagaagagcagtgtagcggaggtagcgacatagagtagagcggtcgctcgcacccacttgcgcacatttcgttacgacctgcacccggttggtctaactcaattagcagttcactcgcaccgttatagcttcccacgacctgtccgcgctctatcataacacctcgacctcgcacttcacgcagtatttcacactcgtcgtctccgcgacctcctcaatgcgcaccactatataactccgctcgatcatccactcacacgtttgccgcctcctcatctcgcctttgtgtcatccccatcgagcactcactaactatctcaatttcatccaccaacactaacttcactccactacacctccccatccattacatgcgcccctacctcccttatctcccgcggctcctctcctcaatccctctcaccgccaatgactgcacagctcgtgtccactcgctcgcctccctcctctactatacccataccctacatccaccctcctcgatcgcactcgatatccaccgacgccccccactcacctttgcacacgtacactactctaccttatctcctctgatttcatcgactacttccaatcccacccgcagatacctcgcgtcatctcactctatctcctccttatatgtacctcgcgacgtcacactacctacgcgtacaatatgccccctatctcgtatattaacatntcaaagtgtgtctgcctctgacttctgctgtacataacatcactctctcctcagcctcgttttctcgacccaactctcccacactgtctccacgcccaccctctagactccctnaatcgtcatccataacgagcttgtaataaaatattcgctacataaatcactaaactctaactttcaacatactcaccacccacatctccccgctacacatctctattctatattacctaccgcccccatttancataaccgactctctcctctgattgctacatcgtatgatcggattgaccttcgctacatacnatatagtgancacttacnctcgctaccgcgtattcactgcacacacgcgcactccatcangacgtatccactatacnacacatctctacatctattcgctccacataccacatcactctcatcacgacctcactacgtcactcacatctcgcacatacacacactatctatactatcnactagag

SEQ ID NO: 19701 - DNA, 127 bp, Homo sapiens
tatctcctatcgaggtatggtggccgcccctacaaagttcttcgagaggcggcctacttattgtttctcttcaagacccatatttggtttcttcgctccgccggaactattaccccccgctatatag

SEQ ID NO: 19702 - DNA, 913 bp, Homo sapiens
  misc_feature (1)...(913): n = A,T,C or G
ctttcgatttcatgattatgtaattttatattattgatcatattatataatgggaccggagataatcagattcttcccacaattactcacatatataagtgacgataatctatttaattatattatctatatgagtcgatctaatcatctgcatatatttatcaaacctatttgatcggtcgacacaacgactataagaaaaaagtggataaatattgttacggcgttaaatgggatcgcttgcataatttntttttataggagataatatttcggattaagatgtgtaagaatgcattatttcatcatcttagatgcactgtatattgcattaatatttgaaatccaattcttcttgtatttgcaatataacacggaacatataagaattatattattcgtgcgtcctctctaatcgttgtatatttttatttaacaaaacaccaccgtggtttttatgtcctaatttatatcgatatcaattataaatagtcgttatgtcgatttaattatatctgactcgtttattgcctcgtacaaagataggtatggtgatcgcagtcatgtgcttagtcacgcgtacaaatttctgaagtttaagatgcaagtgacttatattaattatacctcgcgctaccagctcctgctagcaatcgtcaacatcagggcgcaaaggattcacgcatccctgcttaaataaacgtgggctgagttttacaggttttcgagacaggtttaatggccagtgtaagacttatgctatgtgaggggccattcgtaggatgggtgagtccgatgattccattctccgattggccaaggccgatggcatcgtctcaaagaacttttgtctggagagaatcacagatgtggaatatttgtcattagtaaataatgaaaacagatgcggccg

SEQ ID NO: 19703 - DNA, 836 bp, Homo sapiens
aaaaaaacatagtaaaagagattcaaaaaaaaagtatatattatactagagtagaagaagaaggaatagagtaaatagatagaaatagaggagtggtaggtcgaaagggcgagcagagcaggagtatggacagaatgggtgaataaaaaaagagtcaggaaggaagggacgaagtggaagataaaacgggagtaggggataggaaagaatggatggatggaagaaggatggaaggggaacattagggtatagaaaaagagagggaatatatgttggttagtggtgtaaagaggatgataaaggggctggaataggagggtagtggagaaaaagggggaggaagagtaatagttagggaggatcgacggtggcgagataataaaaatgcaaggggaaggggggatagactatggaacgtcggagagtgagagtagtgcaaaatgaaaacgaaaggaatggaagggttcgttgttggaaaaagacagtgttgaaaggatacaattagacacttaaatagtggccgggggatatattacctggatagaggaaaaactcagtgggaacgtaaaaggtcggaagaataataagaggggcataaaaaagaaatgcagaaagacaatataataaaagggcggacaggatggagaacatgaggataggtggcaaggatcggcgttatgatggagaagagtgggggaaaaccgaggcgagggctgctgaggcctgtgggtgggacacccagtgcgaaaccctcatccagttttctctccatctcttttctttgtacaatcccatttcctattaccattactctgcaataaactctgatgcggccg

SEQ ID NO: 19704 - DNA, 883 bp, Homo sapiens
  misc_feature (1)...(883): n = A,T,C or G
taacgccccccccaataccccccgcccccctcccctcaccccacccggccgctaccccatcgcccccaccaacgttccgggcacgacagacacgaccccgacccactacacacacggcgcgcaaacgatgacaccacactataggaacaantcccctaccccacccacccacacatgcagcgtccaacccggcccaggagccgcccatcccggcagcgttcactacacagaaacacgcaacgggcgcgccctctacacgaaccctacacataccacgggtagcccacacggtccgccaacatcgattctcacgatgcatcacccgcgagccgaactctgtcaggtaagtaaagtggcaatcccccgagcccaagcaccatttcaatatttccaagtagctttagggcaggcaatatccaagggggccgcaagggtccaaattttagccagcagatttacatgccttggggctatgggcttgataagacgctgaaaaaccagggtgtggaccaagctggctaagactgcctggacccaatgtggtgctggatttgatgtaggttttaccgaggccctcattatatgctcattaacatactaaatcacacacccaccagtgccatgncagttctgagaccaatatatgagtaaaaatggatggcaccacagttccgagaaatctccacctttacccaggaattttcatgactattccactccttggttagagaaaccaatcaagatgaaaccccagaacccattgttctctgtcgggtatgcccgaactcccctttcttgagtgtgtactttttgctttgcaataaatctcttctttccctgttgttaaaaccaacaaaactcccaccccnagtaacgacaagac

SEQ ID NO: 19705 - DNA, 1214 bp, Homo sapiens
  misc_feature (1)...(1214): n = A,T,C or G
ctagaagataagtatgtgagctagtgatgaagtgttgtaggaggtgtgtgagtagatggaaggagagtaatgagtgttggatatgttatgcagtgctgagagagagagggaaagtgagaaggtgtagggtgttgtggtagtatattgattagagtatgtgtggagtgggtaagtgggggtggtgggaagtgtagagatgatatgaattgtattagaagtgattataagtagagagaggagtagtgagtaaagagatgaggtgtggagataagaggatgaaatagtttganagagaatagagtgggttatattaaagataggtagtgggaggaagtgatgagagggtgatggaggtagaggagttagtggtggggagaggggggatggagaatggatggagagaggatatgggatgatgtatagtgtaaaatgatgaagatagggtagtgatataggatatggatataggtgggaggtgggtagggaggaaaanaagataatggagaagaggaagaaaggatatgggagggaagatggggtagaaaatagaattggtgataggtgaattgtaatnatggagtagagaaggttgatgttgtgatatgtgggaggtttgatgtgtgtgaaggaggagtaggagattatagtggagtaggggattggtggtgttggagggtgtgggggtggagatagatgttaagaagattgggagagggagtagattaataagttgaaaataagagtgagtggagtattgacagagatggggaggggtgggagaagaaaaaaagataggaagtagggaagttaatattagagggggagatgagtgttagtatgggatagggacatccaccattctagtggaaaaaaaaatgttgtggtggggtggtagtataatatgaagtatgtatgaggagggtggttggggttgattagtattagcatttgattgtttagaggtggtggagtgagtgtagaggagtgtaatatgtgtatgaaatttgagttgtgtaggttgagtggagagagtgtatttgtttttggaagatgaactggcccctgtggtgatgtgagagttgagggtaatgtgtgggtagggaaagaagggagattgggtggtagaaaaatgagtgtggtgtgagatgaagaaaggtgattgtatgtgtggtgtggggtgtgtgtgatggagtgtatagttggtgtggatgaga

SEQ ID NO: 19706 - DNA, 2030 bp, Homo sapiens
  misc_feature (1)...(2030): n = A,T,C or G
ccgtatgcagtgtgcggtgtgctagtnggctcgtngctgctgnctngtcctgcagccggtgtgnctactgcntcccagcntntccgtgctcgctgtcagcgctgccctncccgatgctagnctngngctngtgcgtcgggcngcgtcatctgcattgtgcgtcgctgcgctggcnctggtnccggantgctgtgcgttgacttgncgctcgtgcacnctgctgccgatctcgtngnttgncnagtantgntctgngntcgctgcgggatcgagtcncgtcgcgtgggtgacgtccgtcgctctagatgcngggtcgcctctcatgtgtgtcgcgtgctcgagcngncgtcgtcgtgctgcntgctgctcagggcggctcggtctgtcatgtgcncgcgtctcgccgctcagcgcgatagtgtgtcacanctacgtcgagccatagtactcactngggtctcagctgngcggctggtgctgtctngngcactggcgcgtnctntgttggcgtgtcgtgtggatncgcaccactacgtctgatgcgccgtcgtngggtnccgatggcgcgcgggcgtgtgcngncantgctgtcgcgctgctggtactggtctcgtgngnccgtcgngctggcacgatcgtgtcgngatgtcancgtgtgccgatcgtcgtcgcgtcgctctcgtacgtctctgcgcgcatgcangncgtcgcntgtggctcggcggagtgtcgtcgcgtcntcgtcactgtgtatcgtgcgtggcgctagcgtgcgcgtgtgcgtngntgcgtgtgtgtcgtcngtcgcgctncgngncgcgcatctctcttctcggccgagctgcggcncgcgtcgtcgtctgcggctcgctcgtgtctgtgcgggtacatgctttcgntatcgctactgaggcnggtcgcctagtctgtctgcgctgtcgtggcgttgcgtctacgtcgtgtctggtgtcgcgtttgtcgactgcgntntngnctgtgtcgcgtacggtctgctgtgtcgctacatcgctgcntctgcggtcgtntggtngtactgctttgagcgctgtgagtcntcgtcangtcttatcncntctagtgtgcgagctgngcgggtgtcgcncgggagactngtgcaggcttgacagatcgtcggttgtggtccagttcatancgacgcgtcgggcgtnggggatcantgcgtcgctcnatctgntcgncgtgngtgctgnccngcgctgtgccgggcggctcgtgcgcacgtgntngtntgggctngtcntgnntcgtcgntctnnccgntctctcgcgtcgtcgtncngcgctctncgcgctctgntcgtctctgggtcgntggcctctgtgtgtgtnctgnctgnctgtgctctgcgtntggncgngtgtgtcgtgtctgtcgntgtgtctgncgcgnctggcgcgtcgcgngtctngctctctctctncgtgtcgntgtgncntctgtcanacanaaaagaacagagaagccggtgtgcgtcggcnttttcgtntngcntcgntcgctgcgtgtctgttccggcggtgtnctntgtcgcgtgctgctctcnctgngcnggttgtgcgtctccgctcntctctgctcgctgcgtcgctggtgtggtgcgcgtgtcgcgtgtgcgctgtccggtgngtntntcgtggcgcgtgntgccgggcggcgtctgcgcgtcctcgtnggtttgctcgctgcgttcgtcctgctctggccgcgcgctgtcgcgctgtcgttctcgcgccgcgtngtctnctggtggtcgccgcctgcgcgcgcgcgccctgttccctgggtcgctctcccttgtgtgccgcgggccgctgtctcttcccctcttctcncgtctcncggngcngtgngcnggttgtctcccccnnncgcccacgngncggcgggtcgcggttcnntcctaagcccagggtttttttcctggctctttgtcgtgtcggccgctcggtgtcgctgtttcgtgctcggcgctgcgctgtggtccggt

SEQ ID NO: 19707 - DNA, 932 bp, Homo sapiens
cctcaggaggacatctcactctgtcttccaggtgtaaacgcattggtagcgatctcaactgattgcgagctccgtctcctgggttgaagcgacgtctcctgcttcagcccctcgagtagctgggattacaggcgtatgccacaacgactggctaattattagattttagtacagactgggttacaccatgttggtcaggtctggtctcatactcttgacctagcgatctgtccgtttgagcctaccaaagtgctcgggattacaaggtgtgagcctccacgtcccacatagaataggagtctcaggaaacttgcacctagatcgcctctggactttatttcacgtgacttttccttaagttaacgggactttgcatcctttggctgtaataaaacctagccatgagtttaactaatataaaacaaaaaaaagggcctggttgggataaacggtgaatctctgccaccggctgcatttgatgaggattatttagtgattctgaatcactcacttcctgcgcccaggtgattctgatgccgcagcctgctaagcttactgaatggcaggattgaggtcctccacctagtaaaggtataactcaagaaagaaccttggtttatattgctgcaaatgcgtattaccgattcaaggcctgcgtggtcacgctttttatacgctcctcccccttggaagcctcaaaaatcccacccttagtctattgtgtgttccctggtgaatttcagcacaccgcggtttccgctgaacctggctattgtgtttcaatgttctacctgctcatatcgcgtatatgtcctctttttcccttactatagcgtggcctcttccgatcccaccggcacgggttcatatcggcagatacccttctccaacggatgactgtacatccccttttatctgtccttgctttaact

SEQ ID NO: 19708 - DNA, 810 bp, Homo sapiens
cccactccagccccaaccccaccctataacaaactccacttcagttttcgagacagagtaattccctgctgctgttcagcgttgctgcggctaacagttccaaccttctgaagtgccggctggttggggctgtctctctggcaactgattagcccataaaccctgccttgctggacctgcagcgttctccagtgcaagtgactgaaagcatgcctttcccaaaaaggaaactatgtaagatttagttcccaagctatgtttcatgtttacaacggtcttctcatcatcattagttggattaaatttacagattacaaagatttttcgcttttatcaataatacccttgatcttgaaaaacaagagcaatttaaacagacccagatactctaaactgcaccaccgttgatgtatttctttaaatagcattgcatttgagggctgcatttaaatcaatttaattgaatgatattcctatggacatgattccatggcttatcatactaaacactctgctggtttctcgtactcaatcggctaaccctttcaaataaaaatgtccaatatgaataatgacgcataccctacacttctctgaaatagaactgcacccctacccaaacccctgtggaaagccataacgtacctccctcacaaatacccctgcgaccaccgatcactcaaatctctatcccccgctgcctatctcatatccaaaaacatctaccacatttaaaaggaagaattagctggactagtaacttaacatcatcaacaaccattctccaacagaatccaaccaataaaaaat

SEQ ID NO: 19709 - DNA, 792 bp, Homo sapiens
aaaaaaagggaagagggtaggggaaggataaggagggagaaagggggtgatttgtgggaagagaagggagagaggggggaaggggaagaaggaggaggggaaatagaaaaaagataggagggaagaagggggagggggtgtgttatgaggaatcggaggggagggaagggggtgggtgggaaaggagggttgtgggaggaaagaggtgggggggatgggaaaaaagagggggaggagagggagagggttatttgaggggggggggggagaaaaagaggggggagggggaggaagggggggggggaaaaggaagagaaagaaaatttttgagagggggtgtataaaaggaaaagggagtgggaggtaaaaggttgtgagagagaggaggttatgaaataagaagtggggttgatataagagaaaagagagggggagggagtgggggggaggaggtgtgtaagaaaaaaaaaaaaaaaaatttgttaaaaaaggaaaggagggggagggtgttagagaagggaaaatttattagaagagaggggggggagaagaagaaaaaagattttgggggaaagaggagtttttggggtttatttttataaaaaaaaagagaggtggggggaaaaccccctagtttggggagaggggggggatttttaatttaaaaaaaaagggaaaaggggaaagggaaaaaaaattttatatagaggaggggggggggttttttgggggaaaaaagggtttttttgggggggaagaagaaaaaaatttttttttaaaaaacccaaaccc

SEQ ID NO: 19710 - DNA, 946 bp, Homo sapiens
  misc_feature (1)...(946): n = A,T,C or G
cgtgttaattaatggttatatagggtttggagagtggagaggatggtaaatagagaatgaaacagagttcgagagagtgtaataataagggatatagaaattttgttgtgaaaagagtatgagatatgaggggagattaacagatgttggttagaacttaagaagagatagtgatcatgagaggaagtgtaggagagaatgattgattgtatacattaataaagaaagaaaaagaagtgataagctagtttggacgatggtatagaaataaaaggggaaggggggggtgatattagggggattagatgaaaaagttggggagaaaaatatatgcgttattggaaggtgataggaaatttttggtgtgattaagcgttctaggaggaagatgggaattagtagggtgcaaaaatacatatttgatggaaaaatttttttttgttgcgcaagtattggtattaggaagttttagatgtttaaaataattatacaaagcttggggcttccatgaagtttgggggaattacaaggggtgagcgaccaatgcgtggggtggttttttattttaattgttttaaacatgtaaaaagtaaatttaaattggaaagtttttttattttaaataaaaatgaagtacccccagggattaatgatttgcaggtaacaaatgtttgagttgatgaagcaattgaatagaaattctattgtttttgtttttcaagttacaaacccaataaaaaatgtggatcgttaagttcatgtgctcttggggcgtagttatgggnttgagtttttattgtttacactaatctctcaattaaataatttcccataagttttttttacatatttctccagtatgaaaataaagaaaataaaaagatgtgtcggcctaacctttttctttttttttctttgttgttgttaaatataatataatatattg

SEQ ID NO: 19711 - DNA, 880 bp, Homo sapiens
gcagagcggggggggggtccgaaggaagaaaggggagggctggtcgcatacggattattgcctactgggatccatcttcaaactcaacctgggacatgtgggcaatatttgttccaaaatattttgctccatagggtttgccatcgggccacttgacttggacgacttctccctcaacaggtggggccagcttcaaaccgcgctccgctcacgacgtcctcaagacacgcggctgtgacaacggaccatcgcagagcatgacgccgtacattgtttcggaggggcaccaggctccgatctgaacccgggtacacccgggccggaaatgggaaggtaaccagcgggggcgaaaaaaagaacagaggggggggagaacgatgcacgagcgagaaccgtgggtgacgggcgggacagggcgacgaacaacctgggtctggcggcgggacacgtgggataagggccggccgagaaaacaggggaccaaacgggcaggggcgggggggcaccgggggcgacacagggcgaaggaaaacgaaaaacccaaacggcgagatgggaacacactggcccggcacccgggtggtggggcggtgggggacaggagggagaggaggggggacgtagcgggcacggtacgggcggaggatggatggtggcgacacacggaccgaccgagaccaggtcccagccagccagcgagggcgacccgcagcgagccagccccgcggcgggcggttgacacgccagccgctcggcacgcgtgcacccaccaccggggggggtgcaggaaccagggtgggcgcggccccacactcaacccacacccgagtgcaacagccccgtgacacgggggggcaaacacaacacgaaacagtggtgg

SEQ ID NO: 19712 - DNA, 859 bp, Homo sapiens
  misc_feature (1)...(859): n = A,T,C or G
tgtgggtagtgttaanaaaaaaaggaaattttatggtattataaagtaattggtattttttttgtggacaaaacgtgttgtgcgaaaataagttttctnaagaggtagcacnctctnacaaaatttgtcnttttnngttncctcaaggcnacaaaaataatanatagagaatacacagacacagaaaacacagatagagacagagaattttttaaagagagaagaagagaagagaaaaagataacgtaaaaaaataataaatattaggggagaagaacaagagaagctggccaaagttttcaatggttgggagtaggggccagggtagaggcgatgtggtcagctgtgattcagcttcaccatctggctcgtgtccctttttctttaaacgacccctagcttctataacgcgacgccgtgttctgtcttatagtgtaccccaaaataatttatcgtattattctcagagtaaatatgatcaatataaggtaagtatgaatagccacaccaggtgttatagaggagcccctccccgataatacatccaagtttttattttgcttcgttcaataattttaataaataaaatagagacatctcttatcgatgtatataaatagaaaacactcccaatgtgattgattacacccctcctccgcgtttggtggttccacctctcatatatattattatctttgtactttaagtaataaaacaggtccagcagtctcgagtattaatcaaataatacaattatagcataaaattggacgagatctagaccctaagagtgtgttacactcacctccctttaagataagacccccccctgctccccccaccttgagaccgcgcacct

SEQ ID NO: 19713 - DNA, 1298 bp, Homo sapiens
  misc_feature (1)...(1298): n = A,T,C or G
gagaacaagaacgaggacacgccacacccgccgcgccgacggcccgcgaaacagcgcccttgaagagaacagaccgaggcggcgagncggcttcacgcagggaggaaaaacccgcgccagacgagccgcaggancanagacgaacnagcagcgcgccaccggcgacanacnnacaggacacaggagcggaanagcgggagacaacgacaaaccgcgagccggacagagacagagcgaggcgagaagcagagagcncagcccgagaaacgaaggagagancccgaccgcggcgagcgaggcagcgacgaccgcggacgcngcanacagacgcacgacgaggacaaaacaagcgacgacaacgcgcgcgcagccccaacacgcacgagaacaaacgacgcgcccacncgcgaccgcanaggcgagacccnaggaccgncagaagaccagcctatcacggagcacagaaagcacgcgccgaaagcagacggcaagaacggccacacgagngccgaagccgaagcgccccgcacagcgccgcagcaggacggacgccgaggcagaagccacagcacgaacacagcgagcagacaccgagnaccgggaaccgaagagacacaaggcaacggcgaacgacccagacacagcagaagacacgccgcagccaagacaaccgacaagggcggcgacgacgcgagccacacgcccacgagcacccagagcgcacacggcgcgggagcgcgccgcgcgagggagaggagcgcgaagaaggagacgcggacgacggagccgaggcggccgacagagaacaaagagacacacgagccggcaagaaggaagcaacagccagagcgngaaaagagagaaggagaaaaccacaccagcagacaacaaagcagagacagacacagagaacccgcgcgcggcggcggggcgcggaggacgagaggagcgcagcaaaccccaaagaaccgacaagacccggaccaacagcgccggaggacgagaaaccagacccgacgcgncacgacgagcccggacagagcgcccgcgggccagcaccagacgcaagagacgcggacacgagaagcacgacgaaaggcaacgaacaacccagaagcgagagcagcgaccgaccgcggcgaccaagcggcgaaccaaccagagcgacgggcgaagacagacacgagagcaagcggaacgcgacnacgacacgagaccaacagagaagcaggccgcgcgcaccgcgcacgaaagacagcggagcaggccgacaccgcgagaggcacagcgcgacacgg

SEQ ID NO: 19714 - DNA, 960 bp, Homo sapiens
  misc_feature (1)...(960): n = A,T,C or G
gtgctccccccacggagcccgcggcacataacttctcgcagcgttgtactcatgcacagaagaacggatgtgaagacaccaagagagcaacgcttttcatagttggatatattattttatgaattttttctaatttttgcttctttgtgagatacaatagcgacctactttttataatacgttggtgattcgctcacgtgacctaataccttagacgtgaatatcgttctacagaggacatacaacttcagctcttgaagctacaaagaagggggcacaggatcattaagatcagcacactgatgggagtaactctataccgctaggacggactctggaatattccgctagggccacgttgcccattaaaggcactgaacaattcctatctccaggcgtcccgacaacacgctaaggatgcaacgggactcagcgcggggaagaaagtgctcgtagacaaacgggacccctgtctattccttaccgcgacgcgactatccacgtggtcctgcgtcccttgcgtgaacggtagccagccacggttccactcgcaccgagggagaaaagaatggatggagactacgttagtttcacttcatacagatgtaagaatagatcatatcctcaacgccgctacctgacgcttagcgagcctagtcacctgtgcccagagggtggcccggattcttacacttaaggccgctgagacacccgcgcgcaccctcagcccttctctaactcgccctccttgtatggcgtttggccgttcgtcgcgaggctgccgctccgacgctgntctaactattgcggagtgcgtgcgccgcgcctgtcacaccgtaaactctttatcatgtcgggaaatacgactaactcaggacgagcagacagctgcgaatttacgccacacctttccgccgatattgcatgcctcgcttaaccatcacctcgcgttagagggcg

SEQ ID NO: 19715 - DNA, 1431 bp, Homo sapiens; identical to SEQ ID NO: 6671
  misc_feature (1)...(1431): n = A,T,C or G

SEQ ID NO: 19716 - DNA, 886 bp, Homo sapiens
aattctaccgtgatttatttatatcttaagagaagagcttatctgtagagactctcttaattttccaacgctacacaactgcttcttgctgccgccatatgaagaaggacttgttcgcttccccttcctccatgattgtaagtttcctgagacctcgccagccatgctgaactagtgaacaggaaacctacagaataggagaaaatttttgcaatctactcatctgacataaggctaatatccagaatctacaaagaactcaaacaaatttactttcacataacgaacaaccccatcaacaaggtgggctgaaggacatgaacagacacttctcaatataatacaattttgcagctcacagacacatgataaaatgctcatgatttactgcccaagctaaatctttgacctttatagaagaagtgaatgatggatctctgttgccaatccatcagtaaatggagactcaacaggagctttttgggaattttataggtatgaatacactcgtgcttcaaaaaccctgtataatatgatattcgattacaaaatgaaatccagcttttcatatggtcatattattccaatataccttctcagcttacagtatacctagtgtaacgcatccatataaatggacacatgtcctatggcagaacttgttttcatttaataactcccaaccaccttcgtcgcccaccttcataattcaaaacacgcctcttcctattccttatcctaattggatagaataatttgctatcttgctttgtcgattaggatatctcacctattttacatattttattgttcttagccattgtctttcctcatctagtatgtaacctttgatcaggcgatctttaccgtttctcaataactatca

SEQ ID NO: 19717 - DNA, 776 bp, Homo sapiens
  misc_feature (1)...(776): n = A,T,C or G
cataagaattaaattttttccccggggggtaacccttgggtttggaggcctttccctcaccccttttttgcgggagggaagaaataaagaaagtacgaaggccaagtcaaccctcttcctgttggctgggaggacaaaggaattaaaagaaacccttgagagttaggaaaggtatgttttttcggcaagaatggtaagccgtggttcctgccacacccagaatggtaaattctttaattcactctttcaattatgtctgcaaataagaatcctcattcagaatcatttgaccagctctcaagtgtaaaatcctaaaaaatatataattcttttggaaatagggtcttgctctgtcatccaggctggatccagtggtatgatcatggctccatgcaggcttgccctcctggctcaagcaattttcttgcctcagcctcccaagtagcttgattataggtgtgctgactatgcttggctaatttttaattttttttttttgtagagataaaggtcttgctctgttccccaggctggtcttgaactcctggcctcaagtgatcttcntgcctcagtctccacagtgtgggatacaggcatgggccaccacacctggccctaaaataatcttaaggcagccatgttgcttaattataaccaaatgtccttaaataaatatgcaccactgatggtgttgttaaatttttaaaaagaaatatactcactcactcccttccacgcaattaataaacttcaatcttcagagcccagagacaaaa

SEQ ID NO: 19718 - DNA, 906 bp, Homo sapiens
taacttagtagatcagataaaaagtaaggaaaaagggctattggcaagcctctgttaatttacaccgctacacacaaggtgaatatcttaaccagacttgccgcatatttgaacaaatttatgctggaaaaagtgactgaggacacaagcagtgtactgagttccccgatgcccggagtggtggaggccggctctgtcaagcctggagacgctgtaacatatagtcaagaaatttagatgattgaagcctagaaaaagcataatatttttttagtctgtgaaaattggcacggaaaaatcacgcgcactgacaaactgagaacacattatgaaaaaaggaatcagcaactacaactggaatgaatggattataaccatatatatatataccaaaataaatgatacgtaaaacatgataagatggaaacacaaatagaatgaagcatttagagaggaactgaaattagaacaaaatcatctcactaggtagtatggttgtacaagagagtctgattattattatgcacgtagattaccatttgaatatttttttggttatatgtatctcatgtttataaagtaatcctaaatgatgtagtttagtgtcatggcagccttgtgatacaaaagaatgttgatataaacagtatatctataattatggataaatttttattattttatatattactattggtatattaatgatgataaatatgtagcttaagttattgttctatgactaacatggtataagttagaataatattttagaagtaatatttgatatagattgtaaaatataaagagaattactagataagtcatatgattagactatcatctaaatatttacaccctgtcacgccgttatagtaataaatgacaggataaaatatattaagg

SEQ ID NO: 19719 - DNA, 808 bp, Homo sapiens
tgaggagattcctagtgaagatgatgagctggtataagagaacaagcagtaaccatgaaggggccctgctgagaggaagctggagatggatgactatcccaccttcatggcaaatcgctatgcctactttacagtctacaggaaccgctcacttcacaaatggcacgattacgaccaatgctgtcttctaggaaaactggcgaagggttttggcgcctttgaacgctcaatcttgactcacatcgaccatattctgatggacaaagagagattacttcgaacgacacagaccaagctcttcgactatcgagttcttggcaaacctgagccagcatctaagactcgtcccagacagtttgcaggggaaccgaacatccttactgatgcccctgctaatgctcatctgaaggacttgaatgaggaactctttgatgattatgacttttaccaccagctccttccagaactcatataacggaagaccaactccttggatcccaacgatcacgtggtcatgggaaggccgtgccttgctatccagaagttacgaagcacagtccacactaaagtgcataggaaagccagcaaaagcgggacacttcggttacatgtgcttaacaggctactgactttcatggcacctatagaccatactacaatgaatgacgatgccaggacagaactgttccgctctctttttggtcagctgcacactcccgacgaaggccacggtgattgacaatccccacctcctacacccactgggcgcctaggctggtgtggccgatgctccagatggacgaaaccc

SEQ ID NO: 19720 - DNA, 811 bp, Homo sapiens
tctgagaattaaggattagagactaccatgaccaatgtagttggggcagcgtcggaagagggagtaaaatctaaacccaaaccacataagcagcttatccagtatacacgcctttccacttcttgcattcctcgatgggaaccctgcttcttctgttgaacaggcgagtgcaacagcatcatcagaagttgtggcctctgtagatggagccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattgtaaagtatcatttggcactcttttctgaaattgctttgttttgtttaatcagatactgcggaataaaagcaccttttgcttttctcactaaccacacactcttgcagagctttcaggtgtgactcagctgcatagttacgcagatgtattgccattattggcgtgtctttaagttggattcaaatggccatttttctccaattctggtgaattggatatgtttttgttacaaatacgacattaacctcaggtaatttttgttggtttcctgttggagctgctatgtggcttggggaagcatttgaactatgggatacctccgaaggtttctgtgtccagttattttattaatattttcacttggttattgt

SEQ ID NO: 19721 - DNA, 812 bp, Homo sapiens
tctctaattaccccgctacagatcaataatggtggactttgaaaagctggatgactacacctctgcctttcaaggtcatgatgttggattctgccgcctgagtaccaccagagggatagctggggcggagggatttgctcgcgttgaccgagattatgtgctgaaatctgcacagctggcaaaagctggagggtgcaaacatttcaacttgctatcctataaaggaggtgataaatcaaccactttttttatatctacgagttacgggagacgttgaagccaaggttgaagaattaaaattagatcgttactctagatttaggcctgaacctctgggccctgataggccatacattctcccaggtaaatgggtggatagaaacgtctttggcttcttaccagactcttgggcccgagggcattgtgggccctgtggctacccgggttccagcatgctgaaccaacgttgggggtaccgtaaccaagccagatggaactgctgggaaacaaggccctccttggacatggggaaagcgctaggctctctaagcccatagctcattcggagaatgggtgttaatcggcaacccttatagccatcaccaattgggtatttccaggtttaaaagagttacaacgtctcagcttcggtggttactatccggagcatacttgcaaaaggaatgatgcgcttccatagaagctgaagccgattgactagagaccttgaggacttggcaaataaagcctggggcattatcatcttgcccacagtggggggggggcccaaactcgttttttttgggaacctc

SEQ ID NO: 19722 - DNA, 1560 bp, Homo sapiens
  misc_feature (1)...(1560): n = A,T,C or G
aaaaggggnnnnaaaaggnngggnnnnnnnntaantnnnnaagtnnananatgagtangannnanngtaaangtangnnnntannnnagatagaannnannnaaannnaaagtagtntatnnnnnnnnnnnnnnnnnanntaagnnnnaggttangtnnntannnantatgnnnnatnanagaatgtnnagaagagtgnntgagatgttgagatgganncgaagatgatgatagtaaaggaagatgtttatatagatgtgnganatagtggnntngaaggagagtagagataannnnatagaattngtagcgcgtggttaagagtgatatgtatatcactatatgcgttacgcgtnagtggttgtantatgtagtgacgnagtactaggtgatcaagtagatcagtatatagtcgtcggtgagcgacaatnatnctggatgtagntnagagagtagaggcgtgtagtgtggtgtgatggtataagnagagagtagagtgtgtagatagtatcgtntgagnggaggtgagagagctgtgatgtgtagtatgatgagatgtagtnactattggttcttgtccgncacgtgatagtntgtacgtgtgagatagtgaatangacgtagaantagcacagtcagctgnagtgagcgcggtgggtgcaggctgtnggcnctaacggtgacnataggtcgcgactcgagagcagagagagcgacacacaggccgagggcgcgaagtcaccacgtcgctcncacgtatctgtccgtcgcagcatctgancatgcanatctgcagacctccactcgatgttnctcagcgctctgcgtgctcgcgtcnccgtgagctctacatctgtgctatcgtcacaccctacactctgagtangcatccgactatagatcgatatctccagcacggtgcgtatctctcatgttagtcgtgttgtactgtgcatcggtcggcctggctacgncgngttatcagtgatggctcagcgcagtgtgagtcgnntgcgcgatgtatgctgtcgcagcgtgcgacagtaccgcctntgcatagntactcgatgtcgtagaagatgtctccgtgtagagcgaggncgtagtagtgtgtcgtagtcgtcacgcanagatgncgatagtcggcttntagcataacactacgagtgagccgatcgcgtgcccacggcatgcccactctaagccagtcgcgcgtngcactatgctctctcgcacacctcctctctcctcactcgtcatctcgccccgatctaggtcncgctccccntcgcactgcacgatgtattcgcgagcacgtgctnaccgacgcgcgcnctacggccgcgcgcgcgccacgtgcccntaacgtacgtctcgaccaagtgtcccacgagcgcgnacccacacgcagtcgagcagactgcgctgagtgctacgcaacgttnaccgagcagtgatagttgtncgtacgcgcgcgctctcaagtatctgtcgtctcacagactcgactgccgacatcgagattcgacatcacgtacgatgacntatgaaatgtcacac

SEQ ID NO: 19723 - DNA, 1088 bp, Homo sapiens
  misc_feature (1)...(1088): n = A,T,C or G
aaacggtgatattaacaataatgaagcacgtggagtgtctaatgaagcatggtacggcgccgattatttatgataaaacgctaagatagtcggcggcgaggcgatctatcttccgattattagcgactggtgcataaacaggtgtggtattcagaacataaaattagtgtacatgtcctaaaggtaccacacaaaggatgatataataataaccaggtgtatatcccatttgggacatgagattcgctcggcgacaagggtatatagaactccacgtaggaagggcatctatncagatacacggacggaataataaatattgctgtggatgttcacaggcgatcatgtgatggcttatacagggcgataacgagcgggagtaagatatcgtcacgctacttcagtaaaaaatatggcacatacaaggctcgtgaaaagataagttttgacagggcacgcctaatcaaattatataattcctaatccgcgccattaacataagcatttataagagggcgttatacacaaggccaaacagttctgtgagggggtcatgcaaattcccctaagagttagttccccgcatgttgatgtatacaagcctacgatgtataaacagactcggtggaatcaagaatggacattcgcgacacttgttttacatcatgtaaccatgtgctattatgttctgagaccacaagtcgatggtaaggacataacgagccacccacaacccagagggattaatagcgggtcttgcacgggccaactctagaatgagagcatcgagatatgcatgccatgcattcatgacaagctatatttatgccattcnatgtaaggatgaatgttctacctctgcgcgtgataacactaatggaatggttatttaactaaaatggacccaatattataggaggctctcttagcaccgcctctccccccaccaccgtgttcctttaaggagagtcaagaaattgagagtttacctcaaagtaaaagtcagtttaatgcgccataaataataagtctccgttgcggccaagctttttctctttttgtgagttttgtgcgggggcgggtcgcgg

SEQ ID NO: 19724 - DNA, 804 bp, Homo sapiens
gagtcacatcgtgaatttaagggaggatcatccgggggggttggatatagaataatatagaaatatcggggaggccaggaggcggtgaataacagtattacgagggagtgagtatagtgactcgtgccaataaattagtacttcatgattttttggacggaattcaaaggggacggaaagatgtggattgtgtgacagccggtactaaagatgaggtataaagagtaacggagtagattaaacttagtaatatctagtatagcgtagtacgataaagggaccttaatcttctactgtcgcttgataaagggcattatcggcctaggagaataaagggagctacaaggttattttttcatgaaactggatgcaaagggcgtgaattcttaaggtttatccacttggtgttatagagttatacaataacaactcgtggaaccaagtgactttccgcatgttttacctagtacagggataggggtcgtggcctgtcaggtcaggatacagcagcacaagaagtgataaagggtgtgaagacccgcagagaggaacagaatctgcattagaacacagctttttcgccaacatgtgggatgatgtctccttgcgctatacccaatgaatgatatttacaataaggcccaattaggggccttgggacgcctttcccccaaaggtcccttagggagtcagaatgaggtttcctcagtctcgtcatatagaggccaaaaaaataaaccccgtagcggccgagtctttttatatactctaattaatatgaatatagacaattgataatcttcg

SEQ ID NO: 19725 - DNA, 801 bp, Homo sapiens
  misc_feature (1)...(801): n = A,T,C or G
accagaggagcgagagcagcaagaaccacacccagcancaatgtgagcggggagtggaaacctcanagggggtagacgagtcagaaaaaaagaactctggggccctagaaagggagaaccaaatgagaatggctgacctctcggagctcctgaaggaagggaccaaggaagcacacgaccgggcagaaaacacccagtttgtcaggggcttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtaccgggagcggaatccctacatagggcagaacgagccggagctactggtggcccatgcatacacccgataacatgggggatctctccggggggccaggtgctgaacagtgtggcccacggagcactgaaacttcccagcacaggggaaggggacccatttttaacctgtttgaaaaggggacaatgcccaacagtgcagcagatttgccaggtcaagatgaacgccttggacctgaacattaaaaccaaaaaaagagctgggaagaagccaacataggttttgaataaaaaaggtaatatattcaagaacatggacagtgccgggtccacactgtcactaaaaacttggagagtggtggt

SEQ ID NO: 19726 - DNA, 1684 bp, Homo sapiens
  misc_feature (1)...(1684): n = A,T,C or G
catgctacacggcagacacagtacgctatgctacgacacgatgcgtgactcangccncggaacgcagctcgagcatctggtgcntgacatcagtccgagtacgactgacagtgcagcgagcgtgaggtgaacgtatgcangtcgcgcctcgtgnctagcttctatatagatgtcgtgnagagacgacgcgactaatcagcgtgagtcgcgacgaagatcgcntcgatgcgttcatcgcacgctcgccctatagttgcatagaccgccgctcctcctncctcacgtgcncattcgtgacgactatgtacgcacagcggcagagacagagtgttaaggacgtaacacactacgnagaccagctactgcagagaggtacagcttcggtgccgtaagcgctatacgagtcatggagtcgacatacgactacncatagtntgctcattgtgtgttggtagtgtcagagacagtatgacggtctctgcnatgcgctctgcgcagcgtcacacgcacgtgagntgtgcgcagactgcggtcgttcgcgtctgcgngcatctcttcgtcgactgctctgcgcgagagcgtagtctatcntcgctcgactcgactacgcgagataagtaagtnaggaccatcgcaacatggtcgctgcgcgntcatgagctagtacgcgacgcnacggatcgcgacgcgcgtgacgcggcgttagcagacacctcacgcacatcgcagatacggtatagagattatagtcacgtcgtgcctcattgtggtgatctcgcanctggcttccaatgcagctcacgctgcgtggcagcgacgagcacgtgcgctgcggactgcggtggtgtccgtcggctantcgcantccactactgatcgctcgcctcacagtggcactcactgctncgcgtccaacgttgccaccatgcatgatcatattctagtatcttcgctcgctcctgactgtgcgtactgtagtncgacacatcgcctggagncacagcgccacgtactcagtatcacgtctgtgtatattgaactagaagtgatgtactcgtatatnttcagacagaatactactcgacgacagtatgtctagtgcagtgactacgctgagtaggctccgtgatacgccgtgacgcatcccgcccgtcgcgcgtgcacaaggccgagtacgaggagnataggaggtgacaacgcgcggtgtctctagcacatagcgcaataggatccattgctagtcacagtagctccggatcatgcgtgcactgtgcgagtacgtcgcgtgcagcggccgaccagacgtgctatgagtctatctcgagcgcacatcacgccgtgcgtgctcgagtcgagtcgaaccaacccgggtgtagtcacagcgctgccaagtaccagcgactattcaacacaccgtgacaatatcacgcaaggaccgcgacctcctctgatgagtgcctgagacacgacctgcgaagctactcctntggcttggcgcgcgatgctgcgccggcgtcgcatagggtagtcgcggcgcgcgggtgggngttctgtcctatgcgcatgacccgcatggctggtactagcgccgcgcgcactcatgcgaggcagctaggacactatagagcgacggagtggcgtgcagcgatggttggagtcgtcgatatgagtgcgatcgcgtgcg

SEQ ID NO: 19727 - DNA, 1878 bp, Homo sapiens
  misc_feature (1)...(1878): n = A,T,C or G
ggctactcagtggactcactgctacctcggacagacgcgcgcgatgctatctgcgcgcgtcgtcgtcgtngagtctgtancgagcgcaggtaggtagcgtactgctctcgatagcgatcggcactgcagccgctgtcacgattattatcgtcngaaggctacgtgcgncaacgcgtctcacgcnctactcgtgtgcgcagtctagtccgtcacgctcactcgagtattggtgtctgtgacgtcgcngcncttcgatctgctgtancntcttgtagcgcgctatcatccgacatcactagtagacngtccgcncgcgcgcaccaggtctacgactgcagcngtcactgnntcacatagctcactatagtactcgcatgctctgcncancntcnctatcagctncatagcatacagacgctgctactgcctgtcagctattctctgncttactgacctanacncagcgcgacgtncntcgcacagtatactcagctcgcgtctccgacggtcgtgccgactgtgcacgctagccatcanagtagctatagctagacantctgagtgtacgcangagactgcgcgctcagggntgcgagtcacgcagtntcacggtcagcagngtcntgtccgactgtcgtagtcctgctacgatgcgcctgctgtcactgccgccgacgtgactgagcaccgtntcgcatgcgtgtcattntgactgtntccgcgcngcatgtcacnacctatctgactactcgtctacgctgatgcncgtgatcaatgatactagctnacgntngcacacannnatatgcgagctgnagtgctnagatcacattgttatctcgacggtcacatagcgtcatgcagcgtcgtcactcagagtaggcgctgngcacncggcgcgtagacgagctgcaccgcgcgagcagcgcgcatctgctgccgacatgcatcacacagtgcatncntntnactgtcnactcagtcgtatactcgtccgatcatgtcctcatgacncgtagatgatgcgncacgtgcacagtncgtgcatctgtnatctgcgcaatagatgcncgnacagtgcgtacnncncatacgactntagnctnacgctgcgcncacgctagtcgctgtctcgtcgtagcgatgtcgtgcgcttcgtgncnacanctgctcancgagctgctgncagatacgacagtgtcggcgtgtgcancgngnaggcgatacgactactacgatcagcgcgaacnagcctagcactgcgtgcgtanacagttgcggcgtgagcgtgactcnactggctagtcacagtcacgtcagctcatcgtcatgcgtcngtagtgagcgctcgngtcngancgcgtcgacgcctncatctgacganancgctccaggntacgtgcgactcgctcgccgntgtgntcgcgagcagncgtcgtcaattgcactcgtctgtcgacgctcctcgtagcgtatcgtcacagacgcggatgcgcagcgactaccgacggccagtgctagcngtntnctagactagtagcgagtcgcatattgctcgatngcgagctgcgcgncngcctatctgtctntncgacgcatcggctgncnactatagcgctactntatntacngtcacactctcttcatagagnatcgagcagagatgtactggcggaattagacatntngcagatctgacggacgtagntncngtncnacatgcgatacgacagctcgtgtacatgccatgtnctatcatctactggtacatgnangtcgacgatgacatgcgtcagtatctgncagatcgtcaccngaccnacgcgtatagcatnggncgttgcttgatctgctcgtgcantngcgcaggacgctgcg

SEQ ID NO: 19728 - DNA, 1069 bp, Homo sapiens
  misc_feature (1)...(1069): n = A,T,C or G
tgcattatcgcgtgcatagtctgcctgggcgcgccagagcgcttacagacgaccgtcatcgttccttgacgtatacgttcttcgatcatgcttaagtatctcatggttctgttgagtntcgtgtcctcgcctctctgttggcggcgcgcgcncncttcctgaacgcgtgcgcgtactcgagcgccactgaggcgattnnncccgaatgcgcgagaggggtgtnncgcgcaggagtggggggacatnagttgaggcgcgtcgcagtcccnccaccatacccccaagaggcatccccgagggatcgagtgacgccgccacaggtgccacgccccggccacatcacttccgaccgcctcctccgcccctcacggctccgcttgcactcacgctacctcgcgcccgccgaggcctcatcactgagagggagaggaggcgggatcgacggctggcgaccggggcgggtccgcgggtgcaggggcgtgaggtntatgggtcggtgtcccgcgcgccacgcgttggatccacgcgcaccggcatccccgccgccccgcccgcagccancacgcgtcacgctaccatcgtcccaccgcacacctcgccagctcgctggagtccatcatgcaagtcaacccggcggcacgcgcacgcacgcttacgatcagggcgcgagcgacggtcgcccttncaacgccgtacccccggcgcagccccccgccgctcaccgccttccgcgcagcctcgtagcgagcacacctcgcgcctcgccgccgcctcgcgcctcccgctctcgctcgccgtttctcctgccttcctcctccgattcgcgcggagcgcgctgccagctgaactgcacaggacgccggcgaactctccacggtagtgcgtttaccggcgccccgcgctgtcgcgcccgccgtctgtgttggcggattcacggggtgtgctcgaggacgggccgggcccgagcgcggcgcaacatgtggcgggcagtcgcgtctcctcctcgtccgctacagacggcgtgcgggtccggctgctcncgctcttcacctgcgcctcttccggtccc

SEQ ID NO: 19729 - DNA, 1172 bp, Homo sapiens; identical to SEQ ID NO: 19468
  misc_feature (1)...(1172): n = A,T,C or G

SEQ ID NO: 19730 - DNA, 225 bp, Homo sapiens
gcccaggagtttaagaccagcctgggcaacacagcaagaccccacctctacaaaaacattagccggacatggtggtgcacacctgtagccctagctacttgggggactgacgtgggaggacagcttgagcccaggaagtcgagactgcagtgagtgaggatcacaccactgcactccaacctgggtgacagagtgagactctgcctcaaaaaaaaaaaaaaaaaa

SEQ ID NO: 19731 - DNA, 1547 bp, Homo sapiens
  misc_feature (1)...(1547): n = A,T,C or G
aggaagatatatatagtgatgggggtggggggtaaggtaagttacgttgcagaaggtaggagaatagatagagagatacagagagagagaggcagagctaaagaggagagagagaacanacaccaagcgcatatttttctctgagagtatcgtacttaacccccntcacctaaanacaactaaacgccacgctggagcgcatgcgagaatctgacgggaggacagattagctcgcgagagagaagaagcgacgcttcacgtatcagcgatcaacagtncntcgtggacgcgggtcgcgtatgaatacaatctacatactcatcattaatataaagacaagtaactctcacactccgtcacacagatgctcgacatcgacnacacacaggcacgcaccagcggcgcacgggacgcggcacgccgtacccgcatgcgctcccaccatacactncacaagacacgccgcgtcgcagcgaccgcggcggcccgccntcctccacccgcccacagcccaacgcatatacgacgctgggcgcggcgcgcggacgcgcggcgacagcgagtgtagangaagacgancgggtggttgtatctngcagagggagatagaatgtatttatattacactcattgatacatantnatggtgttgattgaatagtgagaatngtgacgcggcaatagagcgggcctgaagtgggacgtcaagtgccagaccgatcacaaggacagctcactctccncggatatcactaaccgaagcncaactactcagtcacgcgcatctggcaacgagatcacggtcgtaggcangcgcacatgtcggctgctgacgccgcctaatgcgatatacaaagaacagatggaggacccggaccgtctctacgtgtctggatggcgcagacncgaaaggagggccaacatagttcaaccctcgatagccttgacgatgtnacaattagcgaccgcgttcaccgacggcccacgatccgacacgatctatatatgtgtgctatatagtacatgcggacanttatcgtcgagaggcttgcagatttaagtatatctcgatattagatttagaaagatactggaccacggaccgagtggtctagtgagacgtcagcaggaccggcggagatccgcccaccatcactcagccaacttgtaagacctgacaacacggaccggcgctagcatgtgtatactgtggtgaagcatcgacgaggtgagngcgcgagagtcgcngacacccacgacantgtagtcagcgcatagacacagacacatagatatcgacccgatcagantgtactcgtcgcagatctatgccgtgacagcattgatattagtgtgagaaagacacgaaatgtagcnaccgagcgcgagtagagtgtatagtantataanctatncgancgtctacattcgacgtcgtcctcatacatgcgaagcttcanctacagatcgcgtcgtactacgatcancaactagtgtgcgacgtagagaggtangtgagagagtgtggcgtgtggaggaantgncat

SEQ ID NO: 19732 - DNA, 1820 bp, Homo sapiens
  misc_feature (1)...(1820): n = A,T,C or G
atacgaacgancgctcgagagcatgttctatngcgagatcgagcattgacgagtgtgcagttatnattgttatggtcatgtgtgagtatctcgtgtatactatgctaatgcgactacttcattcaatagtttgtgtagagtgtgcgtctactcgagacagcgcgctgtgcaccattcgcgattgtgtgtctcgcgctgcgtataaatatagtgcctatgacacatatctaagacattgatgtctgtgcgctatctttaagtagttcagttatcggcatatcagccatgtgtaatatggtacgggcaacgacagatagcagagtagtagatgcgtcatcgagcgacgnggctctgngtagtgtatacgttatcgttaactctctcatgcattctagctgttgtcactgtgatcggtgcgctgctgtgtgtcttctcgctgtagataaggacgctacgcgtgcagcgatgaatancaacagcgcgtgtantctcttncntctnagtcncntactactgcacatcattagcacacgtgtangacattgctcacacgacagtcgatgtgatagcgcgtggtatctatctgcgatattcgtgtctatatgactaataaagaacaggacgcggcgtatgcangacgagatgattancagatgcgcgtagtcgtgcgagcgtgtagcagncnancacgcagagcagtagacatgtgttagagagtatgtgcatagtagaaagagcttacgagcgtcagtactcgcacacaaggatcttaatctctggacatctgactcgngtatcacgatntacgcacgagtcngcgcgagtgtcgttcgctcgagtctgcagtcagtatcgcgtgcctaggcgcactncgcgtgtgatagttcgtagagacgagatgatcttgtcgatgatacgtcnggtgcttgtgaagatatgtgtgtgtgtcgatggatcgtgaacgtgatgctcgtatgcttatagtgttcgagtcgtacgtntaatacagtgacatatctgtgtatgatgggagtctgtctgtanatatctactnttatctanggacttgngntatgacgacgcacatgagtgagntctacgtgcgatgactcacaactagcactncggtatagtcgngnactctgntgccctactatcgtagangacgtcntacgtgctcgcgtcgacatcttcgagtcgacgccgcgagtnggtgatgatctgttattcgtaaanacgtacangtggcgttcgcgctagttctgcgatcactattacgtacgacgcctgnttcatgtgttcgtagtcactcancactggtctntgcactcgcgtgcctgtnatgtagtcgcacagatgtcatctatnctcgcactgcagtntcgtcctgatgagctcgcctatgtcgtctctacgtagtatgtagctatatcacgngagagagttgcgtaagtgtcatcgtgcgcgtctgatgtacgctctgtctatttctcgtcactcgctancgagtctctgctcgcactgctgtgtgntgtgtatctgatacgtatgagaatgtcctgtgcacacatntngacagcttatacgagacgtacatgatagtagatatgaggttacgggcgtcggactctgtactatacgtctgccgtaaagagacactgcgcgtgcggcaggtatcnttntgttctttgtgctgtacttcatgaaagagtactggtagttatcgtaatatatantaagtaagtgatatnantctttatagatgagagtagtgtataganatgtctgacttaangcatcatcgtatctggctatacaac

SEQ ID NO: 19733 - DNA, 1282 bp, Homo sapiens
  misc_feature (1)...(1282): n = A,T,C or G
cgagtncgcaagcgtgaagtgtctcgcatcacgaganntgaggctggtatgtggtactggatgtgcgcgagtcacaccgacgaaggtggctgatgagttgtgatgagattcattctataggatatactgtgttgaatgactagttacggagagcacaaattagctggtgagaggttcatgtattgcgcagtggtgttcncatcactgtatcagtcagagagggtgtgcgggtgatgtgtatcgtatataaccgtatgtgcagacgtgacgtccattcctgcatcgcttgttgtgtattanggaggatcgttgtacatatcaagacaacttaaaggagacgggagcatgtagaaggcgcggttccgcctctgatgacagcgttggtagcgtgcaagctagtggtggcntatggggtagactcgaagnacgctaaggctctctacgatagataaatacttaggtaagtgctgcccgcacttgtcttgtttatatccgatcgatggcgctatagagacggggtggggaggcggggggagttagtggcatgtgatgcactatcgggcgtggcgggggacaggggatcacgcaagtagcgggccacgattagagcgagagtggacgatggcgagtaggagcgaagattagaacacctgtacgatgcgagggtaaacatgttgagtgcgagtagccgtgctttagtggtgtttggtgttgtggatatgtctaagcagtgaaagacacaagagagctcatgaggcgacagccgtgagcgcaangtagnggatagatgaccatcgtgtgaagctacgtgaacatagggctcatgagatgatctctcacatatttatagatagtncgtatatacatatatatctacaacattgacattagatataatactctcgatcaacataactacttactcgtcgctctcacaacatgcatatggattgtagagacataattgctacgagcaaggcggaagtgttgtctctcgtgcgcgcgcggcacgtcgttgtgtgaggatttaatgtgacgggacgtaggcgagtgcgcggtcagataatggtaagggnaattatgaacattttccgtgacctgcacggccgggaggaggcgacaacaccagcgaaggtcaacacaaccccgaaaatagttaatcttaatcgatgaacgaaagatggccttcgttggcataaaagtcggtggtagtgggtgcgcgcctgagcttgttgtcttgtggcttaggaccgccggactaacaggacttagtgtatataac

SEQ ID NO: 19734 - DNA, 180 bp, Homo sapiens
  misc_feature (1)...(180): n = A,T,C or G
atagggacaggctagaactttcactttatggggctgacaaagaaaacaccatttgctgaagaggctgacaaggggaatacatagggtacggggggggtctacaaactcctattttntcanctgcttgggtggattaaaacttcaataaagatcctgtgataaaacagaaaaaaaaaaaaa

SEQ ID NO: 19735 - DNA, 1551 bp, Homo sapiens; identical to SEQ ID NO: 6898
  misc_feature (1)...(1551): n = A,T,C or G

SEQ ID NO: 19736 - DNA, 953 bp, Homo sapiens
  misc_feature (1)...(953): n = A,T,C or G
tggggaggtggggcaacggaggggtgggggggggggggggcccttattattccacagaggaattcttgttactggaggtgacaaaaatggagggggaggaagtcataaagagaaaaattccttatagggggaggggggggctaaataaaaataaacccanaanaccctacatactcaaaagagattcttactattactggggagaatagatcatttatttacatgggattgggattcatcatcccttaattaaatatcaaattatatttctgttgaaaatgtgacaaggggggggggctntctcttctacaattnatagaaaaaaagtatgagttttcttcgctgatagaggttagactaggggtgttcagataaagctaaatcttgatgccggggaatagaaggggagggagggggggggtcatatccgggaatctggtaggagtgaggagagggggaaaggaaaaaaaggggcttccttggggctaaggggggagacctttgccgggcgtttctctgttgaggggggtagattcaaagtcctggggcgcagggcgtcgtgggggcgggtctgtagaggtgggggagaagcgggatttcttttccgtgagggggggggatgtgcgggttagccggaggagggggggggagaccgcgggggagagactggggggggaggggcggggataggggggcggggaaccgagaaaaagggcgcggcgggtgggtgtatagtagctagagcgcggagggcgcggtaggggagggggcgggagtgtgatcgactggggagcggaggggggggggaggggagagggatgtgttgaggagaggggggtgtgggcgcgcgtgagagggccacggcaggggattgtcggtgtggcgcgttggggtgtggggaagagccggtgggcgttgtttggtgtagggggcggaaggaaggggggagaggg

SEQ ID NO: 19737 - DNA, 1651 bp, Homo sapiens
  misc_feature (1)...(1651): n = A,T,C or G
actggtagtagtnaggagaacacgaagtatggcgcgcgtgacgactgcatgcatacgcacatgctagcacaccatntgaagcaaaggagaatcgnaacacgaccagaggaagatgtttagaagaaggagaaganaccacaacgagaagcagccgcgagcgtgtgacgcgagcccgcggagaaaaccacaacgagcgncgtgcgcgtatcacacagcgtacacttccgtctgncttctttcntcctccaccgcgataccgtcgccgcactgttctctgtcnagaaacgcgccgagctatacgagcanaccgtaggagagcgaagatgctcagtgngcttactctagtcgtagattnacctatgtcgtcgtggttatatagaggaanacggccacgcactggatgtgatgtagagttnaaccagagacggnagtgtggctggtnagtgagaggctgctcgtagtaggtgcatgacgcgccccgcgatcgcaccgcgcactcgctctctccgtacctntgnagtgttaatatctcgtcactaatatagtgattgttgatggccttattagtaagaagagacgaggggataaagagaaacggagacggagcgagcgaggggaggttggagcgccgcgacgcgaggagtcgtagcgagngcgtcacggtaagtcacgagagtgtgagattagntaatagtatgtacagggagcaccaccgacgtactgaagggtatagagaggagttcagagttgaagtgctaaggtctcgatcgcactacaccactcctcagtnctgccgcagacgattctcaagtagttagattatnatagatatagagatgagtggaaggagaatcnatttgatatataatgtgtaagtgatcgccctatatatgctgtcatcagncagatcagggatagaacatgagcgacacacgacactcgtacgcacgtagcgagagacagcgagcgntcctacacactatgcagccacgcatcttctgatcgccgccgactcctgtgatcgcacacacgcgcgntagatgcggccagagagngactcagagaggtgcagagtatagagagtcgccgatccagtcgagtgtacagantacatgagacacatcagagactgagacagtatactcgcgncagtacaacaagaagctgtgactagagcacncagagacgacaccagcgtatgtgcactagaggatgcgacagtnagagagcacacgagaagcgatatatcgatgagttctcacgacgtgtcgcgtgcatatcagcatacggtcgacccagcaagagtcaagcaggtagtccagagtgcatgagtgcggagctcagatacgataacaatagantcggcgacgtaagaacaacaccgttaataacaaatatagatgcgtatatacncgccgcgccgcagccagaacagacgacgcacnggacacgcgctgacgtaagtagaggtggtgatagttgatgttgntggtcaccgaagcagaaagcngagnangaggaggagctatgcgcgagcggagcgacgacgatntaattaagtgtgaagtagcnaagcagtgcgatcagacgagaatagagaaatagcagagcgcgatcgctntgacatagtgttcatgcagagcataacgnt

SEQ ID NO: 19738 - DNA, 699 bp, Homo sapiens
  misc_feature (1)...(699): n = A,T,C or G
cggaaaaggggggcgatagcggggggttttttttttcgggggtttagaaaagggggagaaatggacggggcaggtttgggttaagggtacagagagccaggtggtttaaaggcggcaaaagggttttttacatcggatgtgcgataataaagcggggggaaaatcaggagcttttttggggaaaaaaggggttttttcagaaaggtttttagggttgaaaattgtattttctcacgattttaggaggggaggtgttatggtttaaaggtcaaggaagaggttcggggagggagaaaaggacaggggggaagtaattgagctctttatggggggggaggtaattcggggagaatttttttttttggggaatgttaaaaatgggaaggaagaagttttaaaaaaaaaaatttcttatattttgaaaagggaggtgtatgaaaaaaaacccagaaggcccttaaaaattaaaaaaggttttttttatttttgagaaaaaagatcaattaatcaaaagggaatgggattttttatcccctaaataaaaaaaaaaccccccttgggggaaaaagtggaaaaaaaaattatttgtgtttttttaaaaatgggggttaatgaaagggatttttttggactaaaaaaaaataggataaggggttttaaaaaaattttaatttttggggnaaaaaggaaaattaattt

SEQ ID NO: 19739 - DNA, 906 bp, Homo sapiens
cttgagaccggggtcaggcgtagagtggggagtgaggtgttggtcagggtgctgcgccggggtatcccatgtaattgacaataaaataaagaagaaaaacccagagacgacctgggcgacatcctgaaggagaggtcctaacttaaatgtgaagtataaggatatgagtgtactctacaagaagagacggggggactctcctcaccctgtagtttaaagttggagtactagaacttgtggtggaaagcggtgcaaagaacccaagtttcatgggtttgttcggactgactggagagtcacgttagcatgtcttttctcgcgtcgtccgaagagcgatttaggactgaagcggtcttcacacacacatcctacagtcttcactccactgagtgtgtcggtgcgaacatcagcaacagacaagtaaaataaagtcgccctgtagcaatgataaggtaacttttgcacacacagttgcgctgaggttgctttaccccacggcgctaatgtcttgtatgttataaaaaccaggctaaggagctcgacagtgctatccagcaaaggcttgagcgtggcgatgacatttaccccggaaccaaagtgtaaggggggctctctttttaatatgttggcgcgcaatgcttgtatgggattgacacagaatcaatacggttctgtgtcgaagaacatccgtccatgaatcgtgcgcaactaataggaacaagttcattgtgtataaaatcaggcatacagcgtgacaagcaatgcattagcatgacgctagttggttgatctacttcactgattttagagtgaagtgacgattggagctggaatattttcgtcatgttaaatgaacgtgatagctaataaaaagacaactagccatcaaaaaaaaaaaaaaaaaaa

SEQ ID NO: 19740 - DNA, 235 bp, Homo sapiens
  misc_feature (1)...(235): n = A,T,C or G
gggggggtgggagggaggaggaggtggaggggggggggaaactaccgcgtgatgagcccctgttgatgaacacagtcatctttctggggggtcctagacctggcattgggaacanaaaatgggggggggggggggtacgcttaaagaaaaatctcatattattgagatgaatattttatttgataaattgagctacagagtaaagtacttttaacaaaccataaaaaaaaaaaaa

SEQ ID NO: 19741 - DNA, 921 bp, Homo sapiens
ctgtgtttttggtgggtaggtagttggtgttatggatgttgagagtgtataagagtatgtgaagagtggtgcaatgctaaatgatttggtgatgggagaaagaaggatgtgggtgtatggggcgggggtaggacggtgagggggttatgggatcgggtaggcgtgatcgtgggagatggacgatataggctatggagaagtgggtgtttttatattgttaggtggatgtggaggggatgtgggtgaggaagtgagttggcgacttcgatagaaaggcggtgaggagtcgtgggggggggaggaagatagagtgggatggtgattaatatgagatggttggggagatttagagagtgtgtagaattagtggacaaagagtgtggtgggtgcggtgtggtgttgggggtaaggtggggcggtggttgaggttttgcgggggtggggtgagagtgggcttgtggataagagtggagttagaggactgttggggggggaaagggtgggagcgtgtgggagtgaggttggggatgatagaagggtggggcgcgtgaagaagagtgtttagtggtgtgtgagattcgggtgtggcgagatggctaggtagtgcgatagatgaatgattgggatgagggggagagggtgtgcagaatttttttttaaaaagtagagaggggtgagggtaggcagccccaaagtgggtgtgcggtggagggtgtgtgttatcaggaagtgtgaaagagagtggggagtgagttggaggagggcgggtagaggagaccgaagagggtgggaggtggggtaggggggaagggtgatgaggggaggatgttaaaagagaaggaagagattgtttttaattgtgggataagaagttctccggaatagaatgggtgatttaaaagttaaaaaaaaaaaaaaaaa

SEQ ID NO: 19742 - DNA, 888 bp, Homo sapiens
  misc_feature (1)...(888): n = A,T,C or G
aggagggaggtggaagggagggttattgcgaggagtgataggagggacttagatgtgcctggntagtgatcagtaatgaagaccgcatgccgtcccaagattatgtcctcacttataactatcacaggaatagggggtggggggtggtgctctgagctcctgcagtgaaaagcaggaagaggatggccttgactttttaaatacttgggaacccaaatttattacattagcagaagcatgcgcaaagagataatgtcacagcgctacaattaagtctttgtcagacattctggaggggggggaaaataatagtgtaaagttcaatttcaagaggtccggatacgatggatttttttctcagttttgaattatgctactcaccaatttatatttttaaagcaaggtgggcgttatcttttccacaaagggaaagagggtaagaacaggcaggtgggagatctcagactccaggcctgaaattaagggctctaaagcatcgtggtctttgtttttgtaccggtatttgaggttttaatgtgctggagaaatagtagcccaacaatagcttagtgattcggatagtagcattattttgggtcaggtttaggtgagaggggggaagagaagcagaagattttgggtttccctttgtgagaagggttgggagagaaactatgcatatggaggtgattcaacctggtgggggcttaaaaatggggagtccccgtcgagcctagcggatgggttcactttagagcaaaagtggtcaagggccctagactagcaattggtggtcgaagtaagtggaaagaagggagcattaagaagaggaggccggggggctagagggggaggggtggtctcttgcgttataggggtaaggaaaag

SEQ ID NO: 19743 - DNA, 964 bp, Homo sapiens
  misc_feature (1)...(964): n = A,T,C or G
acatcacacactgcctcacaggcaccagcctaaatcgtgtataatgtatactccgcgttctacaattatgtggtttatgtctctctggcctctgaaacatcatatggtcgacacattcttttgccgctccgccccgtcctgttccgctagcgcccgctctcccccgacacgtccctcgtcagaacgacgttaagatgtatacaatcaatgatggtccgggtaatcgataatcaatataggagcgcagnctccaatcacgggtgacagacgcaataatccgattactgaactcgcgagcctgacaacagcaagtctcggtcaatgacgcgtgatcgggccgctattatcgctatcctcagcgctctcgttgaagatttattgtagtgacggaacagaagacactacaatatcggacgctggggctctctatctgctccggatctccgaatcatccttccgatcaacggccagccatgccaataaatcgaagtggcacaacactcctttcgcccttcttctgctcttctactttctgctcctttctctttctctctcntctcgccctctctcccatctttttccttctctccctcttccctctgtctcccgcttccttttctttctatttttctccttcccctccctctttctctctccctccctcttccctctccctcccgctctattttnttcctccttttaaaacacaaacctctctcccctaactcaacttatatcttttttaaactcccttaccctcccctaaaaaataatttcttcctccaccttttaactaattaaaaacacacattttttactcccccccaaactccttatcttaaaacacagccttccccttccttccaaactctccctctctttcaacnttncccatgggttctccnntaaaccctgggggtggtcaacaaagaatctttcccgtagccccaaagtgttacctgcg

SEQ ID NO: 19744 - DNA, 358 bp, Homo sapiens
agttccattgtgcctgtataaagggttgtaaaggggtaaccattcccctatttcccggtcccccttttttttttcccaacgggaattccgggtggcgcattctccggggggcaagaaatgtataaaaagccgggaaaaaattggggcgatttttttttccgcgtgctttataaaaggcgggaaaaacccacctgtacgggtttggtttaagggccactttgccacctgtcttaaaagcccccaaaatttttttttccatacccctggggaaaacaaacggggggaaatcccagggattttttggccataacccgtagtcccgaaaaagcgggccaaaaggcctccccccaaaattttt

SEQ ID NO: 19745 - DNA, 864 bp, Homo sapiens
  misc_feature (1)...(864): n = A,T,C or G
annttaanagntaantgagagannaaagtttacgtcnanaatgtaaagattaatctttnntgtannnacaaggagangnttncgatananatananactanatatagannatatatnagccataaaggnnataaantaatcatgtaaaaaaagagagatatataaangangngggaaattntgttncaagagtgcttttatcccaagagaagtatanagacanntgaaagagaatananngagttanaanntanatatgtaaaataaagaaganncncaaaaaataangtgagatagaannaggaccnacngtgggaagcanactttggaanggganaggagattaatngaaaaaggtccaagagngncataagnnagggaataancgacaaaatagagtttggtagatntnatccanngttttnnggaaaanacanttctgaaanttaagannncaganactatatatanttaacnaccagaaanaaaatattttggnatagnttcatcnaacaattccacaangctttagtcntntaaggatccaaagctnggactgaagaacagaaaaacntgctgatacaagtcccttaacaggaatggttggnctgancagnntggttcttncacccaatttgnccaatggatttcaaagacaaagttttggaattgaatttcggtaactttaagtctacnaaagantattntngacnnngacaaanangnaatatagattgtgtgnncnntgtatattcaatcnaaatgtctttnttanttnaancaangaagtactgtnnaatgnatatnattcgcaaatgtntnattcactttncctttnaaaagtttgcccttaaatggataaat

SEQ ID NO: 19746 - DNA, 821 bp, Homo sapiens
tccatttgatcaaactttacgatctaaggagaaaacacacaacttacatttaactgttttcacattacatagctgaatcggtctgaaataagctactccaccattgccggtttctgaaaatctgctgaagaacagttggccctctaaattcatggcctctgcgttgagtgatctctgctggattgaactggatgcagaacatgtggatatgcagggccagctgtgtttttgatctgcagttgttggaacctgcagatgctggacctgttgatttataacccagcgataccatgggctgactgtaagagacttaaacatccacagatgttggtatttgtggggatcctggaactaacgtcttgtgcatacagacgactgactatattgaagtgaaacctcagatattagggtcaatttaattcatacgtacctcaggttggaatgctagtaaagatgaggacattttttcttacatgcgcagtgccattttatgcttagaatacctggattgtgccataaatatgcttatacaatgttcttttgcttaccaaggttacacaaggattatattcacatgattccgttctcgcagatgagttctagggatgaaagacaggtaatatgcatcggcttatcggcatgcttttccatccttatttaatcaataatcgattgtaggtttcgcgtacgattctcacccgcgagaaatctccatcctgttatacaactttattctctttttagaaaaccggtatggacagcttgtatacattcacaggtacctctacagtaggggtttcccacactattctctcgtttag

SEQ ID NO: 19747 - DNA, 783 bp, Homo sapiens
  misc_feature (1)...(783): n = A,T,C or G
cctaggagaaccttcccacccagcctacctgacagatcggctcaagagatagacaggtagacaactgcagcttctatcgagcgtgctgattgcccctaactcgaccgaaanaatctcgtgacttgcctctagaccctaccgtgagtgacacatgaaagagaacacagacagcttgagcatgtgatatctactgtctacaagagagtgaacgctcatgatatgatcctaacgaaccgcattctttatggaagatactgggcgagctttgggtgaaagccttagtgtggtctctcactgtatgctaagatagctgagagaacctctgctattgtaaactatgtttcgagttggcggacgtaacatgatggaaacttggttagaataccaatgaaacatttactgggatagaagcgcgatcatcagagacacagagcatgaggctgaaaagataaagaaactggccttgttggcctcagcgccggaactctgcggccgcttccttaatcgagggtcaattcctggaccccccctccctgactcctcccctccggtagttcactcccgccacgtcctccgtccactcccggcccgtctcccgcttcccccaaactcccgacaacccccccaccccctctcgccgacctcgtccccccaggcccccacccttacacggtctcctcgcctccctcttacataccaccgcccccttgaacacctcacacaccccgccgctcccccccacgcgctgacacaccacgcaccccctgtcccacgcctaccccc

SEQ ID NO: 19748 - DNA, 1029 bp, Homo sapiens
  misc_feature (1)...(1029): n = A,T,C or G
gggggggggggaaagaaaannaaaaaaaggaaaaaaaagaaaaaaaagaagaagaaaaaagaagttaaaaaaagaaaaaaaagggggtttaggagagggnnncgnanaggaagaaaaagaaaaagaagagaaaaggaatttagagggggnaagaaagagaagaggggaancntcacaaggttcgtccgccaccgacccccgccgcacggcgaacggggagaggaaggcagagaggaggggggggcccggcttgagcgagcgataaggagaccgggacaaaaggaccgcacagcgcactcgacaagccagcacgcactggagaaaagcccaccgaaccataaaattctcgaaaggtaacaaagggccacgggaaacagaggcgggagaggcgggaggaaganaaagggtngcgtcgtcataggagggaacaacagagcgggaagggcctgcggagcagggacgcgcacggnacacgcgaggcaacggcaccaccgcccgccaccgcgcaccgagcgcctccaccgccgtccccccgtcccccaacgcctcgccaccccaaaccaacatcggctcacggagaaccccccacgcgtccgagcgccccgccacgcggagcaccacanacccccgnagatcaggaggccctcgcactgacggacacaggagacagtaacaccggacgcagacgcccgagtaggagccgacggccaacaagaagcagcgcaaaagagatacacggccagaaggaaccagccaccacagcacgacggaggcacaccggccggggacgaccgcccctcgccaccccaccacacgacgagcgtggtctcgcgactagaatcgtccagaggacgccacccgagtcaggagaggagaggcaagaacggagcgcgcgggtgcggcacatccatcgcgcgccgcacgccaccgacgagagagganccgacagcgagcgggcggaacgctccgcagcggaagagcgatagcacgcgctccacaggccgagaaaggacgcggctcgcgagaggg

SEQ ID NO: 19749 - DNA, 852 bp, Homo sapiens
  misc_feature (1)...(852): n = A,T,C or G
gctgttcgaagaaccaaaccagnangcancagaagaagggaggaaagagaacaacacacacgagtaccccgagaggcgacaacaacacgagagagacacaacaacggaacgaaacaggagaagaaaaagggagcaacaaagaaacgaagccgaacagccacaaccacgacacaaaaaaaaggagcggaccaggcaccaaacaaccgcccagaccaacgacacgcagccaacgagagagaaaagaaagaaccaatgtggtaacccccccgccccaaagcgcccgcccggccgggggggccgcgcccagacggaccccagccaccccccccccagcaccggcgagaaaaccaccacacccaagagncccgagagccgcgcaacgccaacaaaaccaacagagacaaccagcaccaaaaacacaagccccgaccgccccgacaanccccacccgcgcaccaacaccacgaggccaacagggaacagagcccccccaccacagcggcagagagagcgagggcacggagaccagaccacgcgagagccagaccagagacaggccagaaaacacagacaacacacccacccgacccagaggacgagaccggacggccctcaagcgagacaacaagnccacaagcgcacggggcagagcccccaaccgaggacggaaacaggcagccgcagccccggggggggccagggggcaccggacgggaggaggccgcgcccggcagaggccaacccaagcgggggggcgggaacaccccccccgacagccccgaaacaccccgaaaaacaaaccaaaacaaccaaaaaaagccaccacagccagagcgaagaacacaccacccc

SEQ ID NO: 19750 - DNA, 1056 bp, Homo sapiens
  misc_feature (1)...(1056): n = A,T,C or G
gaagaaaaaaacgaggggcaggaacaggaaaagcgaaaaaggaaagaaaaagaaaaaaaaacaagccctaaaagaaagacaaagagaaagaaagaccttcgngagaacgaaacccaacgccaggaaagcaagggcgagaggaggaaaaaagagaacccttccacgggcgagcagaaaacaccagcccccgacaccagaacagcgcagagagccaagaaggaaaggggagcagcgcggccacagagagagccaggccccaaaagcacacgcacccagcaaaagcaagaagcccaccccaccccggaacaaagcgaaagcaagaaagaacaacagaccgggagcacccgagagaaggcgaccctagaagcaaagagacgccgagacccaagcacggcgccacagagaagcaagcgaaaccacggaggagggcaggagagagagcaagagagaaacgcacacacgcgaggacagcaaaacaaggaaagaaaacaagcagaacaaggaagcagacagagaggcagaagccagaagccgacaagcaggagagcgggacccaataggagcaaacagcggaccgagaaagagacaaaagccgagcgcacaaaaccaggggagcacaagggccccagcacccccacacgcgagcgagggaagcagaagcccaggagcccaggcccggagggaacagaacagaagaaagaggagcgagaagcaaacgcacaagccccccagaaaccaggcacgacgcggccagaggggacccacagagcgagcaaccccaggcgacgcnggcgccagggggaaccgggcgcgagacacgggagcaaggaacaagagaccccgccgagatcggagagaggaggcaggggagacacaccacaggcgcgagagcgccgccangcgacaagggcacaccacccacaagcaggagagaacaaacgacgacaaccccacacaagaggcaccagaaagcgcgacgaggccacacaatcgagacacgaggggagaggaaacgcagcgcacaggccgcagcacggaaaagaagagaaaacacgg

SEQ ID NO: 19751 - DNA, 2481 bp, Homo sapiens
  misc_feature (1)...(2481): n = A,T,C or G
ggggccccacgcggcagcngnncacnnnannnnaccgccaacaacngnngcgncgcacganncgcatcgtcnagncnnagcancngngcnnatggctntgttttttatatgngtagacgtgnacgctgtcnacaatacngactcnaccgaccacacgatgagacagnagagtcgtgttttatgtgntgtagnagnagngngtatgtagcacnnacaggatgnangatacaggagaggacgacgngctgagantcgcggacctcnctactatnntcaccatccggtnngagctcacagtggtattagtanatcagcccacgnattatatgtatatgcacctcgcgancaactagacannctgcancagcactttantcgagagnatnatcatcgagtatctaacntacggtacgatcgacncgatanntnactacncacgactcacgtcgattctcgatatctgccggtnacttgatgcgnagcagagantgtatgtgtncgagtatacgccagatatnatgatngtatgtatgaggataggctgatgacgctgacgncgtcgtctggcatgcgntntgnatgagngttgtagtgcggcgttctcttntgcgcagttactggctcagcgtattatatcgcntcactctatattgcactccgcatactctcgtgacgcacccggcggtgntgcgcacgcgcagacgacagggtcgcacgcaactgatcacacnctgcgatntacgtacgtatgngtatactngagcacacngcactataacatatctatacactanaaatagtaacacgagtatcgtcatattntgtngtctgtgtgtatcgctgnngatatatatnctctcacgtatagagatctgttccngacngccangtacgaggntgtcggcgcatgctgtggctgtctgcacggcgggcgggctcgtgtaccngtgtgtcgagcngcgcgcgcagcaccgcacggttgtcgatatagcgagtactctactcccccnctatatatnatatactcaactcatcgtatcatgcagagcacgctntttatgccgcacttcttgtnatctcgttatgacattgctagtcttagtgcacgcgccngncagtgatcctacgccgccgcgcgcgctcggntagcccanttcgtccgcgcgantcgctacagggttaccgcacgnacctttgtgtgcagcncgcagncgaccctctatagtgcgcgncgcgcgtttctgaacagcnactctngtctcgacacacgactatatgctggagcaccatgcgtcgcncgcgcgccttcatagnatgtatttcagcatnacgtcgctntgtntcatatgtcgtacactgcgncgacgtcatgcgtacgantgcctnctgacgtgngtatcgcagntgcacgcaccagcagtngtgtctgcgcgatantcatccgacgatanattacgggtcgcacagttatngcacgtngcacagtatgtgacgcgagcgagatctgttcgacgcgacgcacagaggtatttgtgcgccgccgccgcgtctcgctgatttcgccgtcgcgngctatgactgcccgctgttgtattcantagtanatgangtgagcgcaagagcgcncgcagcagcatccgtccccgatatangtatattctcgccgcgncgtgtatatntgttatcgcccagtcgtcgncacgcgctcgatgagccgcgttatactcgcgagtatgtctgccagctcgcgtatgacgcgcgcgtatcagcctcgcgcgcggtctgtcgcgcgaccgccgngatatcatacgcgccagntatccctagacacctatgcccgctgcccacacggctccgccgtattntgagccgcgcgctttcgaagctccgagtatatctcgcgcacgactacagcgtcaccgcgcacgtgtgtatatagctgtcgatanatnctanattttcgtccagagtgcacgaggagtaccgcgcgactatatntgcgngcgacgagttgantngtacgtatctgtagatgcgatgcgcgtagcgtgactgactcgcgtagacgcgngnagagcggacgcngtgtgctntcggcgtcntggcctgcgcgcgtgacgccgctgcgttacgcgtcggtctcgcgtgtcgcacgttgttgcgcgtctcgttncngcatatatcgtgtggtcgtgtctcgcgacgacgcattatcatcttgccagctgatcgtctgttctatggtacntgttgctacatgtcncgacgcactcgacgacgcgcgccgatgagtgctgcgcttacgtatntatcacgtcgcgtcgtatgttagtattatantcatanacttnatctctcgtcgntgtcatcgcgcatcggagttctcgccgagtatnatctagacacgncgacgcgcagtatgtcgtcgatcgcgagacccggctncntgtctgagtgangacgagatatactatctgacgg

SEQ ID NO: 19752 - DNA, 2275 bp, Homo sapiens
  misc_feature (1)...(2275): n = A,T,C or G
tactactttntcnnnnccnncncnnnnnnnaacnatggnnccnnacatgtntnnnntnnaatattntntannnntnntntnnnttatncncattantaatatgagnnncacgtgtattgtntccactntanaatnntacgtcnatgagtntacangttnntntancatncatatatncgtgnaccnacgnntncgagagncataaaaacaatatggtatatatgtcacntagnaccanttagtagcgacagatggtcaacaagtctgagtggcagctacnancgncacacacgcgatgtcattatatcgngtcgtnanttattgtnagatacggatnctgcactcgacgcnacgcatgcgtagatancatagcaatcaccagctcgcatagagtacgcagatcacgcagtatatatcacacacaatattcgcangacagtagcatcgagtcacgagatactacagacgagacagactcgacgagatatttatatcgaatatattntgagtntctntacgacncncngattanatcgcagcgatatgtgggcacgatcttggattgtgtgcgctgagtggtgcgtnaggatatgcgctatgcgttcagccnncgctacgcgtgtcgcagtcgtatgcgtgcgancccacacnctgtacacactatatacttctacctctatatatactgattattatatantactcttgctnagatcgtatgttttcacgcaacatcgtagtatatccgatatactcacaccatctacgcatcttctaccatatctcaccttacaancccacattctcaccacaccacccacgccggttgcgtgtcgtctaccgccacctagatacaaccacgccatgtgtcccgcngatcaatctgcgacctccacaaanagagatattgcgtcatggtgcacgacgncgtatcgacgcaccangttcccaccgacatagttgtgtgttacgttgtccgaaattgatgtctcgacgcacantctactagcagatacattgtatcggcgcgcgcgtggttgcgcggttatagccgtatatnacacacaaactcccgcacactcatacccctctctgtcacctcaccgcgctgtattccacgcgagacacagtgtcagtcactcattccaccgcgcaaatgtcatgtgatttgtgcggatatcagtcgcgcctatcatcgccgtccnctntttgcgcgcctgccctctttatcnncctncccccagtcagcacgcgcggtagtcgcgagagagacgcacgatngtcntacgcgcgtatagtatcgcacgcgtggtcgcgcgcgcggcagtatatttaacagcagaaatagaggangnatgtgtgcgcgtgtntacgntcgtatncatcatacggagacgaacgacncagtacnanctcacacaataaaccgactgcgcggngntgtcnncgtcgcgactgcatcgtantgcgtcggctgcgggtcgacgatgagtncggancggatagttatactnctccaactacnctcncatcnannaatatcaactnctactncgtacgcgcgangtnctcctntcanatatctcaaacagcagacccnggacgactgatgcaaatcaaaggatagaacgnacganctatgtgaccgngcggttgggtcgcgntctacgctatccnnaannancacgacccggcagnatnntangtncngtcagacgtanatatgatcannctacnacgcgtnggtngtgacnatgtnctactgcaattgatcctaatgcgnanatagtantgcgnctnatcgtagcggtcgntagnngagcannganacagangctcagcggnctggtngngtngtagngccnggcngcngtcgntcnttcngatcgtcgtnntagtnatgcagtagtcagcnacgtacaattntacaactanncgnngactgnntnngtnatcgtcagtnatcnacgtcgtcgcngtcgacgncgatntagtncagctagatgatgtcgtagtnnattaccagncantcgtccgtcacggcccccgcncagacnatnctgcaacgantnatcgntanctancgnatggcggaannctntcgngcgncgtnctacatangccgacgaagctagantnatnagnctagcaagtatcatactcanaacttnncctccgtccgncagttgantntggagtcgtcgntcgtccagccagacgcgcnttagcntantactnattcagcagnacngattagttnatagtnacnngcacg

SEQ ID NO: 19753 - DNA, 1099 bp, Homo sapiens
  misc_feature (1)...(1099): n = A,T,C or G
ttatgtgtntatatggtaaatattaagtntnganntngccagcggcttgtnnatagcagtcgaatgatcatttaattcgaaactgattgacgcagaagaggnnttcnatngagggaagactcgagagacatgctatttncattcatcnctcgtccaatcgaccgagcagaatagcnagngcaaagcgtcgagtagtgttggcacctatcataccctatatatactgctgttgactacaatacacacgcctgtcgaccaccaacatgttccgatatgatgctcaactggcgcccacacactccttcactgccgcagcacgtccgccgagacattctgagtgtcgggtagtagtgtagcctacactccatgcatgcgtactcctcgccatcatcgcgtcgattgcactcaccttaataggagactgcgtaggtaagcctttgtctgagcgcgacacacgttacctgtgtcttgcaatcgtagacatgttcgcacgtgtgcgcagaaccccacccacactcgactgcctcctcatgtttaacatggccgaatgatatagagtacaggacaggtaagtattatttaatccctatgtataagaatcctgcactaacccggccgcgccactataataaacgtagcgatcccacacctccacggcccagttcgcctccgcctttcgcaccaccaacccatgcaattaattctacctcccacttatacatccctctccctcttttttccccacgtcatccgctttcctcgccctcctctcactttacactcccgcacccactattactccccccctactcccccccctcgccaccctttttttctatcctcttcccccccttcccctccctactcatcccccccgaccatttcccccatgtactattaccccccctcccagcccgcgcctctttctttttttcctccccgctccacttctccccgcgatacttatttgttcttcgcgccccatcttcccgccccagtacatttcccactattcccccccccagccgcaacattccacccccaaccaaaattaatatacggctatcactccccgtatatatccccccccctcccccat

SEQ ID NO: 19754 - DNA, 1599 bp, Homo sapiens
  misc_feature (1)...(1599): n = A,T,C or G
aaacaccacaacangggggaacagactgacgcgcagagatttcgcaccaaangngcgccccgccagccatatttattagataggagatggaggacagagaggtaagtagatttgtaacgtacgaatgtcacactttttgagcacgaggaacattgagcgatagatgtgcagctctgagcgagcatatccgcatagaagtgtggtgtacagaaggaagtatcggggggtagtatgtgagacacatctggacggagtgtacctaatgttatggttcacaggtggcgcgtgtgttacgtgttggagtagagtcgttgaatgtggtcgacgagtagagactttgtatgtatgagtgtttgtagtcgcttgtatnagtggtgaagtcttgangcagcatacacattattatttatctgatcgcggttcatttctattgtggctataggcgaacgacaactaaagaacgcgcagacagacatccccgacttcgacagagagaagatcatattctctgtcttccttcccgctttctagtatgttgattctgcttatctgcggtttggccgcgcctcggtgttatatagccttgcgcggtttcattctcatttcacgacatatagttagatatagcgccctattatctgtcgcgntcctgagacatatcacgcgcacgatccggagatatttaatacgatttcgagtattattatactgcgcactacctgtagtcagatgcggtttcagtgacgcgggattcgatcggtatcgctactatataacgctgaatacgtgtattgtgcgacatgatgcgactatcgcagtgttgagccgacncgatgtgtgtgtatcgtattgccacgctatagtgaatgtgacgatgatacggcgatacgccgctgactattcggcagatatatanagtatccgcagtgcagacacgtntaatacgatgacgcgcagatgtccgtccagatatctaccatatnacgccgcgctagatatctactcgtccacagntatgtagagccgattgcttttccagtaaattctcacgcatatatgtgcataatcgaccggcatatcgctcgggcttattgttggtgncgtgtcgagccggccgacatttcgtttgatcgactccgaatttatagtcggatcccgatggtgcagcgattgtatgcagcgngcagtatttgatttagtggttgtacgcgcagagcgaagacgcgatccataacttacgtactgcgtatacttaatagtctcgtccnacgaccgcgtacatagcgcgagtgtcggtcgcgagtgtgtgtgntgtgctcgcgagtgtgaatgtagagttcgccccggcntngcatgttatatgttcgacgcaccgcgtctgcacgntccgtatcgtntgatccgcagcntcgccaggcgcgntcttgatgtcgtattttcggtcttcncgcggcgcattgtgctctcgtgtttttcgtactttgttgcgcctcangggaccagatctctgtcagtcggctatatatanagtctcgcgcgcttactgtcgtcgtcatgtccgcggcgacgtnctgtcnacatgctacttatctatncgcg

SEQ ID NO: 19755 - DNA, 192 bp, Homo sapiens
aaagaaaagagaggtaaggaagtgaaaaaaaaaaaaaagaagcttgcctgtacttttagcacaactacttcctgcatgtcttcaagagatggatgctggccaatttcctcctcaaatggcaagaggtatggatctacaggtcctgaaaagtaagaaaagtaacataaatcattttcattaaaaaaaaaaaaa

SEQ ID NO: 19756 - DNA, 1648 bp, Homo sapiens
  misc_feature (1)...(1648): n = A,T,C or G
ggagcggagcgagaggggagcggcgcaggcgcgacgagacgggcgcgcgagagngagagagacgaagcgcgagcnccctgcngnanagggaaagnaaccnagngnaagagcgnaagcgcgcccctgncaaggagaggagggcgaaaaccanagaagaggagagagagagggnagaggagagagaccagagagagagagaacancgacacgacgagcgtccaagacagcgacgagggcagcagccggcagacgagaaggaganacgcaccgcgacgagcgacgacagcagcaacggaaccgncggacgagnagacgacacncagaacgcagcgcacacgagagcagnacgagggagagcggcggagcngagcgcagacnggaagccagacancangagcacccgcagagngacacgcacgaaagcgcagcagcgcagaacacagacgagnancaccgacacgaacagccaccagcacgagacaggagagccgacgagcgaggncagagaaagcgaaaacaacgcagcgagcagcgagcgccagagacaccgccgagagagagcggtctcctacagacgagacacacgacacagcacggacaagcgcacaggccacagaacgcaccaccagacgaggccagcacnacgagcacnacgccagagcacagccagccagagcggngcgagccgcgcgcgacacgagcaacgagcccgacgacgcacgcggcacagcgcggagcggcaaacgacgcacgcgcacacacgncggcgnagcgagacgacancggagagncagcaacaggcacggcacgaggcacgggcgaagacacagaacaagagagancaacgacggcacaagcgcgacgaacaaggnaccagacgcnacgcacgagcacaggcgcgacgcgagccgcanacaccgcgcccagagacacgagcgcagacacagcangncagccggaacgancngcnangacagcaaacgcaagacaacagcacgagacgcgcacgggagcgccggacacagagcaggcagagcgcgaagaggagagacgacgcgggacgcacaanagacangaagaagacgagagaaggcagaggagcgagcgagggcgcggacaagagcagagcggagcagaggaagcgagcgcaggcagcggaagcagcagacaacancggnacgacgacgagcggcagcaggcggncgacaacagacgacgacgagaggcgcggagccagcacgcacggcgacagagacgacgagcgacgagacggaacgagagagagaccgacagcgcgngagcgggcggacgccgcacggaccgcgggcacncgccgcgaggacgagagcagggcgagcgcagcgcgaccacacgcacgcggaagaagcaggaagcgcacggcacgcgcgagcagcacgagngagagccgcacgacgagcacanggagcggcagcgcgaagaggagaagaagagaaccagccnagcacncgagcgagcgcgnanggaggcgcacgcgggcgcgaacgcggacacagacggancgcacgcncgagcaggcgcgacgagacgcgccacgcgancgcaggacancaagacacacagacacaacacgacacacgccgccacaggaggngcagacgcgcggcgc

SEQ ID NO: 19757 - DNA, 993 bp, Homo sapiens
  misc_feature (1)...(993): n = A,T,C or G
gcagcccggacacccagagaaacagacccgaaaaggtttcggtgacaaaagaaagctcaggggagaacagagggaggagaagaggaaagaaacaggagagggtataggaaggcccgagagagagagccacagggccggcgagacaccagcgccgacacacacggcgaccgcccgcagcccgccgcagcagcaggcaaaacgcccaacgagagcgggacagcaaaggacgcaccagccaacggcaaccgcaggagggggacacagacggacccgacgacgcgaccggagcagagaaaaaggcaacgcgttgaaaagcggcgacccggaaagagagacggggaagagacggcgagagcggcgccccgagcacgcccagcgccggccgggggaccgcggcgaggcgcccgagcaggagcaggccgcaaagcgcagggaagagcccagagcccacgcgaacgcagaaccggacgaaagggacccaggggaggcgagggtagcgagcacaccaacagccgcgcacccgacggggcgggacaagccggccgcgcgcggagggacgcagaggagcggggggagaggaggaggggcgcgaagggaccgacgacacggcccaagcgagcagaggggagagaaggaggaacaagagcgcagccgagcaagggagggcacgccagagcaagcaacgcagcagcgcgagacacacagcgcgcgacgcgaaaaagagccaaaagagaagggcacagcgaaccgacgaccagaaaagagaaacccggagcacccgagaaccccccgcgcaagngccggcagcgccccgccgaccaaacgcaggcaagcgcgcatgaaacaggagcacgggcgcgaggcagcccgccgagaaaccgccgcggaacggcgcaacgccccgaaggggacacggggaagacgacnacggggcgangagccaagggaaccaaggacgaatagcgagacacggaggataacacccaccagcgc

SEQ ID NO: 19758 - DNA, 1619 bp, Homo sapiens
  misc_feature (1)...(1619): n = A,T,C or G
aaccaagacggacgagcagacgctatgaataccagatgcacacagagcagcaagaggagaagcagacangcgagagagagagaacgcnggcttcaccgcaaggggngnngaccngnacngngaacnanganggncccgcttcnngnangagaggaggcgaagaaaccaaangcaaagaccacagagcgcgcagaagagacagcgaccgcgccagagacagcgcgggcgcggcacgagagcgcgccccagancgagagcgacgnccaccgacgcgacgcacgcgaaacanggacgccgcaccgcgccacagcaccagagacacacagagacgagcgcgggcgcacgcgacccgggncaggcaggaagcggccgacgcagaccgacacacgcagcacacacgcacagacaacgcgagccgacncggaaacgcngagacacgcaagagacgcanacgacgcgaaccgcgagacagacaaccacaccangagcacgcagacgagccagacgaccacgnagcacccgacacacgnagacgacacnagcggacnagcgaacgagnatacgtcgccgcgacgagaaagcacagacaaggcacacacgcccncgacgcggagaacaacaacagccacangcacgaacgagcgcacaacgccagagagcgcgacgacaagacnanacagaccaccagcagaagagcaacacgacgagagcacacacagcaacgcgagcgaaggcncacagcgagagaggcacaagcacngcncncgcaccaacacgaccagccagacgagcaacaacaagagcaccaggcgaggcacagacagaagcagacgggagaggcagccacacgagcagagaagagacgagcggagacacgagcagcacgagagaacaagaggcgagcgaganacgancgacgcncacgaacagcgacacgacaganagcaaggacgaagaaacacgaacaccgaacgaaggcgacagcagcgancggacggcgagcacagcaggacgcagagaggagcacaacgaagcaaacaccggcgcgacgcgcngcgagcgccagaacgagacggcaccaacgcacagcgcagagacgagacgacgagaacacgccngcgcggccacgggccacacgacgcccgacagcaccagccagacggcacgcgacngcgacgcaggacgagcgggacagagacagagagcagcgacggcgccacggaggcggagcagagcaagggagaccaagaggaggcggcnggagggagcagagaagcaacggagcgacaggcggaagagcgaggcagcaggacggcacgcacgaganagcgagagaggcacgcgccacccgacgcagccgacgncacngagcgagangagaacacaacgccgagacaggcacacgagcgcggcnagagaacgacaagaagaagggagacgagagacggaggcaancggagaagcaaccggcacagcgcagcaggaggccaagacgcgcgcgacacgaagggcgcgacgcgcccngcagncagcgcacacgcgagcacgnagcngacgagcgcggcaggccgagacgagaagagagagacgcgagcggcgaagcagcgacgagggncggg

SEQ ID NO: 19759 - DNA, 1302 bp, Homo sapiens
  misc_feature (1)...(1302): n = A,T,C or G
acacacacagcaaaagacacacgacaccaccaagcacgcgacganaagagagaacacccnaacacgcccctgcgatgggagaacgacccaaaaanagcaaggaggccctgnaacacggaggaccgcaacacagaacgcgcaccacaaccgcgaacaggccacagccgaagccgagcaacaacaagaacacacccaccaaagcggcccacnccgacgacacgacccacgacagagnagagagaccaaggggcgaaagaaacagacgacgcgcacagcagagccaacagaacacgacccgngcaagcaaaacagcacgacacacgaccacnggaccccacaaagcaagacaacgaacaaagagaccgaagcaaggaggcaagaaaacagggacagagagcgagacgcgcccgcgacgaagaccccgacacacaacaacaacgcacagcgacccaaccaaagcacgagagaccagaagacaaaaaacaaagacaagaacagcccgcgaacgcagaccacggaagccaccgaacacaccgacgcgcgaaaaagcccaagggaggagacgccgagcaagagacgaccaggcaaccagcacccccacccaaggaaaggacacacggccgccacccaagggcccaccagacacgaagccccaagagcaaacaccacgccaaaaaaagcgcgcacgaaacccaacccgccggaaatcccgaacaccgcccacgcagaggaaagcccgcaagcaacaaacacacccgcgcctaacgacaacaaggaaagaagcaacgaacgcagagaaaggcgcgcaaaccagcaccaagcaagacaaaacagaagagcgaaacgcgaccgccacaccgcaccgccagcagagacacaacaacgagcaacgagcgcagccaaagaaccgccaccacaaagagcggcaacggaacagcaggcagagaccaaacggagagacccaccaccgccaggcacacagaccgccgagacagacgcaaccgcacaaacgggcgacgcctaagaacacaaacacacgcacacgcgcgcgccggaaaggcaccacaggcctccgcgaagaacgaatcacgagacgcaaaaactacacgagccgacgccaatcgaataagacagcaaggccacaaccacaagaagaacgccgccgaccgaaagacgcaaggacagacgagaagcacaggcacccgccaacgcacaacgacgtaggcgaagagaaaagaaaaagagaagacaccgcgacaacaccaacacaccaaggcgcaaacaatacgaacgcgcaggacg

SEQ ID NO: 19760 - DNA, 1191 bp, Homo sapiens
  misc_feature (1)...(1191): n = A,T,C or G
aaagaggcccgaaccgaccaaaaaaggaagggaagacggcgcaggggcctttgtagtggaccgngggggcgaggctttcgcggggncgaaaccacccacacacaacgcgcgcccagaagcacgacgccagtcaggcagcaagaagacccccccgccggagcggggggcgggccgggacacaccacagacgccgagcggacgacacaaacccccacacaaccggaacaggagcaagaccacgagaggaacgggcagcgagggcgcggggcgggccgagcaagggagcagaggcgaaacaggacaacagcacgaaagcacaacgccaggggcgatttttttgaccggagggagagagcacgacaaacaagacaccgagcaacacgcgacaaccaacacccgaagagggcgaacgaccacagcacgcaagcgcgggcgcgtcgcgcgcgaggcgaggagagggagagaccacccccgcgcacgcgcgcagcagcgcagcgagagcacagcaaaaacgcgaagaaagacacagngacgcgcgcgcacgcgcgcaccagacgcgcaggaggaccgcacgacacgcacggcgcgcgaagagagagcgagcgaaacaccaccgaccagacaaatcgcggaaggcccacgcccaagcaaccgacagggcaaacgcacacgagaccgcgccgccgcggacccgacggagagccgacccgcggacgcacgcaacgagcgcggcacgcaagacggcgcccgccggagaaagaaagacgacggcgaagtgggcacggaaagagacagcacgcgcacacgcgcgcgcagcgcgggacgaagcggaagcggacgacagaccgccaaaggaggcagagaagcaacacacgcgccggacgagcgcgacccgcagacaaggcgcaccaccagcgtcncagacaggcacacgcggcgacgcgcccgcgcgcgcgcgcaacgccagaagaaactganaccgacgcngcaccgaccgcaccacgccggcgccgacgagataggcgcggcgcgcctggcacgcgatgcggcgaacgcaacaaccagcgcggngcagcgcgagcccgcgcgcgcgcagccagccaacattggccgagacagatagcgancgacgccgaacgtcgacgagccgaccaccgcgaaggaaaactccgtccggacacgccgcaccgc

SEQ ID NO: 19761 - DNA, 483 bp, Homo sapiens
  misc_feature (1)...(483): n = A,T,C or G
catgtattgatacagatttgtnntggntttaattttttatttattccttttactggtttcgaagtgatgatccttttattattcttttagcgcttaccttcaaattttaaatggacattattgaggcttgtcaacgtctacaaaagtgtactggaattttgattgggattatgttgaatcactggatcaatttttggagaactgacaactncacaatattgagtgtgtaggtttatatatgtgatatagctctccatgtatttagatttttagttctcctacacaatcttttatagttttaattaaacaaattgcacacatattttaaaaaatgtatccctaggtattttatcttctgatgctattcgggagtgctattagtgctttttaaaaaatccttgcagttttttgatgttttagttatatataataatgcacataattttgttataaaaacaaaaaaaatggcctcngttggcctca

SEQ ID NO: 19762 - DNA, 139 bp, Homo sapiens
gcctgagggcactgacaccttccctgtttgagaagatcagaagaagaatctctatcaggaccagtcttcagccataggggttctgcttctcggcttctataagcaaccagacaataaaattctggcctcgttggcctca

SEQ ID NO: 19763 - DNA, 399 bp, Homo sapiens
aagtcccagctcctttgaatctgaggacacccttctccatgaacggtgcgtgagcaagtctttcagattctgtctccaaagtcaatcacaaatccatcttcttctctccatctccagtgccactcctttgaaggttatgattacctctggcttagactattacaacacctcccaaatgagatgggatttcaccatgatgtccaggcgggtctagaactcctgagctcaagcaatccaccctccttggcctcccaaagtgctaatattacaggcgtcagctaccgcatatggccaattttctaaattcttaaatgcgattctttggcagtgttgttttgtgaccaaaaataaaatggttcctagaaataaacacatcacctatttcataataaacgagga

SEQ ID NO: 19764 - DNA, 1107 bp, Homo sapiens
  misc_feature (1)...(1107): n = A,T,C or G
aaggtgtggactttgggtatgggggcggggaataattgatgtggagaggatataaaataaagaataggagggtgtaatgatggatgattgtatttggtaatagaagcagcgacggtgtttatgttgaaggagttatgggtgggggggtttatgataagagggaaagggaacaatcgaaaaaattgggatggtgtatggaatattggcgaataatcgaaagtattagaggagtgggtaatattgtatgtattaattagggtaaagggtgtttggcggtaagattggagaatgcaaaaagaaaggtgataataggaggaataaataagtggtgaaaagaggaaaaggctgttagaattttgggcagagtgtattaaagtgggttttgggtgtttttttatgataaaaagagagagattaggtcataaggtgaatgggtgtaatggaagaattgtttttaaacgaggtaagagatgtttggtaaaagcggggggggggaaagggaaggttaaatatgttggggactataaacggagggagaggttaggaaaatggaaggaatccgcttctttttgaaggtgaattgtttgtgtagagtggttaaagtgattatgggttatttaggaagggaaaaaagggtttctccttgtattaggtgatttatcttgtgaggatgctgtcgtaccaaaaggggagaggtggcccccccgcaccacgagtttggtgttagaattagggttgtgaagttgatgagaatgtttgaaaaggttgattaaagatagagtttggtgagaaaatgttttgttattggtcatgataaattaaagttggctaagagattttgtagtgttgatgtgtattgatatagaagacattcaagggtagggtcaagtgtgtgtgaattgatnnttgttttgtaattttggcaagcgcaccccccgccctcataataagtttcttattttagaggatgtattggaaagtctctaacaaaaggtcgttggggttaagattggaaagtagataatagagaaggacgggaggggcgggagagcngcgtggtcgttgtgtgtgtccccgcgttatgaganaggatctggaaagagtgtc

SEQ ID NO: 19765 - DNA, 413 bp, Homo sapiens
ctcaacaacaacacaacgcagggccaggccatggtggtggagctgattctgaccttccagctggcactctgcatcttcgcctccactgactcccgccgcaccagccctggggtctgctggggacaggtctctctgggacagacctcagagattgtgaatgcagtgccaagctcacaggctgcaagggccaggccagaaaagggtgggcctgcagcctgcaccccccaccttccccaacccttcctcaagagctgaagggatcccagcccctaggtgggcagaggcagaccctccccagagctccttaggaagaagacagactggttcattgaatgccgccttatttatttctggtgaggatgcatgcgtggggctgctggtgtttagagtgggggctacccaataaatcacga

SEQ ID NO: 19766 - DNA, 256 bp, Homo sapiens
catggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaacctga

SEQ ID NO: 19767 - DNA, 844 bp, Homo sapiens
  misc_feature (1)...(844): n = A,T,C or G
cgcacacacaacaatcacccctcaaggacccgaaaaaanaaaaaangngggngggaagcttagaaactgaccgtgaactgtgctttaattaacccacccctacagtgctgagaataaaggattanaaactaccaanaacaatntantgcggccaggttccaaaaaaaaaanaaaatctaaatccaaaccagataagcagcttatccagtataccccctttccacttcttgcattcctccatgggaaccctgcttcttctgttgaacaggccagtacaacagcatcatcagaaattttgtcctggggggataaacccatacaacttnataaacttataaataccaacctanaccccnaaccaacccaaagtaagcttgttcgccttgaacccttgacctgaactgaacctactgaagctacactgttttatttatgtgaacttcctcctacacctcttgatagtgatattccacttttaaatagctaaatccccacgaagtggactttacatgtgtatattcatcaaaatcatgaactatttattctaaaccatcatttccctactttttttcaaaattcctttatttcttttaaccaaatacctcgagaataaaacccccttttgcttttctcactacccccacactcttccaaagcttccatgtgttactccccctccttacttaccccaaatcaattgccccttattgcccgctctttaattccaattcacatgcccctttttcctcccttttccgaaatttgaaatcctttttttccactccacccttacccccactaaattttctgttatttcctttatatccccgcctattccttcaag

SEQ ID NO: 19768 - DNA, 1678 bp, Homo sapiens
  misc_feature (1)...(1678): n = A,T,C or G
tttgttggttnttnnntgttnnttnnntnnnaaaanntagaggnanntnangaagtaggtgatgatgtnaggnatgtagagtgnttggngagtnnntntnngtgggaagnngtgntngcgantagtgtgatgtgtnntntngngntnnnnnangataatntaagtcgtatcatagttgttgtntncagtgccgatagtgcatagttgttaagntgtagnatgtgagactgttgtaattaatantgaaagattattgagtatatacattgtctgttatgtagaagagtaggtgtangagagngatagnctacaacatgtagatatgatagagcgancaatacagtacgaccngtcgaccnaccgcactcgagcagcgcaacacaacaccccgancgctcagncatcactatgatcatctatgtaacncgttacctaccagcaatccacacatgagtagtcacgaggctagacggtgagttgcatgtagcatgagnagtacgtgtatatcgnacgtatattgtatagtatgacccagcctcggngctattagtatanatatatatagtcgaatagattgatcgggtntgngccatagnatcacgatgagagatgagagtctactacggngatngcgtagagnctgacgctgnggttctgacgcgcgagcagtcctncgactcgagcggtagcccacgancnctgncgtgtgcggcgcngcgagatggcataacagcagctaaatcgagcaactnaaangcaggtattgctatcgcacgaccaacggtagacacaccgccgtcaacacgagtcgacnggcagtaatcacctcccgacatcagactgnatactcacacttaacacagcgtcacacacacccgcgatcgtcacgccgcctgtcagttactagtcccatgaccctcctacagagccctccacgaccagcgtgacagcaccgtcgacgtcgcgacgctcgtgcagcacactgcggccagtctcggtctaccatagacagtgacaaggagncgtngacgcatacgacagaatccgagcgatnccgacgatccgagtcgcacatcttcgcagtcgagtagtaatacagtccgcgcacagcaagaatagttactgaacagacagagtcggcacagagctgggaagaagagtgatgcgtccatcgacacacacgcgtaccggatatcgacgacccggcacgacgacatcgagctctcgagcgaccgcagtagagccgcacggtacgcaatcagagtaagccactagctgagcgagagcgccgtcgccnccagcacgagagcagactacagatcacgagcgcnctggcaccncgcagactcaagtgngtatncgacgtattgngatacgagaacagtcgagtatgntgtggatctcatgaacccgagcagagtcgagcgctagtcactacacgacagacacagcggctcgacagcgaggtgtgtagacgattacgtngcanatctgtcgtcagagatacgcgactcggncngcatcgtgtcgcgagncggntatctcaccgaacgatacgatgtgtnatttcacagagacatgacgtccgcacaaactgtgcagcatgcangtacacgcagtagtgagagcactcacgaacacnacaacggagcgatcgacagcaacgtaacnctggtct

SEQ ID NO: 19769 - DNA, 408 bp, Homo sapiens
tataagtaatttcttatttgatccctagttaaaagaggaaaaaaagctccatggctgccgctctgcaccatttgggatgtatgaagagccaagcccagcaatagaggggagcctgcccacatggatctataggagcctaacaccagatttccccatggcgcgatcccggtgacggaggcagccccagccggcatgccgcggccactctgcagaatggagaatgaatgtcggtgacaggggcacacagggcctccagggagacggccctattgtgcctcttctcctgggtgtttgtcacctgcatgcaaatcctagagaccattcactgactcacgttttcttacctgtctccttagaaacagttcttaaaagctcgcaccctgtattccacttagaaaaaaaaaaaaa

SEQ ID NO: 19770 - DNA, 1842 bp, Homo sapiens; identical to SEQ ID NO: 6280
  misc_feature (1)...(1842): n = A,T,C or G

SEQ ID NO: 19771 - DNA, 780 bp, Homo sapiens
ggactcattctcacagttccggtttgctgaggagaaagaatgggatagtggagcttcttgtccaaaacagaattcagcattttatgtggatagtgagttattggttcgagcccttcaagagttgcctctctgcctccgactcaacgttgctgccgaactggtccacatgcacctataaaagagggagataacatcttaccagatcaggacgtctcaggacctgaaatccaaggaagatggggaggtggtccaagaggaagaagtttgtgcaaaaccatctgtgactgaagaaaaaaacatggaacctgagcaaccaatgtacctcactaaatgttaccgaggaagagctgagagactggttcgacaacatgatttcctaaaaaggggaaaaaaagtgcctgatgcatatcttggttgcctttctaacggcaagagggcataaaagctgtcccttcagaccaaccagtttacaagcatgtcgtaagctagtgttgtccattatccccaacacaaaacaagcctacctctgcgtacgacatctaaaagaaaacaacgaagcagtcaagtagcttctgtcctcctgccttagaaatctaataaagttcattcagggcccgagaagaactttgaccattgtttaaaccctcctccccgaccacgaatccaacttaaccgggtttaacagaatgcaaatgtcatgcttgtcaaaaaaatagataccaaccagctaggtttgcgccaaaaaaaccatatcccgtccgctcccctcaatgagttgag

SEQ ID NO: 19772 - DNA, 748 bp, Homo sapiens
agagccaatgctacaaagacttagctgggaagcagggaaacatccacttgtcagcaccttgcatttattctgaagttatggaagcattgaaacttcaccccaggaatgtcttttcttaacctgggaagtggaaccggatatttaagtacaatggtgggcttaattttagtattttgacctcagagtcctcaactgaaatgatggatcttgaattatttcatcttcagaactttatgtattgcgaagtactttttgcctgtggctacgttctgtaagttagctttacacaaaatactaaaggcacagtgaatttcattcaaatgcagtgtggaactctcaggtttccttggtctgcctcagtcttctactcatcagcaccacactgtcaaaatgttggacattacaaggggcgaacatagacataaataaaaaatattggtattgcatagacacttgatgcctaaacctaataatcattaacttttatgtgcaagcttgggttcttgactaattggtaaatgataaatgaaccagattagatccaattattagaaaagcactcttaagagtgcaatgaatgtgatttgaaaacttgaaagcagcctagattttactatattaggtattgttatcaatgggggtttgtcaaccttaaaaattattttttatgtaaagatacctaggaatttctaataactgtatttgttttaataaactttgactttgctgtaaaaaaaaaaaaaaaaaa

SEQ ID NO: 19773 - DNA, 586 bp, Homo sapiens
acactttacatccggcacaggaagccttctgatggagcacacctggcccatgaaaagacaagggaaagaaacggggccaaaggtcacagtcctttcatcccatcatactgcttaaaatcatcctatttacatgggccctgaagccagggcttgttctttacacctaaaggccttggcgcccgggccttaattccgccctgttccttaccagctaagacatgttgggaaaatccctagagcccagaatcttattcctgctaagccagaaagcctaaaacacaccctaattatgtccctcttacttaagggaacattgccaacttaagacgcgttacaattattgaaccaaatggataactgcaatccaccatccaggtaaaaactggaagggaggcaacattccggtcctaaacatggttgcgaaaatccagaaaaaacggttattacagcctttccacactaacaagagccactataaaaatggaccctatcctctggacccacacgttaaaactaaccaactactcccctgaaatggacaccatgtcataaacgggcttaatcgagaatatacgctcagagaggg

SEQ ID NO: 19774 - DNA, 280 bp, Homo sapiens
ggggcttcctggcagacaggaccaaagggagaaaagggggagcttggccgaccaggaaggaaggtatggtctgcgctgttctgagcaggagcctgctactgccaggcattcagacttcttccgggggctgccaagcctggccaaattccacccctctcacttcccgccccaaccccagaccatctcactctgctacccatcagagaaacccttcatagctccaaccagtgacattgaatgactgtcactctctgtttgattaaatttgaataaatccaga

SEQ ID NO: 19775 - DNA, 792 bp, Homo sapiens
caccatgcaagaagtgcctttcacctcctgccgtgattctgaggcctccccagccatgtggaactaactaaacagaaacactgtagaagcaagaggttgaaaatatcatccattttgatgccaacaattgacaatcctagatagccaaagacagccttactaagcaatgtggctgcttttggagtcaaaggaagactcactttgctcaactgttggataaaaagataaagagaagaaaaggatcttcagagggttcatcagtaaacaacacaaagttcagtctgaccaggtgggaagaaactgatttgacatccttgggaatgagaacagcattaaaatggaaaatattaagtgctttttgcttattcaagacaactcaagagtcaaaaataaatggtaaagcagccgctcccctttagagagggttaatagatgatcctcgctcattgactccgctggccccggtcgtaccgctgcggataccggtttaagcttaactccaaggcggtatacagtaaaacaaatatacaggggaaaaagcaggaaaaacatgggagcttatggcctcccatagagcaacaccctcaaaaggccgttgtattagacttaatcataaggctccccgctcctgagaaacatgaaaaaataaacctctaagtcgaagggggcaacctcgaaattgattttaaaactccaaggctataccccaggaagtccactgagggcttcctgtaccagcccgccactaacggtaaccgacaacttgtccttacagaaagagcaattaatcaa

SEQ ID NO: 19776 - DNA, 686 bp, Homo sapiens
  misc_feature (1)...(686): n = A,T,C or G
catgctgcaaacgactctcttaattttcaccggattcttgaatttgattatgagatgaaacttgtgaatcatgtaactcagattgtggattctgaatcatggtcttttggtatgccttcaggaactcggaccattggagccagaggaaatgatagaacactgtcttaaatgttgtgggaagaaatatgtagatgagagttggatgctgataaaatatgtagagcagcagcacgaatgctacttcagaatgcggtgaaattcaatctcgctgagtttcaagaatcctgaaggaatggtaactagtcttgatcagctgaagggtttagcgctggtggatagacactcgagaccagaaatcatatttttgctgaagataatcaggaacgttttaatagccttttttctctaagggagaagtggacagaataaaattttggtccatatattcaagattngtgtggagagaagcactaaattttctggttctacgatgcaaaatggggttaaagtttataaatcaagaaaactcttttcttaaaaaaaaaccgttttttgctaaagaataaagtggcttaaaaaactagactttaattcgagattttaaaaaccctagttttaaggctttttctcctattttagcattggaaactttttttttttttaaatgtgtaggaagaactttaaat

SEQ ID NO: 19777 - DNA, 1594 bp, Homo sapiens
  misc_feature (1)...(1594): n = A,T,C or G
acatagcgcacacggagagagtacgggtggcggtagcgcgctgcgcggagcgggcagcgcgacgagacgacagagaacacagaggcacgagagcaaagagaagataagatgtaaacagcgcgcggcggaaccctgngngttnnggggnannnaactnnncgcgnccgcgccacgcgcgcnnccttcgcggnngnngggcgcgcganncaacccnggaggnannncannannacanagaagacaaaaagagaacgagagcgcagngagaggagcggcgnctctcccgcggcgcgccgcgcgcggccggcgacaacacgcgcgnggcggcgacggccacccnacacagnccggaacacanggacggcgaccgagccacacgacggcgcgcgcaacgcgaccagcggcggcgcgaanagaggagncgcgacgcagncgccagaaggaggccgnggcnnangaacgcacgccgccgcggcgccagcagcgcgcaccgcgacgaggcgccaaaccnagagcgagagcgccgcgaagagcacggcagaccacgcgagaggacgacgaacgagcgacgggaggacaagagaagaagagacanatcttttttttcttaagagagacagacacgaggaggaggcgaacgncaggcagcgaacgagaccaacggaggagcnnggcgaggaggagcgaggcgaacagaagcggnagcgcgcagagagaggagcagacggagaggcacgagaagcaagcagcaggcgacaanaccggcagggcgcgagcgcgnngggcgcgcgngncacgcgagaagcgcgncgggcggcgcgaccnacgcgaacgnagcgagcgacgcagagacggcagaaggcaggacggcgaagacgcgagacaggcgcngcacacgacagaacgcacacagcagccgagagcgcacggcgaggggaaacgcacgcagcgcggcgagaacagcaananaagaggggagagagngagngngaggaaggcgccaccgaagcccgagcacgcgncggggcgcgagcggagagcgacagatgcagcgnacgcgccggagcgcggcagccagcaacacgaaagaggcgagcgactcgcacaccacagcctacccagcaggccgcgcgagagggcgagacgaagagcgaggagcacagaagcgacgacacgccaagcgcaccaagcgagaggaggaggacgagacgcagcagcggcgcaggcgcagagcgaggcacatacacgagcggcgagacaacagcaggcgacgagcaggggaacaaggaggagaatacgcagaacgaggggtgaggcaagaagagagggagnacacaacacagagaccgaccggagcaactcacacagcaagagggagcggcgtggcgaggagagcacatgaggtgcagaggacacaccgagaagagccggccaggcagagagacgaacagacacacgaagtgagaagggcgcgacggaaggcnaccaccacaacaacacagacacgcgcacaccacagaggagacagacgaacgagaaacacaacacgagnaacacacaccagagcacnagagagagagcganagtcgcaaga

SEQ ID NO: 19778 - DNA, 1886 bp, Homo sapiens
  misc_feature (1)...(1886): n = A,T,C or G
ctagtggtgcacaaggcggagggtggtgnngcactacgtntttatggaagganagacanggnagagagcacgcnnncnnnggcaggtacctccctaccacgcacaacaaacgaaaagacccctcagagnatgggggggacacgcancacaaanaacacccccaanaaannnattttttnngnaagcnaggagagccnnngagagagggnaggggnagcgcgacncacgcncgaangnggcaggcccgggccgccggcggcgcnncggcgcgcgcgcgccgcacgccgagcggagngcaggaggaggngcgncgcgaagnggagaggacgaacagcaggcgcgcccaacgcgcgaagaaggagagaaacgaaanagaggacaaanngcgagagagagcgnggcacgcacagcacagccgccgcgccacgccgcggaaaagcacagagacacaccggcgcgcgccggccgcgggcgggccgccncccgccgaccacccgcaccaccgcgcaccaagccacggancccgaccaggcgcgagagacacgngcagcgaacgacacaacggagagccaggacgcgggggagcgaaccgcgcagaggaacaaggcaccgaagacaaccaccgaccaccgcagaccgagacgaccaaaaagacagccgcaccgaccacacaccaaggacgcgcgcccncgccgcagcggcgccgaagacgcgagcgagccacacgcacgagcaccagccagacacgcgccaaagcnacgaaaggagcacgccgcgcccgacgcgcgaaanagaccccgcagcgcgacgagcgcgaacaaagaggagggagacaagaaagagaagagaacgaagagcaacgagcgcggagacgaacgcgggacagaacgcacaagagcgcgcgccacaggacaggacaccacacgcacaggacacagcagcacaagcgcgcgagaacagccancacagnacgccaagagggcagcacgccaccgcgcggcgagccagaggaagacgcagaaacgagcagacagacagaaacccgacagacgccgcccgcaccgaagcgcgcacagccggcgaaaacaccgcgaccacacggaccacacgacacaccacacacgccgcgcacgcacacnacaaccgaaaacggacagcagcgagacagacgaccaagcaagacgggccgcgcggcgcggcgacgacgagccgcaacgaacacgcaacacacaacaacaccgcaacccaccacgcaagaaacagccnccaccgacacgacacaacgcgccacagaagcgccaccgcagaaagccgcaccacgacacaacgacaagcgctacaccacgaagagcgaagnacacgcncgacacacgccacacccgaccacatacacaaccgcgcattgagcnagaccccagacgcgcacgcacacacacagcgctgcgccgancgcgcgcatacgcgcgacgccaccacaagggtcgatcacgcgccaccagtagcgagaacgcgacgcgcggcacggatgacactgccagaccaccgcgcgcgcgacatcgcagcggcgcancgcgccgaagagcgaccacagtgtacgcgcacacacgcaccacacaccacantacgtgaggcgcgcacaggagcgcagcacacccgcggagtggacgagacgacancngtgcggcanacgaacgcgcgcaccncgagcagagcagagagnganactcgatgaggacgacaccacacacgcacaactagagcgcaaacaggaacgatcgcgnccaaagngngacacgcgacaacagacagagacgcgaccgcgcgcgcgcnccaccgagcgcgagcacatcnctngcaccaaacgtcngataccgcagtgaggacac

SEQ ID NO: 19779 - DNA, 201 bp, Homo sapiens
atgccgcagacgactctcttaattatccaccgagatgtgagaggtgaaataacttgcctgaggaaacacagctcaaactggaactgactcctaagtctatgattttaacctcttgtgaagatggttctatgaaaagtccgtaacaacatacaacccattaatttagtaccagatgtaaaatgtgatttaactgcacctgga

SEQ ID NO: 19780 - DNA, 1312 bp, Homo sapiens
  misc_feature (1)...(1312): n = A,T,C or G
gccccccctgcaccaaaaatacacaagcaccgtcacaagttcaacccacacatcacaaacaacgcaggagcttaaacggcggaccaggcccgacaatcgttatattcctgcaaaatacaggagcaaatgcgcaggcagtaaaactcgaaataactccacaactgccacaagagacaatgcagcggtcgaatatgtttctgggtataagttgacaagtgtctgttttgctgggctttacatgatatgaatgatatgagattatacacatgatgatggaactaaaatgtggcaatctaaaactttactacagcctcccagaaaacataaaatcctccaatatgctcacttcgattgttcgctcctaatagaatgtgaatcgtcctaccgntgtctgcattgaccgttgtacgtgtgagggacatacttcccatcgagttcatgcggctacatctgaacctccgcgtcgcacgctgcgatgccgtacctccgctcgtcaataacacgctgataccaaaataataatatcaacaatcgcgcgtatgccgacaccgcatactctcgactaatacattcgttacctgtactacccaagcaaatgcactacgatacgntgggtattattcataaacgtggctctgatgttgtaacctgccctactaacactcactcccttggcgttaacggcgcgctgatcacgtctcctagagtgcgtgtggtaggatgagtcagcgacttgtgcggctgcacttatcccgcctcancactccacactattatgtatcaatatcatataccgattggtaccacgctccgtgcacactctctatcccagcnacatatgcgtagncgcgcacgtgtttctcctctntcgtacgcgcacgtcncgcgntatctcngtatctngcgcacggacgccacacaatgtacgcactacgcgcgcgcgacacactgagctgtcagtgcgtcgtgtatgagagcggagcgtcgactacgcaagtggtcactacgctccatggagtaacacttcgccgctgaccactatctcacagtctacaccgcgtcgctggctcgtcgcgcgactgacacagctcgtagtagcgtcacattcgcagctacntgctcgcatgtcgacaagtgcgaatcatctcagatagtatatccagactatgtcagntcgtggtgctcgccatccacgctctntacacgtccacgtccaccgcgtcgntcgttgcgcgctagtcantgcgcaccatcgcacgcgtgagtccncatgcacctccacgctctganagtcgtcgatcactacatgtct

SEQ ID NO: 19781 - DNA, 1416 bp, Homo sapiens
  misc_feature (1)...(1416): n = A,T,C or G
gggggcccgtttggagcgcnggaggagataagagtctttaagncnaagggccgctgcncggtggnnannnannccnacattttttggggggggcgccnnncgcgcgcccgcgccgccccgccccgcggccggcgcgcgcggccggcgcgcgcgcggccgcnncngcggcggcggcccgcgcggccccgccccgggggcgcgcgcgccggcggggggccgnnggggcgcgggcgggcgagccggggggcgcgccccccgcggcgccgcccggccgccgcggggcggggggcccgcgggctcgcgcgggggggcgccgcgccgcggggcgcgcccggccgncggcgcggccgccgcagcggggcgccccgngccgcccccggccgcggcccgcgacacgggcggggcgccccaganaacaccgccgcgcaccccacgcggggcggcggnggagcacggcgccgcancgcccccgagccgcgcgcggcccggcgccccccggcgcccgccagcgccggcgggggcgcgcggcgcaggagaggccgcgcgcgcgggcgcgcggagagggagcaccgggggggcagggcgcccccccgccgccgcgggccgcacgacagcaccgcgcggcgccggcgccacggagcgcggggaagcgatccgggggggcgggcgccgcccgcgcgcgcgcggcggccggcgccaccgcggccgcccacacgaccgcggcggggcgccgcgtcgcgacgcgtcagacgaacgaaccgcgatagcgggggcggcggcgggacgggcgagcacgnacgacacaaaccacgaaggggaggacacggggaccgcgaggacgaagacgcggcgcgcgcgccccaccgagagaggcggggcgggcggggcgaaaccacagcggcgcgggacggcgccgtcagacagacgacaagtccgcgcggccggaaacgcanacgccacgcgcacagacggcaacacggcaacgaccacgcaccaccgccggccaccaagagcgcgacgacagcagccagcgcgtcggcgcacgataaggaaacacacgcgactaagcacgagagagaaagcgccgcggcaaccgcgcggcaccgcaccaaacgtacaaagacacagcacgcgccccgcggtgggcgccaccgaacagaacaaacgggaccggcgggaaaaacagcgcgccgggggaccagagcagaggcaccgacgaaccagaatcagggcgcaccccgcctcgctgtcgacatgccgccaccagaagggcgaacagggagagggcggacccaccaggacgcgcgaggcaagacggcagcacccgcgcgcnacgagccggagcaagccacgaccgcccnccgcacggagcgcggacgcgcgaggagaggaccgccacctaaacaattggaccgg

SEQ ID NO: 19782 - DNA, 995 bp, Homo sapiens
acgtggtggtaccggggtcggccgcggagagtgtcggcgcggggtgggtacctggctgacccgtcggcggggcggtatcctgggtgattgaaggattcttctgggccccggcggtttgcggtgttcctgacgtgcgaatgacggcgagatgcgataccggggtcgtaacattcgtagcacctcaaccatatcattggcggcggcgtcagtgttgattgccacttgagcactagccccgccaaaacgcccatgacaccggagcggaggaaatgaaacattgggcgagaagattttggtttgttgacggtcaaattgtcatattgtgtaaggtccattttctttcccgcgaaaggggtgggccgcatcgtcgacatccttgcttccccgctccatcgcacgtttgctatttcgtcctcctttacgcccctgatggcatcgtgttcccacctttgcatctgtgccatgtccgcactgagaccgcgagaacaccgtcgacggccccgcgcattgcggttcgacgcgtccataaaggttttgcattgttgtctgggctcccgttgtgctagcattcaacgtcagacattatcggattttatttggtgtcgagtgtatatcagcggcggtcagtctagttaagaatgtggcccaactacacgctacgtgtgattgcgtgcgcctgccaagcgacgtcgctcccgatttggtgagctacacacatcgtaatgcgtcctactttgccttgatgcctactctgctccatcaacattactttcacatgtggatccatccgtgtcgtcgccgtcctttgctcccacttcgtctgcccccgctctttcgtttctcaaccataacgcgagtgccctggagtgtttctgcctgctgcccagcctactgtggcccgggcacatttgtaggcgcagtgggttgacgacgttgggacgttgttacgacttaaggtttttcccccccaccttgcttcgtgttcttggagcacg

SEQ ID NO: 19783 - DNA, 1297 bp, Homo sapiens
  misc_feature (1)...(1297): n = A,T,C or G
gacagcgcgcggccggcacacggtgatgggcacgcgcgcagaacctacacatacccacatacgcggcacccacagtacacaactacggcgaaagagtagaaaggcgtcggagcgaacgtgatgaagctagtcggacgtaacgtacacgcgaatacatcacaccgcggtgacgcgaaagacatattcgtacaggtaagaagcatcgtaccggaanacatcgcctgatccgtcgccgccctcctcagcgacctgctcaacgncaaganacaaaagggcgctgcggaagcgaggattgtattgagttgtagtaacgtcaacatagtgcaacgatgatacacagagaggatggatcacgcggacgagtggtgtgttaagactatctangttgaagtatactagacagcgcggacatgatagcaaccgtactcatatatttgccaagctatcatagaacatcggattagcccgagcagttgagtgccacggcacatcgcgttgtggttcagctgcgcgcgcaccccaggtcctatgcgaatcggacatgacacagattgcaattgagcgagcaggatgtaccaccttgtgtgcctgacggtgtgcacactgtcatgttatgccacattcaccgatagtgctacccatgattccgcacgtcgccccacccgttcggcatgtacgcgcgcatcttgttaattgaatgatgcgtgtgcgtcggtagatacaacatactatacggagtattatcgaatctataattgcacaagtgcaatagtatctggtgagtttgacatcttagacatgcttattacgtctcatatttattctgtcatccatgtatttttccagtcnatccagcgcgactacgcntcgngtcantgccgtataccggtctgctgctcacctagcaaatttgtgaacagactctgctacattggtgatccaccgatgcctgccacctccacgtgcatgtaccccctgatgtcantgcaccctcgtgtgtnatcgcgcgcagccgagtgtcacgccaccgagccatgtgcgcccaccacactgtatcgacgngtacgtatgtgcagaccacgagtatcgtggtacgatgcacacagtggatgagacatagccaccgtcangagccgcgtcccgcaccttacttcgtggtgcccatggttactatacaacttgcgcacctctcatttagttgtgtcaagctgtagtgcgccataataatcactctcatagatatatgtttgcgtaccctcccacttgttcgtttttgttcacctgttggtgatctggt

SEQ ID NO: 19784 - DNA, 979 bp, Homo sapiens
catgacagagacagttacgaaggtgtagtaaagatgcttggtcatgtaattctctgacctcttctctgagtagggatcagatacaaatcagaggcggtcgaaactgatatgaaatatataattaaatttgcgacatcccaagactattatatcatccacaggctgaaactgatacctacctcttatgattattgtatctaaattgcgcatatatatcgttccattataactgttgagttgtacagtggtcgaatgctccaaatgagtacgcgatactccgtggtcaccatctctgtccaggctccatggacatgtctgttaacaggctcgttatatctaggcaataacaaccgtatcaatacacgagaaagatttttgtggttcacggtttctttacagagagtgtacaataaccaataactaccgaggactagagtatggtcgtacttaaccgggaaacagtgttgaaatggcccctacacaaggctcctgtgatggtgcctgtgagagagacattaacacatcatgaatcccctagaccatttcccttgtgcatttgtatagacttctacaaggcactcctccaaacaagtagaccttatcggtttactccccgcattatccccaacagcattggtgagcatgtgtattagtctgtatacaagatgtaccgcaggttcgcacccagagccccatggtatggcgcatgtctgacatctaatataggctgcgccgagaagggcgtcaaatagttcaccctctgagcatttatgataatctctggacaaatgcaaggaaatgtgaaggatgataatccgcatatccttcactaatcccacaagagtcaatcaagtttcgagtataatctgcgaagatctctcagagtgctttaccgtggtttatcaatgaataaaatcatcaatctatgcactatatatgtaaattaatagttattcagttttaaaaaaaaaaaaaaaaa

SEQ ID NO: 19785 - DNA, 753 bp, Homo sapiens
aatgccagtgactacctccattgccatattaggggatgcactcacgcatctaccttgcgtgtccctcctaacattgggcgtgtgaaacgtgggtatcgcccgattgggtcaagagtggggagaaccggtgacctagtcgccgcaattgtcagttgaggtttaacgcgttcatgcgtcggtcctataaggctgtccgaggtgtctccattattttgaaataggcctgggagtgtttgtcttagtttcttttaggggcgttaaaacggcgatgttccgatctagtaatgggtgctttgcgggacttgacgatctccttgaaatgctttctagtgttccttttgattctattgggggctatatactgagatatgtctgggcagtttttggcctctagaggcatcgtgtgggtgcgttttattgattgccatacatgtccccaacattatgtgaaccgtcgtcaggtgatgccagatcttgcaggaggtaccgggaccatggctgacctttggctgttgttatataggtcgctataggtcgactaatgttcacttaggtgcattataaaatattttgaaaatgtaagaaaatgtaaggaaataatctgcaatatcccacaatccctcagagtcaatcagtgtgagtatttttgcgaagttctttctggtgcttttcgtggtttttctttgattttttctcatttatgcacttatatgggatttaaatggtattcagttttaaaaaaaaaaaaaaaaa

SEQ ID NO: 19786 - DNA, 416 bp, Homo sapiens
tctcctgctccctccatggacctgcacagaattgtcccatgtttctgtttgtttgggcaccactgaggaaggaagcatgaaccattctattgccctcctgctgctgggtctttaatcctgagatggcttcaggggctggtccttctccatggccccctccatgcaaaccctggtcagaatgaaacattccttgggaactcgggccatgagaagcatccttcctgaccacctgactgcggaaacatcgggcgaaggcccaacagcctgactgcaggaacatccttgccatatcctgccgggcagcaagctctaccgcccagacccctccttccagcctgtgagcggcagttggtgatggcactaagctgatttcctcctctgcagggttttgctagtaataaaggtagatgcggccg

SEQ ID NO: 19787 - DNA, 1348 bp, Homo sapiens
  misc_feature (1)...(1348): n = A,T,C or G
accacacaccgaggccctcataaccagtaggacgtggggtgcgncacggagacgcgcgacagaacacgtgcgcgcgggagacattgagcaataggcgagccctgagcgaggagagcgaacaacgagcgggcggcgcgcgctttttagcgccgacgcnagagaccggggcgcgcagctgaccgcaggacgacacacgccctcgcgacaccagtgtccgcccatctgccacccactgatgcgcgactgacgtccttgaccacataacaattcaagcaggtgggacgtggcttctatgcgcgacggcaggcactatgtacgcgactacctcgcctaggcagccgacgctgtcgccgatggaccgcagccagtagcaaccacctcctcgcttcccttaacgggagcgacaggtccgacgacacacgacactgaaggacactggcgcaagcaaggctatgcgatctgagttacctgcgtgaccgtgggccgcgaacgtatgcgcgcaatgggcgaaccgtgtgacctcacgtgcggcgtcgcgcgagtgaatgcggcgccgagtctccacgcgcgacgtctgccggctaactttcgcgtgctgcggcatacgactatagtagacactgctccgcgggcgccaggaccgccggactcatccatgcgcttacgtcccgcggtgcaccagagtgccaacgagcggcgcgtcgacactatcgacgcgatgggcggtttcgcgcagtcgacacacgctccgtggctgtcggagtggaaccgcccacagttatacgggcgcgaggctgcgcctcacggtgggcgctatcgccgcagcatctataccattgggtcatgtggctgagcacatgtcgtcgcgcgngaccccgacgccttcgcctgcccgagccacactgtggttgggcgnagcgcntggcgttcgctgcgaccagcagccanacgtcggcactgtaattcgataagcacgacacacactagccgcgcgncgggcggcgacacacgtgacgaccgggtgcgtcgcggacgagccgccaccttgcgtgcgtgatactcaccacattgtgcccacgtcggccgcctcacctatcttggagacagccgcgtcgccgcgcggcgcggcgcctcaatctgcggacgtgtgggtacacgccgcgcgccgtcagcgctcgtgagagantngctcactgcgagnacgttgatagtcagcggtgactcgctgatgagctncactcctcactaccctcactcgctgcgcctagcgcgcgcgaggagcgtgcggtgggngtcnctcgaccgcgcgccgcacgcgccgccgcatcgcggctgcggccgtcgcact

SEQ ID NO: 19788 - DNA, 1332 bp, Homo sapiens
  misc_feature (1)...(1332): n = A,T,C or G
gttctctcccccccctcggggccttcccgcaatgtctccnnnnanccaccacnaaaaaatccttggaggggggggcgggggnngagaaggggccnnnngnngggccacccnnggnnggggccgnnncccngncggcgaaaaggcnggccggcgcggcgcgaggcgcnggccggnngaggcggaccggcggggcccgccggcgccgcgggggtggcggggcggcggggaggtggggcgcagcagcgcacggcgcgcaacccgtggnagcgcggtcngcgcccgagaaactgggccgccgccgcgggcnctcgggcggcgggggcgggcccgcccggcgcctgcccttccctctgtctctctccccgcccacccccccgccgccaccccgccggacccccccggacggcgcgccgggggtgggaggggggcgggaaagaagcgaacccggccatagcccgcccgggaccgccccaagccccaagcccccgccccggcgcgaaccgcgtgacaaaacagcccccgccggcgagaccaacaccagcggacaagagcgggcgaggcccaccccacccacgagcgcgcgctcggcggggaatccccggccaccgagcaaccgcctcgcgcgccggcgcaggacgggacacggaacaacgcgcggggcagcgcgcggtcggcgccgataacgccgccgcggttacagcgccgacggcggaaccggcccaagcgggaggaaactccacgcgccgcgcggcgccgcgggaacccaccacgacggcagacacggagaaccagccgcgaaagcagacacgcgggcacacagccaccagaccgccggaccccgcgcagccgagagcggccagggcacggagcgcgcccccggccgccccggcgagcggagcaccgacccgaccgcacgcgcagccaaccgcgncccggcccgctcacgccggaacgccaacgccggcggccgccacgcgcgccccacgcgcgaccacgcacccggacgaccgcgaacaggccagagaaactggcgcgcgaagcaggaagcacccgacgagggcggctggccgcgcggtgcgaaccggaccggcggacccagcatgcaccgcgcggagctcggacgcgccgggagggaaacgggcaaaggggacgcccccacaaaggggcgcgcaccgcaccacggaaaccgcacgaaggaagaacacccgccgacaggagcgagccacaaacatcacccgccgcgctgaggcaganaagaggagagcgcacaaacagatatcggcacgcgagcgcgaagagagnatcacaacccgacaatacagatgagacact

SEQ ID NO: 19789 - DNA, 628 bp, Homo sapiens
  misc_feature (1)...(628): n = A,T,C or G
gatgctgcagacactctcttaattatcaccgctcagtggtgcagcaccctcaccatgtccacccccgcacgcctcttatcacgtacagcaatgaacacttcacgccgggaaaccgccgacgtagaccccaaaacaggaatcccacggcctccgcaccctccagatatatccccgtattacccactatcgcctggcaccatccgctaggatggttagtaccacagcaaggtcaaccagtgtacccaatcacgacaggaggattcagacacccctaccccacagctcatgtccaggttccctccccatatggtcccaccacatcatacgctacacacgacgggcattccgcatccggccatagtcacaccaacagtaaggatgtcggctcactccatagttcaaagcatcaggactccaaaaaggaagaagaaagaagagccccccataaagaaacctttaatgcattcatgttcaaaggtcgtagctgagtgcacgttgaaagaaagcgcggncttaaccaaatccttggcggaggnggattcactggccaaagaaaacaagcgaatactacgagtctttgcaactgtacccggttggtccggcgggataactttgaaaaaaaaaaaaa

SEQ ID NO: 19790 - DNA, 1127 bp, Homo sapiens
  misc_feature (1)...(1127): n = A,T,C or G
gcacgccccgcgaaccacacacacacacagacgaaacgcaccgtacncaacaccgacccacgcatccaacccgtcgcgcgcgagcgcttcgaagcangcaacagaaacgaggacgatttaagagcggagaaggaggagaggcgacaacaggacgacaaagagagcccaagcagcacgctcaatcaacacatacgtgtcataccgagccacgcgcctccgacccccaacgcgatcatccacagcgccaccacgcgcaccgaaggaaagtcatcaaatacgaactctaacaacactcccgacgagtagacgatcgcaccaaaggaaccgagcggaatccccgagacgcaaataacgaagttcaggatagcaggagatgtgcgacaggacacgtagagcactcccacgcaccgaccacgtgcgcttagtatggacgaaaggctcacgcagttacgacagcagcgacagccgcgcatacgggcggggaagtcgccgcgacacaatcacgttgcgcgtaactcccangttgagagntattataccggggcggaggcaagaggagacgaatagcaagatgaataaggagcacattgcgaactgtacagggcgcacacttgtacggtggcgatgttgccccaccantgactcatccccgaatgacaccgtcccacacacctagtgctatgccggcgaacgcgcaactagggggcatatcacaaccaccaactatgcaaccatcacacgcacatgagagccttagaccacgctctcaacccctctgatgacgagnaccgacgcgggtagagcgacggcgcanataatagaccctagccaantgaggantgcgtagtctacgngatgggtggttagcatgagtgtggtcacatgcgcgtctacgacgcacagagcatttacgcgatacacacacatgcgcgcggacgcgcgtagcgaggcgctgactagatgggactgcacagacgagacacagacgaggcagacgagcagatagtgaataaggtcgagagtgcgacgcgtcccaccaccaacccactcgcggacncaacgcagatagaggcgaacggatacagcacaacgtgtaccacgcagataacgagatgagaatcgcggat

SEQ ID NO: 19791 - DNA, 2158 bp, Homo sapiens
  misc_feature (1)...(2158): n = A,T,C or G
ggttcctctctgggcgcnccnntntgtaccttggatnnattagtttntnnnaacacncnncccnaaccnncgccttnncctcgcgtngnngggnnggggcgggnnggggcnggngnggcgcgngggnngngnnnnnnnnnnnnnnngnnnnngcncnnnnnnnngnnggnngnngggcgnnngnnngnnnngngcggnnnnggngnnnggcgnnggggncgnngcnnnngnnngggnnnngggggggnnggggngngcgcnngggnggnnggngcgacgcgnggggcgcgccgccgggggggcgcgcgcgcgcgcggcgcggncgccngcgggcggcgccgccgcggcgccggggngcgcgcgacggcgcgcgccncagcggcgcgccgccgccgccgcgccgcgggncnggncgcggcgcgcgccgcngcgcgcgccngcccncccnncccgccgggcgngcccgcgcgcccncncgccgcccggcgcngcgngcnctcggcaccgnggccnnntgcgcggcgtcgtgcgtgcntcgncngtcgcggggngccaacgtatatgtttcgccctccgttgtcgcctcgtctgcccgcggcttctgntggtgtccttcggtatcgtgccgctgttggttgtgttgtgtttgttcgtgcgtgggggctggtcggtgcgtgcgtcgggttctacgtctntgcgttatcgtgccgcgcgcgcgctacacacatgagtgccggccgcttttgcgcgcgctctgtgttgtcctttcntgtgntcgttntgctgctgctcngcccgtctcgcgtcctnctncgctgtctcgtcgcggtcgcgcggtcgggcgcgcgtcgtcgctctgtaccagatcgtcgccgccccgcnttcgtcntggcaaatancgcgcggccgcgtgcggtcgctcgcgtgctntgtcacgtgttccccactggtcgtgttcctctctccncgctcccgcgncntcgtctctctgccntctncgccgcgtcntcctgctgccncgtgcgctctncgactgcgtccacgntcgcgtgcttcttcatcttgcgtncttctgcgctgcantctgcgggctcgcctcggttgtgtgtttgtctggccgcggtgcgntgctgggcgcggtgtacgcgcgcgtcgcagacgcgccgngtcgcgcggccgcgntgtctgctggctgcgcgttntgcgtgcgtcgggcgctcacgtgtntccgcntctgccgcgccgtcgttcgcgcggcgcgtcgttgtatctcgccgtgcctccngagttcggctgcgcggaggtccgcgctgtctctatcgcatcacntaangcaaagagcggcntggcgtcggcgctcgcggntctgctacggtctggaagacatggtgctggcggcgggctgggcgggtgtcgacgcgcgtgcgcngactctccgctcgnttgcgtcgagcgcntgccgagntcgctgcctagacntgacgtcgtcgacgntcctcgccgttcgttgcgctggctgntcagcnatgtccctctgacgctcacgtccgcctnattccacgcctcgctcctcggtcgtcgtccncgccgtgcgcncagcgcgcgcgcgtcgccgtcttgtgttcgtgcgctgggncgnctgacngagagatangcgnctacacagtgncnctcgtgtaatgcctcaccgacatgctgatgttatatantcaatacctctagctacttatcttgagcgacgtcactcatgagtnatntcacgtcacatgtattctcaatctcagcttncncnctggctgtcgtcggngcagtcgtagtgtgcatcgtcgtgagaatgctgctgggnntncncgtcgctcgctcacntggcatntagtgtgcgctcgcccgtcgccgcgtgacgtgtgttgtcncgcntcgtagtctaggtagtctgagtcgctcctcaacactatacagcgtcgctgtagaggnatgtagctggtcgatagcccgcgccagtccangctnacngtgtggatgcgacngctgatgtcacggatgatgatcgacttcgcaacgcnnnttagtgcagagtagacncgangacgcacgcncacgcttcgnaagtcatanatccgcacggtcgnngntgcntntcacgtgtngtncgtngcag

SEQ ID NO: 19792 - DNA, 289 bp, Homo sapiens
gttgtatgaggcgcctggaagaattgcttcgacaaatgtgtcaagcagcaaaagccattggaaacactgagctggaaaataaccaaaatcaagagagatattgtgtttgctgccagcctctacttgtagagtcagctaaaggaatgtgagattttaaattattgagttgactacaaatgcctgcaagtgtggatttggttctcccatacattttaatatgtattatatgtaaatcaaacatcattcatagaattatacataagcattacatttttttaataaaagtaga

SEQ ID NO: 19793 - DNA, 107 bp, Homo sapiens
gcctgagccaaagacattccaagaaaagaaaactacagtccattattcctcctaaacatagatgcaaaacttctaaataaaattttggtaaatcaaaaaaaaaaaaa

SEQ ID NO: 19794 - DNA, 311 bp, Homo sapiens
atgctgaacgacttttaattttcaccgttattcccagttcacagatggggaggtaaaaacccagagcttaatagcatgtccaagatcacataactattccactgctcagatgaggacaccaggacatgccaccggaccactgaaggaatggtgatggtatgaagaaagtatttttaatgagcagagccatgtcctcacccctcaagagaatttcccttattattatgaaaactttttatcttaaaagatattacatgttaatggaactgtcgtttagtaccaatcaagcacattgtcgaaataaaagttga

SEQ ID NO: 19795 - DNA, 2077 bp, Homo sapiens
  misc_feature (1)...(2077): n = A,T,C or G
agccgagcatgaagcgagaaggtanacggagnagcancgcagagacagcgaggnacgaggagnagcaacatgcgagccgtcagctgnctgagtcagaagacactgagacgaaggagcacgcaacnaacgcgacgaacgcacgaacagcagagacaganccttcganagagnnagagcangcngaacccnnagnaggaangnagnagagagagaaggncnctcnacagganagagagagacgacgacagcaacacnacaaacnacngacgacnacacacgagcagacgcggangcaganagacngagagacgacnacananagacacacagcgcagcatcgacacgacgcaagccancanaccacgacacggcagagcacangcnagcaccagagacacggacgcgcagcagcagacgangcganagaagcacgcacaganagngcgagccggcaggcacgcacgaaggagagacgcgggaccacgcgcngacgagagagnagacaagacgagacacggcgcgagcagcgagcgcnacgcagacgcgacgacaacacggacgcgccgacagccgcgcgagcgacacgagcacaagacggaggaacgcaagacgcgngagacgccgcgccagcaggagagacgacaacagacgcgcgcgcgcacacccgcacccgnccgcacagcaagccgacgggcacananacgcacagaggacagaacnacgcagacgagcgcgcagagnancaacgcaganagccagagcacgagagagacaggancagcacacagngcagcaggacggacgacgacggcgccggacagncgcacgcganacacgcgagngcgagacnganaacagngaacgcggagcnangagnagaccgaggcagnanncgcgcganaacgagcacgcgcagacagaaganagnagacngaganaagagagagcgancgnnagnancncagagcaaggcgtcgacagcagagncgagcgagacgagcagagcacacccgcgcgacagacggcacgctcgacgaccgcgcgancnacgcactacgagagncatacnangangtagacagcagctcgcgagcacgacagcatacacacggcgagagngcncaggagacgagagcacnacacagcacaccgagtcgcacagngcacagcntacgagacngagacgaacgagacggcggagaanctacgcacgcanacangancaccagcgagaggacgaggagngacgcagagagcagacagtcagaggngcgcagcnngcgcgagncagcaggagacgcagaccncagcgaagnacgcagcgatgacancggacgagcagtagaagntactgcagangatgagagnacnagcagagcaagcagcagagcacgtacaacgacacgaacgatctgcggatagtacngacgaggancaggagagcagtcananntcggngcgcgcaggcacgnagcagagccgacagccgaacngcgacgagacagcggcgncgancnacnagaccacaangangacgaacgacgacgagcgacgaggaaaggangcccanacgacgacgacacgagcagcaaggcttgacgcgcagcagcaaganganagcgaangcgtacnnacgacgagcagcgngancgacgcatcagcacgccggacgagcagcgcantcgcncggcaccngacangcaatacnagcntagncagcgacgcgatgcatncgcngacgcgnacagcgcntacggcgacgcagcatgaaagagacgacgcagacgagcctnacacgctcagcagaaaaagcaaccagcgtccgtggnacangcngnaggtacgcacanancagagnacagcagcggtcagtgcacgtacgactatncgacgagacgtcaggagcaanancaacncacnaccgacacgcnaccagcagagagtcgagantacgacgtacgatgcgagnatgtacgagagnantgncgcagtccgacacactagcancgnnagcaggcagancangcagacgagcaagcagcagcgagacgacgagacgagggnacgcgagcgacat

SEQ ID NO: 19796 - DNA, 1812 bp, Homo sapiens
  misc_feature (1)...(1812): n = A,T,C or G
caggggaagtgtggnntttngccttagggaggggccnaagaaaggacgaaataaaaaggtaattataagaaacaaccccaccncgngcttgcaggtnnnngnnnnnaaanacaaccnaacaaatttttggggggggnngggngcggcgcccgagngggcccccccgccccgcnccgcgcgccccgccgcgccgcccggaccnaccgcacacccgccggggcgggggggcgccgcggccgcgggggggcggcgcggccgagcgcgcgcggcgcgggggcgcgcgcgcgcgccgggggngggccggccggccgcncggcccngcggggcccggcggcggcgccggggcgccccgcccccgcgcgccgcgcgccgcgccccggcgcgcgccacgcgcggccccgcgggcgcgcgccgaccccggcccgcgncgccacgccgcgccncacccagcgcagcancccgccagcagcgcccccccccacccccgccgcgcgcccccacacccccgacccagcggngcgcgcggnacagggccggcgggccggggccccggccgggcggcggngggacgcacggacgcccacgcagcgcccgcccgccgccgcacagccacgccgcggcacgagcggcggccgaaggcccgcccgccgcggccggagagaggggaggaggcggcagggccgnccgcgcgggcggncggggccacggcgagccgaagcggnggggagggcgccgagagcgacgcacggcccggagcgggcggcggacggcgaccgcggccaggcggcggcgcccgcgcggcnccgngcgcgccacgcgccgcgcggacacgagggccggcagcaggcggcgcnccgcagcgcggcgcgcgcgcgcaccgcccgcgcgcgcgcaccgcggggacaccgggggacgaacgcgcacaaaccgccccgcgccgcgcccgcgcgacgccggggcacggcagcgcggggcggcgccgacggacgcgccnccacacncggcgccgacagccgncgcgcgccgccaccaccacgcggcacacagccgacgcgccgcgaggaagcgacgaggacgggccggagcggacgcnaccgaaagagcggcgagaggaacggcggccgcgagcccngagaacggnacacgcccgnccgcgaacgcgcacgcgagngcgacaggccagacgccacgacagcgcagncgcgnnccncnacaagcncccgcgcgnaccgncgcgcagcgcacaacacgcacgagacagcgcgcncgcgcaggcgcgcggnccagcacngaggncaccggnccgcncgcgcngcgaccgagngacgacgaggagcgcgccacgcacagaagcgagacacacagacgcgcgagaganacgcaagagagcggcgcgcggcggacgccggagannagacgcgcgacgaacgcagcgagacacaacgaaccgacagcgacgacgnnanagcgacagccgcgcagcagacggcgcgcgccacgcgacacacnanacgcgacgcacgagcgacgannacgacacacgncgcgncacgcaacgaagaacggnaagcagccgcacgcagcgcgcncgacacgcacgacggcgccacccgcacacaccacggcaagaggacgcgcanaacagnagcagaggagcgcacgcgccggagaaacgcgcgacagggcagcggnacagcgccccgccgcacacngaacggcacgcgnaacagcgcggcgcacaccnacccacnanaagacgcaccaccccacaacgcgaagcacacaaaacacacacacacnacaagaaccaca

SEQ ID NO: 19797 - DNA, 306 bp, Homo sapiens
gggactatggccctcctgagtggagtgttaacactaaagcttccagaaacccttgggaaacggctagcaactacttgggagagtcagagaatgaaagcaagtcaagcaaattacttctcacaactaataatagtgggctggaaaaaacggaagcgattaccttggtgaataaatgtgccatgcctgctgtctagcacctgaaatattatttaccctaatgcctttgtattagaggaatcttattctttgtatgtctttttaataaattttgtaagaaaattttaaagcaaatatgttataaaagaa

SEQ ID NO: 19798 - DNA, 1566 bp, Homo sapiens
  misc_feature (1)...(1566): n = A,T,C or G
ggggggataatagtgttatgggggctnttgggnagggnagnntaataagatgttttttttaagaaanaaaaaagacnccnccttcgacagatnggcaacaaaangaaagccccacaaaacttttaatgggagngngcgccnngccggcggngngccgcgccccgccngcgcgngngcggcggccggngccgcgcacccaccgcggcgcggccggcggggcggcgacccgcgcggccccgccgcgnnnnnngnccgccggcgcgcggcgcggcgnnccgccccgcgagnccagccccccgcgcgcccaccnccggaacaacaggcnggcggccccgcgnncncgggcgggcgggggcgggggcgggnccccgagggccacgaggcgcgcggaagagcgggcacgcgggcgcgccggcgcgggcgcggcgccgccccaccccccgcgcggcgcacgcccgcgcgcgggcggcggacgcccggnggagggggcgcggcgggccgggccggggcggggcgagggcgccggnggcgcngcgcgcggcgggnacncgaacgacgcgacaggcgagaacgccgcgagggacacaggaaccgcaggccgcgcnagngcgaccgccgacgcggcggcagacgcgcgacgcgcgaccgccgcgcgccagaccacgcgccgcgacgagcgcgggcgncgggcagcgagcggcgcgcgccgccggcgcgcagagagcgggcgcgcggcaggccggcgagcgcggcgaggcggcgtggcccacacggaaacgacggaaacccncgcaccgcaacgcgggcgacacgggccacacaggagnaacccacacgcgagcgggcgcgcggacaagaggcacacggggcgcacggcaggcaggaaaaggaccgcgaaagggcggcggccggcgggcacgagagacgaacaacggggccgcgggngcgcgagaaggcggaacgccgcggggacgagcagggcgagacgccagcgcgacgaggagaccacgcaaggcgaacgccgagaacgaacgcacgacaaggaggcgagccggcgggcggcaccgcaaccccgccgacgagacgcatgaggccagcccccacgggcccccccaagagcacaaaccgaggcagaaaagcgggnaagcgacggcccgagagacaaggacgagggagaggcgggaacgagccgcacaggcgcagaaggccgcacgaacgacaacccgaacccacatgcgacgcgacgnccacaccatcggcgacccgcctcacacaccaacgcgacgagatcaacacacacccagagccacaccagcggacacaacgcggcgcgcagaaaccgaagcggggcggcgaacacggcgcgaaggagaggaagccgccgcaggaggaccccccacgaccgcgaaggggcgcacgccgcgggggaccacgaaaacgggagaagcgcccacgacgagacggagacgatagaggccctccccgccacgacacgagagaacagggagaaaaaacacaaggaacggcgagcagctagaagaacccacanacacgcgcacaagacgg

SEQ ID NO: 19799 - DNA, 1911 bp, Homo sapiens
  misc_feature (1)...(1911): n = A,T,C or G
atccgctgaaggagaggagcagaagaacgacgtcaggcacagcgacgcacgcaagcaccacgcggtagacacagcagagacgacagnacagacaacaacaccacagccgagccagagagttcttttgagacgaggacggacaagcggccgaagagacgcacagccagacagcttcacgcagagcacgcgacacgcagagacagagggcagagcacgcaccaacagcagcgaggacngcacacgcaacgacagggacggagagnacgagacagcacagcacacacacaacagcacgaccagagccacgacgcagacgcaccgagcggacagccgcggncganacaccgcancancagccacacanaacacaacacaccgngcaggagannaacagcgagcgagacgcaanacgacaacangacgcgacgagcgcacngccgaagagagggcgcacagcgggcncccanagcagcgcacagcacagaccaccnacacagcaganagancgnagagcagccagcgagnagcgcncgagacggncgcgnannagagcgnnagcggcagagccngcagcgagacacgagcgcggcgnagncagcngcagcgcancgcgncgagcacagagcgcncgcgacnanangacncggagcggacgcaacggcgagagcagcgcgcaccnacgagcaaggacaggcgcgctgcagcncgagagcgatgacnagngnagcagcaagacgcncgcatcacgcagcggcgactagcgnnaaagcgacacaacgccagcgcagagtagacagacagagacgcacgcaacagggcgacgacagcgacgcagcgcgagacncgacggcagcgtccaggagcaccactcgtagcgcgcagcgcaataganccgccacgcagngacgcacagagaccgagcgncggcgaggntancgagcnacgcacgctcgcacagcacgggtatagncggacaagtgagtgagacaggcacagngcgctgtccgagcgcgtgcagcgggaccacagccgacagcancagcacaaaggcgcagcgcaaacgccgagagcccgcgagcggagaacagagtgacnccaacancacnacagcgcgcaacaacgcaccagacacacgagcaggacagagacagagagcacacacacagcagacgcaacacagaacaacagaaggcgcggcgccacgcccgcaccgacacacagcatagcgcgagagggagccgctcgccgaagagcgagggcgccagcganacgacaacgcgccacancaaagcggacacgcgagncacgcagtccagacggcgcaggaacgcacagcgcnacaaacanacaccnatgcacccacagagtcgagagtacagcggcgacgagacgcgcgagcgaacgcaggcgcgcgcacgccgcgcacatcagacgcgcggagcagacgcgaacgcacacagcagcgagcatgtgcacgcaagcgcanacgcctacncggacnacaaggagcgcacgcgacgcgaggcagcagatccacgagagcagncnagctaggcacagcgcgcgtgtgagctcnacgccgtagcgcacagncncncgacgacgtccgcagtgcagangcgacagctgggagcagacgcgcgnanacactgncagacagagcagagcagcgcacagcgnagaganctgagatgtaccgcagcagtccgacggcgtagcagacancagtgtgtacgacantgcgagcagaacacgcgagcacgagacgncatgacacacatcacncacnacacacgacncatgacancgagantccgagagtagagcatcacagtcgntggaggtctcanctcangagncgcggcgcgacagccgcggcgctactgaagagcgcgcagagatcgtagcgct

SEQ ID NO: 19800 - DNA, 411 bp, Homo sapiens
  misc_feature (1)...(411): n = A,T,C or G
tctggaaacactaggcgnacctggtttggggttttggcttttctttgcttctcattcctgtgtcttcgtcttgttcgctggggtgccgcggtggccgggcgcgtttacggctcctggtgtgggcctgcccccctttcgccccggggggggggggggggtggggcgttctggcgtgcccccctgtgtccgcccgtcgccgcggtcgggctgcccgggggttttctttgggtggcgtcgtgggggggggtgtctcctcgcgcgctgctggctggggcggcctgtggttgcttgtggggtgctgcggtctcccctgccttccctgcccggccggtcggctgccgctggggcctggtgctggggtctgggcggtgggcggcttcttctctgggggggccgtgccctgtttttatg

SEQ ID NO: 19801 - DNA, 678 bp, Homo sapiens
  misc_feature (1)...(678): n = A,T,C or G
tccacttggggtcactgttccatatacaataagaacccacctttaggattttcttttagaaaattgtatatgcagctggatgtaatgccaacccagatgagggagtgaactactttatgtccaagggtatcctggatgattcgccaaaggaaatagcaaagttcactaaattggaaaaaactgagaatctatcttgatgaaaggagagatgtcttggatgaccttgtaacattgcataattttagaacactgagagaattttttcgtcatatccatgcccctgaagagcgtggagagtatcttgaaactcttataacaaagttctcacatagattctgaatgcgagaacttggccttagtcctgatgctgtctatgtactgggctactctttgattctactttccattgacctcactagccctcatgtgaagatttattcgaaatacccggcgcgctgctaaaaatattagtgaaaatttntgtagggcatctttatgacaatatctacctttattggccatgtgggctgataaaaaagcacactttagaccaaaagctaccccaaggacttaacagaatatggggggttacattaagggcctggggcatttggagccctgaatatacaattacagccttcagggtgcaaaccttttttttttgtaggcattttctgg

SEQ ID NO: 19802 - DNA, 1154 bp, Homo sapiens
  misc_feature (1)...(1154): n = A,T,C or G
cgcccgcggggcagaagcggaccggagccgcgcgggccaccgcgacgccagcgcgacacggacgccccgggccgccgcacggtggcgcagagcgcttagagggggagagcgcgaggcgagcagccccgtttcgcccgccgacggagaggacgcgagncccgacgccaccgccccacgcggccgcccgcggacaagaaccacaaaggggcacagcgaggagacgaggagagcggacgaaagaagcggaaagcgggcgacggagacacgcccacaaacacgcggcaacaaaacaagcacggccacacgcacagccatacaagccacacgacagcgccccgcaaaaggatagcgcaacacggagggagagagacgaagagcgccacggcgtaaataaacgagaagaggcagagagaacaccgcgcgcgcgacaccagccgagaccccaagcgcgcacccgagagagaaagcgagcgcgaccaaacgaccaccgaaaaaaagacacagaccgaacgaccagccaacaaacacacggaccccgcgaaaaagagagacgagcagagcggcatgagccacaacgacccgcccggcggcgcaggccgccaacaccgacaaatagaccgcgggggacacagagcccaaccgaggcgagcacgcccaccacgggggcgggaggacgccatccacgaacaccacaacacaggggtacaagcgcacacacgcccaaagacagaggcgggagccgcacgctacacgagccgcggtcaccgcgcccccacaacggccgccggaagtagcagccgggaggcgccggagcaccaagcgcggacaccgggcggcgccggcgatcggcaccgcacgcagcaacgcgccacaaaccgacaccacgcccacaggggagccgggcgaacatggcagagacggagctgcgcagaaacgccaccaagagagaaccgcaacggagccacacggcacacacacagcgagtggagcgcgagagggggaaccacgggggggtggcngaggggaacgggcggacacggagcgaagagcgcacaacaaagcaccagggcgccagccaccccacccggcagctcacggagaggaggggaggggtgccacacagggcgccccaccgcacaggggcggaccagaac

SEQ ID NO: 19803 - DNA, 1411 bp, Homo sapiens
  misc_feature (1)...(1411): n = A,T,C or G
ttgttagggggggaggagactagagtctttaagcaagggccctgcagtgggnancancccaaaacttttggggnnnnnncnnnnncccccccgccgcgcgcgcgggccccagggggggggggggcncnnncnngaagccgccccgcccncgccccggccacngcgcccggggcgcgccagcacacgacacaagagggcgggaggncccccggggccgcacgccgggggggaggcgggcgagcgggagggggggggccccggggccgccggcgcgngccgccgcgccgcgcccgcgccggacggggcgccggggcggcggggggggcggcgcgggggaggcggagaggcaccgcgccgagcagggacgggcggcggccgacccgcgagggccgcgggggccgggccggaggccgaagcgcgggcgccgcgggagaggggagggggggcggggccgggccgcaaggaaagcggcggagggcggggagaaagcgggccccgcgagggggaggggcgcggcgcggggccggcggggccagagggtaggcggcgaacgagcgaccgcgaggggggagagcaggagcggcgcgcaagaggcaaaaaagagcagcgcggcgccaccgggggcggcgacgcgcaacgcgcgccacgggccacgaggcgccagagcaggtgcgccccccgcccgggacggcggcgcagagggcagaccccgccgcgtgggcaccgcgcggggagcgagcggcgaggcgcaccacgaacccgagacggcgagcggcacggaggcaggggagcacgccggcggagcacagcacgcgcccaccagagggggagcagggacaagtgcgccgccagcacgagccgagcgtcatgacgagacaacgagggcagagcacatacgcgacgccggacngacgaggcgcgagcagcgggcgcgccgcacgctcgggcgagacacgcgaagcagagacacgccgagacgcgcgcccgatggcgcgcacgccgancagcncgccgacacaccacagtgaccatgcccagcgccgncaacacgnacacgaccacggacgcgcgaacgagacacgcgagcgacgcgccgcagggcgagcacaggaggcctcaaaggagcgccgcagcaggagcagcaacgagccaaggancacaggtggccgcgcgcancgcgaggataggccgcgcaccgaacgctgcgaccgcggagcacacgcgcgagatggcggtaggtgcgagcgagtgccagagaggagcgcggcgcgaggaaggatcgtgcagactcgcgccgcaagngacnactcgtcgcacacgcgacgtnccacacgcagacggcgagtcgactcaacggcgcncagggcgtgacgagacnccgacgcatgacagnagacacaccgacgtagcg

SEQ ID NO: 19804 - DNA, 406 bp, Homo sapiens
ctcatagaacggaagaccagctccttggatccgggcgagggggtggccatgggaaggcagtggcttgcaatccagaagttacaaagtagataggaaagccagcaaaggcaggaaacttcggtttcatgtccttagcaagctactgagtttcatggcacctattgaatgatgccaggacagaactgtaccgctctctttttggccagctccaccctcccgacgaaggccacggggattgacatcgcccacctcttggctggtgtggctgctggtccagatggaggaaaccagtgactttatggggctgagctagtagggaagcccctggaaagatgctgcgttacgcaaagggcgctgtcccgcccaaccccgcctttaaacgccacaaaaaaagaacgatgcgggg

SEQ ID NO: 19805 - DNA, 702 bp, Homo sapiens
gagctaataacgctggaaatccatgcagtcggcaaaaccatcacagcgctggtgggctgggatacagctgttggaggaggcacacaccagagctccattagaacagcttttgttggctgcaaaaaaaaaagaataatgatcagggatgccagcatgatttttttttgtcccaatgaattgtcacaacaaaataacataaaacagtgtgattatattactcttgattttttctagtctgatattttagaacacaggtctttttgaacaatattgcagatggattaacttacgagggtctgaaagaaaaaccacattcgcctgataaatcacttcccagatgggcattgttatggactgaattgtgagctcacctgccgattaatattttcaaaccctaaccggcatcgggactgtttctacacattggactttgatgaaggtgtgctggggctccctaatatatagacgtgacgtatgtcattgtcttgctctactgccccctccatacccgctccctaggttttttgtttctcctcttgatagaggcttttccacacgccacacctgcctgcggaggagggcttattggtgatcccaaccaatcgtagcacagtagttcctatgtcctatcgtaatacgaactacacattctgccaggagtagtctatgtccccattttgccgcgcccctgttgagtacatt

SEQ ID NO: 19806 - DNA, 650 bp, Homo sapiens
  misc_feature (1)...(650): n = A,T,C or G
tttgaaacctgtcaggctcctgagctcaagctaagccatcatatcccgtgacatgcacatacacatcagatggcctgaagcagaagtgaaaatagccttaactgatgacattctaccattgtgatttgtttctgccccaccctaactgatcaatgtattttgaagaaggttctttttaatctcccccacgcttaagaaggttctttgtaattctcctcacccttgagaatgtactttgtgagatcccctgctcctaactctaccgcctatcccaaaacctgtaagaactaatgataatcccaccaccatttgctgattctcttttcaaactcagactgaacagccatgttgctcaaaaaaannnaaaaaaaaagaagaaaaaaaagaaaaaggggaaaaaaaaaaaagnaaaaanggggcgaggcggccgctttccttacctcgctaactgactccttgcgctcggncgttcggttggggaaagcggtatagctcactaaagggggtatacgggtttccccaaaataggggatacccagccacaaaaggccagaaccttaaaaggcccgttttgttggtttttcatagggtcccccccctgaaagcataaaaaatttaccctaaagtaaagggggaaaacccaccagcct

SEQ ID NO: 19807 - DNA, 1160 bp, Homo sapiens
  misc_feature (1)...(1160): n = A,T,C or G
gaccgacgcgaacccggacggcgggcgaacgccggccgcggccgagggccggcgagaaaagtaagagagggggcgactggnttgggaaacccagcgaaaaaggcttnagggggancnaaacanananccanannnnacacaaaaaaaaaacaaaacaccnttttaaaccccaaccccccccaccaccaaccannaccccaaaaccaaacaccccaaaccaacccacaccccaccccacccacccaccacaacaccacgaaccaacccgacacaaccgaaggaacagcgcaacagagcacgagacgaaaacaggaccacacgaagggcgagcaagaaggaaagaaggaggaacaagaaaaaagggagagaagagagaagcagagattttttttagcaaacagacaaggagaacaccagcgacaaacagcaccggcgccgcgcgcgcgcagcagacacaacccgcacagccgggaccacaggcggagcnccgaaaccgagagcgcaaaacgaagcaggcgcgcgagaggggagcactggaaaggaacgcagaagcaagcgcagagaagagcagcacgaaagagcgagcggcgcggcaggggcgagcacagccccggcagagcagaacgagaggagggacacaagggaacaagccccggcggaacacaccaaaacggggggagagggggcacgacacagccgagcacccccaggaagacaccagggggcagcccacgcgccagccaagcgcgagaggagagccgaacacgaggcgacagaaggagagaacgccacacggagacgaagacacacacagggaggagcacgagacgacagagcagacaaagaggagaccgcgaggagccacaaccgagggggaacagagaagagcacgaggccgcgccaccggggcgaaggaggcccggcacacaggaagaagggagagggcaaaagaagcgcaagaactaggacacgcgggaacacgcacagggagagagagaggagaggaatatcgagggaaagagcagcagaacacgaagaggagagaaccgaaacgaaaccgagccaaggaagagggaagaagacaccagccacagaaaacacagacaaaaggaacgggaaaacaacaagcggagaagcaaacaaccgagacgaaaagaaaa

SEQ ID NO: 19808 - DNA, 1531 bp, Homo sapiens
  misc_feature (1)...(1531): n = A,T,C or G
ttttaatttgagaantangagagaaaaanaaaaaaggttntttataaacaaaaaagaacctgaagggctacttaaaaaaacccaaaaatttttaaaacaacccgcaagcacgagggagagccgcaagaagaancgcgggagggagnggaagcggagaccgggggaacgccagaggacgagaaaccggacagcgccagaacgccgacgccgcgcaggggcggggcggagagggagccaggcgaggagcaacggaggagcgcggggggggcgcagggaacaccgccgcgacgggaaccgancaccacacgcagcacccccgcgcggcgggacacagacccccccacccgcccacaccgaggccgccgccacccagcccccccacgcccgccgccccgcacacaagcagcgacgacccccccagaaaacaacacggcgccccaccgcgcggcgcgcccccgcccgcacacacgacgcacgaacagccccaagcaaagggggagaggcgcaagcgagaagaccagaacgggacgcgagcgccgcagacaggcaggcaccgcaagaagagagcggcgagcgagggcacacacaaggagcaaaggaagcagagacagacaccgcgcccgacggcacgtacaaaacccgaaacggggcgacgagcanagcacgacgcgcccccgcagaagacggagagacaggaggcaggaagagcacagagcacagacagaaatcccaacgaaatagcccgacaccgaggacgagacacgcagaacggaagggagggacacaacagccccacacgcgccacaccaccgcccaagccgcacgcgcccacaccgacacacaacagagggagacacagagacacaggcgcgagagaaaacgggcggcagcacgcgacgcgggagagagagccacaagacacccacaagaacacgagaacacagaacacgggggcgagcagcgcgagggagagaagaacaccagaacgaagagcgcgcccagaggcgacaaaagcgggaaggacgcgcgcggaagacgggcccgcggcggacacgcggggagcgcggccaccgccacgcccaacccgcggccggagccgcggcccacaacaacaagcgcgcacgcgaccggtaaggcgacgacaccaccgccacgagagcgacacggcgccccacgagccgcaagaaccgccgacgaagctgtcgcgacacaccagaaacagcacccgcactcgccaacccgccacgaaancaacgcgcaacgcgcggatccacccagcggccagggaggacaacgcggcagcgaacacggacgacgcggacgagagcaaccccacgacacgaatgcgggcagcgcaacccacggagcaacagccgggactagagaggaccaccacacgacggcccgcgcgcacaacggagagacaccgcgcacgacaccgncggcaggggaccgccatgaggaccctgcgaaagcgggagcccgcgcgacccaggagcatgccgcccnncgcacgcgggnaggagccgcg

SEQ ID NO: 19809 - DNA, 781 bp, Homo sapiens
gctgtgagtggtcagttatattagaggatctcgatgctaacaatcgcaacaggcaaactttgtgctcgctgttacccaaaaaatcaagatcacataatacagatgctgccctgctcccctgcatcagttatcctgcattcgccctggatgatgaagttctttttagccctacactcgataaagtggttagaaaattaaaaggaaaatatggatttaaacgtttcttgagagacgggtatagaacatcattggaagatcccaacagatgctactacaagccagctgaaattaagctatttagatggcattgaaatgtgaatttcccatatttttactttatatgaagacggatggaatttttagaggcaatcctatgcaagtccaggaatatcaagatcttttgactccagtacttcatcataccccaaaaggatatcctgttgaaccaaagtactattatgtgccagatgactttgtaaaaatgaaaaaaataaccctgggaaataaaaactaattactaaaaaactggggccgggatggaaaactggttcctttggggacaagaattatatatcaacacagaacatgctggatggtgaacttatgagcgcaaaaaatatttgacccctgtacaaagctaatggcccactcaaggatctacgaaaacaggagcgagaagtgttcccaatcaaggaaacatacgtgggattaaaaaaggtttactatcctatccacgtccctcagttgcaaggaaaaaatacattagaggacacacctaaga

SEQ ID NO: 19810 - DNA, 1262 bp, Homo sapiens
  misc_feature (1)...(1262): n = A,T,C or G
aacctctcacactcgcattaggattgcggttttgttttggtgggcggtgtgggcttgttaagatcgaatttgaggcggcagtgttggggagagtcnggaggagaggcggtggatgtggggagagaggcgaacatgaccaacaggtacaatacacagaagacagacaagaggatatgattactgaacgcgcgacaccgcttatttgtctcttctacgtgcgcagtacgcgtctccgtatatgcggtaatgacgaggcgacgtgcgaatgacgaggggtgacgcggtcaccaatcgtcagccaccgccaatgccaggggtacatataggtgcccgcgcatagcagtgtattgataaggccctatccatgggctccatatttcgttagatccacaccgaccacactgacaagcgattgcatgatttatatattattataattctgttgatacgtaatcttgttaaatacggttgctaaaaatttagtctatgtgtatggacagttcgacgcatagtagattgaaaccgcccacccctcttaggcgctccacatgtggaaaacgcagtgaatgagttattcgaaactgcccttcgttgcatgatgcgcggcgagggtccccatctattgatcatcgttgtgacccgttgttctgctgttgctctggtctgatatgtttgtatctgtagatctcgcacaatcggcccgccatattgcggttgccccgcaccaacatgtatatggattgatgctaggctcctccnagatgataatactgcacttggccttattttacgcatcatgtatctcttgtagcttgtcatcgcagcgcattcatgtgtatcatacaatccagtattccattcatcaaccgtagctagagaaaagagtcggtctatctcaatagccgcaggcatatgaaatcaancaggtgtactatgcattttagtactaactattaactttgtgtgataatatgtacaccacaactgtgtacccctcccaggtcgattcaccttattgtatcagcctccctggtcgcccccggttacttgctccctccacttaattcttttctagtctatcctccattcgatgttatcccgagatattgttcatattccagttcgcaccacaccgtctgtgttcccccctgtgactcataagtaggctctattgtaatattaactgttatggctatcttaccctcacattatatattttgctgcgaccaaaacttgttgactgttgaccagtgtgtccaatg

SEQ ID NO: 19811 - DNA, 108 bp, Homo sapiens
aaagcaattttgctaaataggaaaggcattcacaagaggacataagaatctgtatttcccatgggcaaaaagccccatgttgcctaggcgtaataaatatggcccaag

SEQ ID NO: 19812 - DNA, 1456 bp, Homo sapiens
  misc_feature (1)...(1456): n = A,T,C or G
tcaccaacaaccacactcatctcggcgctgtttcgcccgcggtaggctgggtactttatgttgttggtatgttgttgtggagntcgcgatacgcggacgctcgcgcgcgccgaccccggcacgcggcgatcggcgaggagaaagcggtacgagacgaatacaccgtactcaattagggcagtagtcctcaagtacgtcgctatatgcggcgatgaagcggtanggcgcacatacatggttcgacggcgacagagagtcacagcctcacctatagttggattctcaaccgaggtcaggcattcacgtcggagcacacgtcacaaaacgtgccacaatcgtcctactcaccattatccgttatcatcgatactgcgcgagcggaggagcgtaacattgtcattcattngcagtaacagcgcgcacagcgtggatatagagcctcacgtgtagacattagattagcaagcgctcaggcaaatacgactgaacgcctcagctgggatagcccgcgaccacatcgtgtcgtaggtacgatcgatgtgataacagcatagccacgcactctgaggataatatcccacattattctgatattacagcgcacatgtaccaccacttgttgccctccgtgttgcgccgcatgtgccatgttgtgtccctgggcgacgcctgatggcgccgcatataacccaaccaggagcgccggccagagtgcgatttcaaccagcgacctnggtactttggtacttatgcntgtgtcactcacgtgtggccgcgcttacgatcgtagctaaactatatgctatagtgtaggccgtcactctgagtagtctcttcctcgggtttgcaccgtactgtgccaagcgcattattcgtcttatatatcgaccgtcaattcttgtgattgtctagcgaacaagcacgctcactatgcacatgttgccgcatctgtattcagtggattccgcaattcagtacgtattatgacgccatacggtgacgctcgtgagtacacntcacactcactcacacaccagctagtcactattccacatctagttactcgtacgcgcntagtgcatatcctacgcccaccatagagcgtcgcgactgagacgtangtccagcacacagagagcagtattgcaattcgccgtgccatgtaccggagcgagtgggatacgagcgtcccctgaagtgtnggacatattcgattgctcgtgtgtgtcactcactcgccattcncgtctctgtggccgcacgcgttgacccccactatctatcggtcgccgctctntntagatgttattntgcgcaactantgctgtgggacctctacatctctcacatncacgtccncntatatgtttatatattttagcagtagctantcanctaccacactatgacagagtgtctgatntgagcttcctgtatgggtagtgctcatgtngtt

SEQ ID NO: 19813 - DNA, 1486 bp, Homo sapiens
  misc_feature (1)...(1486): n = A,T,C or G
cgcagcggctgcaganaaacaaaaatagaccccaggcaacaaagaccacgggtcaccttaggaaaaggaaaaggtggggtgtnggccaaaaaaaaccnagaatttttgaaggggggagcgcccggaacaaaggagngaaaaaggaacgccggggcgcgcggggggaggggggacccgcaggcacccgccgcggagggccgacaaggcgcnaagcacgagagaaggagagcaggngccgcgggggccagaagcacaaggagccggcgccggcgaaggagggagggggccgccgcccccccccgcaagaaaccgagacgaacagaaggcaggagcagcaagcgcagggacaccgcggcgcgccggcgaccgaccgaggagggcgcaagcagaaaaagaaacgagcaggcgcgcgcggacggaacgagagaaggaggaagcaagagacgcacgaccacannaccacagcgacccgacgcgaggcgcggaaccagcaccaccacccacccgcagaacgaggggcaccggcgggccgcgggagcgcccgccccgcgccgaagaagcacggacagcacgggggggcngcgcgacggaggcccgcgcgagaaggcaacgcagacagggcgaggaggaagcggaagaaaacagagggagcagagcgacaaaagggggcgcagccggaacaacaagcagaaagcggggacacgacgggggcacagcccagacggcgcaacgaagngcgacacgaggaagaagcggacgcccagaacagcacgcaagccggcacggcaacccagcaggcgacccgccgccaccgcgcggggcgaccccacgcgacaggaacgcagggcgcgcgaaccgcgacacccgccgcacgcagcacagaccccgaacccggcataaaagaggcggagcgcgggaaaagacggggcacgaagcgcgcgcgcgaccaacaccaataacaaacaggaaagacagcagcagagagaacgcgcagcgtgcaacggcacccaacgagcggcaagagaaagaacgagcaccgccgcggcacgccacaaccgatagacgcaccccggcggacggcgcggcgcgccaagcagagaacgcgggcggaaggaaagaagagcgccgancggcgggggcgccggcgacggggagagagcgcgccacggcggaccccgcggcagcgncacggcagagtccagcagggagacgacagcggtacagcggagcacaacagcgcacacgcgccgaaccgaccaccactganagcagacaccacgagnacgaagatcccgnaaacacacgccgatagccgcccgtgaacacgagcgctagagagagagaaaaccgccgagcgacacacaacacccaagaggcacgcgccccgaggcacccagcaggacgcataagaccacagaaagtaagagagaaaaacagacagaagaacacacggaaccgcgcgagacgcagcgacgcaccacgcacg

SEQ ID NO: 19814 - DNA, 1154 bp, Homo sapiens; identical to SEQ ID NO: 6328
  misc_feature (1)...(1154): n = A,T,C or G

SEQ ID NO: 19815 - DNA, 1260 bp, Homo sapiens
  misc_feature (1)...(1260): n = A,T,C or G
gatgacggtgtgtgtgcagtgtcgagttggtgtttgtagcccagtgttcgagtcgttgtaatgagcaggtcttacagagaganttgagagaggtggcagccgaagaagtgctcgtacaatgcaatcctgtcaacagagcatagtcgtgatctgtgttcgttacgttagcgccgggtcggcacctgcgccactgctccaccgctgccgtccntcttntccgtcgattcctacggatgcgagaatttatctgcgctcctnctacacaatagtatagaaacccacagtcgcccgtccggataggcgccggtaattccggagaggtagtgccatgtgatgcgcttaaatgcacgctaaattaatacgacaccatgttacctgcagcccctgtgcttacattccgtttgcgcgcagagactaaatttaggtaataattcagacgtatatataatgagtgaagtgtgtagggaaggctacccacgcctcgtagctgtgtcgctgcgcacactcgtgtgcgcgcccaatctagtgcgttcacccgtgccttgcaatccactatatccgccctgataacatatatatcgctcactgcccccaccctatatacagtatgtgttcacacggcttctggtgcactatcccctcgatctaccgattaatccctcgatctgaccggcgatagcggaatcgcccgccgacaacgtatatctacagatcatgtttgactgcgttatcaaacatagcatcgttgtctatatgcaagatatgatcgcctcccctatgagcgtctagtcgagtatgaatcgantcgaccagctctcatatccnaaataataattactcccggtatcattagcatacgcgccatcgaataccctgagctctgcgatatccggctcccggctcagtgagattatctcacagtaccatatgtctaatctatctatcctccatccgtccatccgcacttctccaatcccatcttttaatctccaccacactgtcacctccatggttatttcccacccgtcattatatcgttagcatgcctgcttctactatcgaagcaggccacaatggcggactagtcgctcctctaccgctcaccgcagcacttgtgccctccccattggccctcgagtggtacgacgctagtttggtcatgttcgttggtgtcttgcccacactaccactcacctcagtctttctagttcntgcacccacccatctgttcgctttatctactcattcgttcacctgtgt

SEQ ID NO: 19816 - DNA, 561 bp, Homo sapiens
  misc_feature (1)...(561): n = A,T,C or G
ccacctgctcgcgcctgtgggngttgttgtgcgttgggtgtgatgtcccgccctgngtacatgtcctcttttcttatttcatgtgctcgtggggtgagtacaggctgtaggctgggtcttgggttgtggtgggtgcgttcactaagtggcccggtggggagggtacgggtgtccaccgcgagttagcacgctctttatgtgtggtgtgttgtggcgtgtattcctcggtgtttccgtaaggagggggttgcaagttatcgtttcgcgtgctgtgtggctgtctctttatgtgcgtcactggaggagtgtgtgtgtctagaggttgtgtctaaccggtttaagagaccgagggggttgggtcccatcttttgttggagcggggtggggtaatacttttttccctttctggggttcaaattaggtgtcctggattcctctgatgttttttgtgcttggggatacaaggtgtcttgctaacgtcctatcagcatataatgttttcccgggcgctatgagaactctgccgtggccctctggggggctgtacgaggtcccgcgaaa

SEQ ID NO: 19817 - DNA, 1358 bp, Homo sapiens
  misc_feature (1)...(1358): n = A,T,C or G
ctgctgtcgctctgctctgctctcttgtcttccgtcctcgtncgtcctccgtccctgcgcggnctctgctcntatctcgtcgtgatcgagtctctgctctatacgatctatcggtgtgcttagttctctntcacatntggtncgctcttcntctctcctcgctgctcntcttgtgtgcgcgtgcgcgcgccggctgccgcgcgctgtggtgtgcgctgctctcgtctcgctctccgcgtgcctgtgcgtcntcttcttcctgcncgtgtgtgctagtctcgcctgtgtgggtgcggtccgtcttgcttctggtggtccgtctgtctgcgtcgcgtcgtctccttcgcgccgcgcgtcctcgccgtctgtgtcctcgctcgggccgcgtctgtccgtctcgttcgccctgcttgtagcacgcgctcttactttgcttccgtgatcgtccttgttcgttcgcgcgncggctgggtctctgctcttgtcgctgtcttatcttgcgctgtgctcgtctatgctgtgtcgtgntctctgttcgcgctgtcgagctctctgcgngtctcttccctctccctcgtgtgtcgtgcctgtgtctcgctgctctgtcgtgccgcgttgtctctgtggcgtggccgtgtctccgcctgtgctgccgcttctcctccgggcgggcggcgcccgcgccgccgtctcctgcctgctgcgcgccccccgtcgttgctgtctgcgccctctctttcgctcggtcgggccttccgtcttgtcctttgtctttctggctcggttttgtgccgggtgcgcttcggtctggtgtgtcctccccctccgtctctgttccgccccagccgcctccctttcgtggtgtttgttctgctgcgtgtggtgctctctgtttgttgcctcgtgcgctgctcgcgtgcgcctttcttgtgctttgtcgggcgttcttcacgacacttctctgcgcgctcgcgcggcgcttgggtcgtcggtgtcggcgcgcggcgggtcctctctcgtctggttgtgcttgcggcgtccgcccccgcgctcgtctgcgtcttctcggtctttctcgccgcttgccgcgtgtcccgtgcgtggcgccttcgcggctggtcctgtggcgcggctggtgcctcgtgcgtcctggtcctctgctcgtggtgtttcgcttcgttcggtccctccctctgacacgtgtccctcttcttcctcgccgtgctctggctcntgttcgcttgtgtcttccgtccgcgcctaagggctgcgtggttgttcgtttccccgtctcgagggttttgttctccctttctctccgctcgcctccgggctcgcttcgggtggtgtgtgtttcg

SEQ ID NO: 19818 - DNA, 1712 bp, Homo sapiens
  misc_feature (1)...(1712): n = A,T,C or G
gaatgacgtagtcgcatgcaagctgagagagtgatggntnggcgcgcggcagagacgcgtagtcgcccgcggcgtgcggggtagcgcggctgtgcgggcntctgttagtanagaggatcgttcagcgcgtgcgaatgcgcagctanagcgacnactgcgaggcaaactatgtgcaagtgtcaancatagacgtganatccgaataccgatacgcngccgcatctctatcgttnatcgccggtcgatagcaaatgcaagcagcgacgcgtcaccgctcgatatcacgggcatcgacgaanacgagcgcgatacgcgagnatatatgcgcgcgccggcggcgaacgcgtcgccagcgataaacgcgtcaggcgatctcccgctcatatcggcgcgacgntacacatnatcacaatgcgaccggcgcgatagctagtcggtgttgcacnttgccactacacgtaagtgtgctgcccaccangtgtncggcatcgatactactagatctcacagcactaattataatagagatggagtcataagtatcgatgaatatgatcagaataattgtacgcagatagcagacagtcgtgctgtcgctatatgttacagacgtgatcacaccacaattatagtgcgtaatccggntatagtcgtctagacatgagcgtatcgatcatccatatagagtgcttacactcacgccgcacacacttgatctcttgtgtacgtancncancgctgtcgtgacgactcacgtcggtatcacctctcgctctntcacatcgtancacctgcngctcangaatctagtcgctcttgaatggagctccgtgctagtagaccacacacagctntgtatgtccactacattatattgacacaccatcagctttcctacatgtgtgcacgtacantntataagcgacacatcatgtacatatcgacattgatatcgncgncacgtgatangacgcgcagngccgattatacccgaataggtacgnctcgcgcgatctcatgtgctntcattgcacatcagtatgggataggnacgactccgatatatcgtctgtgcatacgccatcatcgacgacactatagatgacacacgtatactacagccctctagctatattatagcgttttacgccancagcatcagcatgaattacaaccgtatacatattcctccnctatatactacacgcgcgatcacgtagtacacacttcgctcgcggcacacgcactagacatagctgtgtccgttgattcttgagtaaggcacgcacgcacgctatagatattgcntaactagtcgcatgagtgcacaccacacgcctctagcaccatcatggtacntgcccacattgtcctctntacacccactgttattgtttcacgcccttccagtgtgtgccgcaccacgcgttcgttgtgcttcccgctcacnactaaagtccagtgtggtgatgcacacgtatgcatagtcggagacacgcgccacctgaagacgtgagatagcgntgtccgctgcgcgacgaaacaccgctcacatactagcacacacccgatgcaccacctttttgncggcacactcatgagttatgtgtctatntatgtgtgtcaccatcacacacaatacctacttagtgttgatgtatccgcgcanccctcactaatgccggttgtgactccacttactatctccattt

SEQ ID NO: 19819 - DNA, 873 bp, Homo sapiens
aaaaataaatattacaaatacgggaccaaaaaaaaaaaacttaagcggaaagacactctcttaaccaccgcatcagaaatggagagtttgtacagagctctggataaaatggtgttgtggtgttttctctggggtcaatggtcactaacatgacagaagaaaggggcaacgtaattgcaacagcccttgccaagatcccacaaaaggttctttggagattagatgggaataaaccatatgccttaggtgtcaatactcttctgtacaagaggataccccagaatgaccttataggacatccaaaaaccagagcttccataactaatcgcggacccaaaggcttgttttgaagcagctcacccattgctatccccatggttacgattcaatcgatgatcacataacccgctctatatcactacctagcagggcaatgcaaattctgttaaataggactttaacacacatccaaatacagacctagtggactgccctaacgacgcttctttaacgttgctcaatcacagcagatgcttctcaagtgacgtagcaccccgctctctttctcaccgaccatccacctaagcccccacaaattattttacttagtctatcgccatacccaccacaatatattacacctgattcctcacccacagtagagtctctcaacacaaggggccccgtccccgctgcctagtgccgctaactgtcatgctcgtgcagtcacatttaccaactccgttcctaacaatagccacaaactacttgagcccaccatgtgactagtagacctatccatcgacacaacaaaacagcacacgccgcaagcactcctctcacatcaatatacccacctgcatccatcacgaa

SEQ ID NO: 19820 - DNA, 1475 bp, Homo sapiens
  misc_feature (1)...(1475): n = A,T,C or G
aagggggnaangaggaggggnaaggnggggaggaagaaaagaggataganagaagaagaggaaggaggagagtaggaataaggaaagaaaatgtanaannnanaggaaaagaggagaggagagattataagaatagatgagagatgnnaaaaaggaaaagtgtagaatganaaatagaggatagtaagagaagnttttagaggngaggtaagatggggnnaagagaggagggaggngnaagaaagacttgatgtannnntagtggtagtatgtacgaagtgtgtngttgttnagtcgtgttaggtgtgtgnnnagagggtatgatattaatgtgaacgtgaggatgttggtagtggagtggtgngcaggtgtggnngagtaggtgtagtgggangtgttgtttatatnnanagatatgaggattgatgtgttgtgtagttgnnnngcggnaggngnagtagaangtggcgtgnnagtatagatgatgaggaaaattnactagtgcctgggtacacagaggcggcgtacganagcgtgagcgactgatgcagcgngnacgncgatgctgtctncatnggcctcgcgatacatcatgagagtacgcgtagaganactcgngtccgtgagtgcgctactgagcagcgnctcgnatctccgtctgaggcgcngttgcgcgagtcgatgtacgtcgncgagtcgatctcgctgggcggtcgtggccgtccgtgtcgagtacgggtcgcctcgcgccacgagacacgaccacaccttaagcactcgtccatcttactctcagcgttcgtctcntacttacgtgtgtcactattgtaatcattcagagtatacattcagtcgcatgtctcagtgccgtgcgaggtgtttgatntcatgtcaccnacttgtaggttgtgtctcacaggtagctgaggtccgagggtgncgccgtagatcgagagatgctnncgcggtgctacggagtgnncngttaagacgtgaagagaaagtgagcagaagggaccaagggtgtncnntgtatcgcgcgtttgtatcgtgctgacagatgtgcttcnntatacagacgacggcacgcgatgcncaccgtgtagcngccgagcagtnacacagcgcacgagtccacgtcgcctgtgatagcacgtccnctcaagagtagagggtnncactgtcgagtcgcgacactgtggtagtcggcacctatgagtnatacatagtggagtactggtctgagcgccggcagccagccgacccgacgcaccgcgacgagaaagtgtcacacgcaatgtcnntcaagagcaggacacggnccacatagcgacgcacgcgacatgcacncttgtagtagacaggtggtgnncacgtagaatatgccgtgtagtgcgtgcagtcncccgctacacgncgctagncgatgngtntcgaacacgtacgtagtgcgcgaccagcatgtatacgctacg

SEQ ID NO: 19821 - DNA, 957 bp, Homo sapiens
  misc_feature (1)...(957): n = A,T,C or G
gagaagaggaagaagcggacacacccaccgcaaaaaaaaagcccaacacctcnagagtgcacagactctcttcttgaaccaccgcaacaggttttggagatcatattcattggaggacactggaagatgggaagaaagaagcagctgccagcggactgcccctgatggcgatcatccataaatcctgcccgtggagctagccaagccctaaagcccacatatccacaacctacaggaaattgcacaaccctcccataacccaacgaacgtcaaccgttttttttaaaccacgaaccccgaacaacacccacaaagggtcagccagggagcccttcccccccgcctccccttcacctgcccacccagcgtccccccgccccccccccccgcgcaaccacaaaccacaaaccgcacacccccaagccccccagcacttccgcgcacccgccatcctagacagagtaacaggcgacaacaaggcgcgaccggaccggcgcacgcaccgatgcgattcccacgcatcagtctccccagcccgccacccaccaacccaccgcgcccccccccccaacgtagtaacacggtacagtataagccacgccaataacataaccacacctccagcgcctcacgcgcggccggcgcacccaccgccccacccgactccccccgcgcccaccgccgtccagcgacacacccgaactgttccaagtgcaaccgcaacgaccaacacactgcaccgcaccacgctacacctctccaacataatcatccgttacaaccctaccacggccaccggacaggatcacgccccgcatacctatctcacaacctgaccgcgacacgcccccccgccactccacccgcccccgccccgaccacaccccacccatccaaccatctacagcccacatacgccccaccatcctctcggagcccacgcacacgaaacacacg

SEQ ID NO: 19822 - DNA, 802 bp, Homo sapiens
  misc_feature (1)...(802): n = A,T,C or G
actcttggatactaaattgatggccagcacacaagcttttaaggatatcattaacaacacatcccttgcggaattggaaaagcggttaaaagagacaccttccgatcctgctaaaaacgagcccaaggtttaccaagttatgacacaccctctgaacaactccaccaggcaggctacgacgcctacatcgcaggccctgaggttcatcgtcatggacaaagacctcatgctaacttttgaggccatcacctactatcatgaggtcaactccaccaaagcccgcgcccccttcgtttaacgctgtgagcgccgcgacacatacactcccctcgactgcagcttcaatatggccttcgagtatctattcggtcgctacagtggacggggataggcacgacagggtcgtcatactcataatatatttgcgcagcccgtgcagggccggctacattcccccttgccactcccactacacgccaggacctcgcacccgctctccccaccgccgcagccccacaccccactccaccatagctgtgtcggcagatctggcaaatgtcncgtagggcgtaagtattgctactttcgtgcgtctaccacccgctactgcgcgactagtcctgccgcgtaatgaccccggggcgttcttcgaagagaagtggaacgccctagatcgcttagaccaactcgtttctgccctcggttggctggctcctgctccgacatccggaagtgtgcctctgcggcccatgagatacgcccccaccgagcgctagcgcctgccctgcagatctcatcgggg

SEQ ID NO: 19823 - DNA, 1098 bp, Homo sapiens
  misc_feature (1)...(1098): n = A,T,C or G
cgcgcccgcgcgccggcgccccgcggngcccgccccccgccacgggagcggctgggaggggggggggcgccttttttgtccccccctctcgcgggtggcgtggccgtggctttttccgggtttttccctttcgcccgcccaggggggggcccacccaaactttttttcccccttctcccccnncccnccccccnccnnnctcttcccctcttctcccccctcctttttcccctcnnccccctttcttcccctcttttcttnctctctctctccnttcctccnnccccccnccttcttctcccccttcccctttccntgggggggggggggggccctctctctcccgggggggcgcncncctctccgcggcgcgtgtccccccccctctgtggggggcgggcggttgcggcggcgtccgtgcgcgccttcgccgncgcccttctccgcggggcgggcggcgggcgcggcgcggcgcggcccgcggccggcgcggtggtgggcggctccgcgcgcgcggcggcgggtcgccggggcgcgcgccgcctgggcgtctcccgcgcgcgagcgcgtcgcggtcggccccggcgcgcgcgcgtggcggctgcggccgtcggcctgtcggccgggcggcgcgcgcgggcgccgtggccgcgctccgtggcgcgcggcggcgccggcgcncgccggctccggcgcgtcgtgggggacgccgccggtcgcgggccggtnggcgcggcgcgccgggtggtcggggcgggcgggtgcgggcggggcgcgggggcgcgcaggcggcgtggcccgcgccccgcgcccgggcgcgggcggcgccgcgcgccggccggcggccggcggcgctcgcggcggcggcgcggcgcccgcgcggcgctgcgcgcgcccgcccgctggcgccggccggttcccggcgcgcgcgggcgcgggggcgccggcgcggacgctgccgcgggtcgcggcgtcgcggcggggtcgccgcgcgctacgccgcgcggtctccgtgcgcccgggcgctcgctgcggcgcttgcgcccgcgacccgcggttcgctgcgggtgcggctccgcgcggcgcgggagccgccng

SEQ ID NO: 19824 - DNA, 766 bp, Homo sapiens
  misc_feature (1)...(766): n = A,T,C or G
atgggttagaatgtctgttcaggttttatacttatcgagggagggggagttcaagcgaaaaatttttcaagatttccaagaagaaaccaaagaagactaccgaatctgggtcagcgtgtagtggactaggaaaagttttggggcttatttgaaatattctcaatctaagacacagtctattgacccaaaacttcacgaggggggggggacttttaananggtacaaaactaaacaagggatccccctattacggatgaattgtggaagagaaagacattcctctacttctgggggaggaggaggagccggctagacttcccctaattcctctacaaaggcgccagatgctggtaaagctacatcgtaccggggaggcttagggtgccagtaagactctcccagaatgagtattttccccggagggccgggggcccttgcacattagacagtggccggcctgcgcgcctgggggatccaggaaaggggcggaggcctcgcgaagtagacgcttctcaaaggcgcctgggcgccggggggaaccgtggggctgcggagttgttttccccgagatgctccggggcggctgttcgggggcgtcggaagagtggcgcggtgtggcggtgggtgcggtgtgtgtagccggatggttgtgttcaaggcgcccctgcgggcgcgggccggcggggggcgccgcggcggattgggaggggcgcgatcgggggcgtccgggcgcgtggtggtcggacgcctgcgtagggcccgtcg

SEQ ID NO: 19825 - DNA, 1749 bp, Homo sapiens
  misc_feature (1)...(1749): n = A,T,C or G
aaggtnnnnaanggnaatnnnnaanaannnnnaggnanaagtatgnnannnaannnaaaggnntnatnagtaanagnnagaagnnnagtaagttnnannnnnnnnaaannaaaatnaaagataatnttnnttagtnnantgagtgtnnnaaataagnnaaaagaaaaatgnaaaagaaatgaaagaaatatgaanatcagaaggaataagaagganaaaggatgatgaagtagaacagattatcaacacacatgtataatgatatcttagagaatttaagcctacgaatgatgttgtcgtatgagnnttactatacagtaagacgatcagtgatatactagacgaatacgcgtagaacagtcnagcagatgagcgngtgcggacgaagagaacaggtcaagagcaagcgntgagcgcggagagntatgtagaatgcaggagaannanagcaggaggaacaaagcgacagagangncggcaacgtagtgatggcanagcgaagagatggaanactncctaaggagaagagagtcncagaacgcgtcgaggaaactagcagagntaccgncacaaaagcagcaacaagcagagagagagnacacaacgaagacagtacaacgacagtagagcgcatcacgtagtacgaagatgaagcagtaacaatacagtcgccacgancagctcgcgagtcaagtcacgacacacagagagangacagntgagccaacagacgancgacgnacgtncgcgagagcgcggagcgctacgactnatacgctcaagatgtacagaccnatcngacagagctactatgtactagacgtttctatatgacgcaacatntnatnaagangcagattactgcctcacgcatcacaaccacagtcttnngctcnctctctcgtcatcgnagatcgttgccactgcttcgagtcatgacacttcgcgagaatgantcagcgaagtggcgcatacagagacacganncagcgngatganagaccancacgcacatganatcatacagagacacatcgcgcncctnagataaatgtgtctactnncacgcacagncngactgangtgcgtcatcgaagcgtctgncgatgagacgcgcagtgagagacnnnaccagtgtgagataagacgatgtcnctacaagtgcatcataganagacgatncgaccntacacacgcactagatagagactcgcctcatatcagtaatgntcactagtacagatcgatagacgtcattnnntctacgctgacgcacgtccgcactntcncgcncgatacgttaacanagaatgtgtgtcaatataaantatancacatctacacgcgtcgcactgcgtgtgagacgnagatctcgagcgatatcncacgtcgacctacgtagctaaattatatatgnatnacatgagagtgctcnnatcncactgataatgtgnccgcgtacgagtgtgcgatcgacgcncncncgagcaatgagcacacacgagagatgtgcagcncgatacaggcgtcnnncnacgcagagaaagcnacgcgcanatgttaaaaggtcagctcgcgcgtcgcataggcntaagacatgaacatgatagatatantnncacgnaggcgtggcgactagacgcgtggcagcangacgaccccaacggtcacgcacncactntcggcgacgtcggacgcacacgcccancagcagtgagcgctnacacacgatacgatgcgcnnncnacg

SEQ ID NO: 19826 - DNA, 501 bp, Homo sapiens
ccatgcggactgactctcttactaaccccgctacagtgctgggcctaaaggagataacatttatgaatggagatcaactatacttggtccaccgggttctgtatatgaaggtggcgcgttctttctggatatcccattctctcagatcatccatctaagccaccaaaggttactttccccaccagaatctatcaccgccacatcagcagccagggagtcatcccgtccggacatccttaaagacaaccggagtcccgctttgactatcctacaggctttcgctgcatattagtccccttatgaccaactgcgcccctacggacccgccggccgcaagcattccctactcaacactctcaccccccaacccaccaccccctgctacgccaaccagagtcacaaacaccactcacgatacctcacctcccctccaccgcatctccctacccggcccagcgcaccgccccctctgctgcacactaccacctgcactccaatgcc

SEQ ID NO: 19827 - DNA, 1382 bp, Homo sapiens
  misc_feature (1)...(1382): n = A,T,C or G
aaggtggnaaggggagngaannangaagaganaggaaagggagtagggaaagagagaggaaaaaagatgatgggatagagaatgggagtagaagnaannacggaagaggtgaggtttaagggagatgngtgtaggagggtataaaaggagagaggtgagagtggtgaggncgctaggtttaggtggaagaggggaaggagggggagtggaagtatgtaacggtagcgcggaggggtggtgcaaggccgcggcgcgacgggggagtgcgggagcgaggcgggagtgagaggggcggacgcaagagcgggcgccgcattaggggcataagctgagcgtggtagatgggtgatgtncgggagcgatgggatagggggcagggaggatgcgggtgtgtgggcgagtgtagggtgntgcgcttgttcatgggtgacggtgcggccgcctgggggtcgcggcgtgcggggcgcggcggcgcgcgtgcgcggagcgagggatcgttggcgcgngctgtgtcgcggctgtgcggtcgcccgtngtccacggcgctctcgcagtcactcgtggcctcccggcggccgcgcgcgcctccaccggccgtcgcgtcgtcgggccgaccgcgcgccccgccaccgccgcggccaccgtagcgcagcgccgctacgtctacgccgccagcacgcgctgtcagccacgccttccctcacgcacgcaccgcccccacgcctcagacggtccgtccacgtccccgccagcgggcggcggggtgggaggcccgccgtgctactgggcggcggtgtgagtctcatgtccgaacgcgtggtcatagctgcttgtacagagagggcccggaggggcagcgagctgtcgagtatgaggtgcgtccgtcggcgagttagagtgcgaacgagcgggagcggtcgacctgccggcgttctggcgctgcaggggaacgagtttgaacancgccctctcgccncctctcgctcgtcgcgccgtgcgcgctactcctccgccggcaggcgcacctccgcgaggtcacgctgcgtgagcgagcgtcgcgctgcncnagcctcctgcgcgccgcgcgcctggtcttctcgtcctacgtgctcgtcccngccgtctacctgncgctctccgccgacccccgctcctctcacgcctctctcgcatcgcgctcgtccccacncncgtccatgctcgagccgactcgctgcccancggctcggcgctcttacgccatgatncaccaaggagtggaggcggctcnacccgcacgcgcgccgctcgngtagcagcagcncgcnccgtcccgaacacgcaggcgcgcgcncgatcgcgcgccncgctgggncggtcgctcacgcgcgcgcctgcgcang

SEQ ID NO: 19828 - DNA, 522 bp, Homo sapiens
  misc_feature (1)...(522): n = A,T,C or G
tcttaaggctctaatatcttgtcttctggctatgagaacagagcatatggtttgcttgaagattcttgttcaacacttatccattagtctgacagcaggaagtgctaaagagcagaaacaggagtcggtcagactctcacctcaagtccaaggcaaatatgcttgcccctaaaagacatacttgatcttcaagttcaggaaaaccagatacaaagtctcactctgttgcccaggatggagtgcagtggtgcgatctcagctcactacaacctctgcctcccagggtcaagcgattctcctgcttcagcctccccagtagctgggactacaggtagcctcagcttgcacctgcatcagtcagtatttaccagccattctagacccttttaggatcctcaaacacacctcacaggactcaaaaggaagcgaactttcaccagttcgccaactgtcgtcaccaatctcatcactcaagagaaactcattcagcttttgaacactgcanaaaacaatanacacaga

SEQ ID NO: 19829 - DNA, 862 bp, Homo sapiens
  misc_feature (1)...(862): n = A,T,C or G
cgtgatctcacgtgtcgaggtgatctcgaactttgaggctccacagatccgtcccgcatcggcctcccggagtgctgtgatgacacgcgtgggcacagacaggagtttcactcttgtcgcccagggtggagtacgatggcggatctcggctcaccgaccctccgactgccaggttcaagtgattatactgtctcacccttcccgagtagctaggaatgacagatatgagccatcgtgcccggctaattttctctatttttactacagatggcgttcttccatcttggtcagagctggtcttcaacttccgaccggtggagaatcttaactttcttggtggtggccgacacccttgagccttgtcttctgtcctttgatttcctaggcctactcccacacgctctgttgtcagnctcacgggtgcttcggctcctgccaactgtgagtcagaactcaaaactggagtctgacccaacccctagacaccccttatctccaactttcaaagttaggttgtaggatgagaacccgctgacccattctaagtccgctgctagagtcctaattttaattttaataatgcccactaaggggcccgcacccccaccccgggagtgtgggagacttcaaattccatttctgagatctatgggctattccaaaattctaaaggtttttcaaattccaattacattttgaggcttaagccccctggatttgaccctagctaggccttgacttggcccctgttccaggacccgggctgactggggtgggtgtcccctccagggctggacaccccaataggtaattatgcaactgcgccgtcccttagtaggggaatatatcccgcccataacta

SEQ ID NO: 19830 - DNA, 1364 bp, Homo sapiens
  misc_feature (1)...(1364): n = A,T,C or G
aacgagagggggaaaaaacctaaaaaaaaaaacaaaaaaaaaagaggctagggggggggggaacgacgcagaaggaggggagcaagaagaaaaaaagcagaaagagccctcgngggggaggggggggaaagcccgagggcgcggaggnnagggcgcgcgaggccgcgagggggagcgcggccgcggcacgacancgacagggagacgggcgccaacggcgagcgccccgcgcccgcaagccgccggcagcgcacaacagaggcggggcccgagcaggagaacagcacgaggancaggccggcgggacggcgcccggcgcgangccancgaagcggacacagacggggacgagcgggagagccaggagggagggggagcagcacagcggcggaggcncgcgcagacgcaccagcggcgccgaccgcgcggcggccgcggcgcccggacgcggcaggcgcgcgacaagcgcgcaccgcgcgcacgcgggcgcgcgggccgccgcacacccgaccccgcgccgcacaccgccgcgcacgcaccgggcaccgaccgccgcgccacgacccacgcgcacaacggcgcgcagccgcgccggcagcagcgcgacaaggcngcgccancacaggggcacgccgcagcggngcggcacgccgcggcgccgacgcgacgagcgcgccgcgcgcagcgcccgagccgcacgcggagcgcgaggcgcgccagacagtaggcgagcgccgcaggacgagaccgactacagagacgcgccgccgcgcacccaacgacgcagcgcacgncgcgcagcgggccgcgcggaggcagacggcggcgcggcagaggggnacgagaagaagacgcaccagacgcgcgcgcgaggcgcagaccgacgagagaaaggagcagcccgagcgccggcgagagacaaaccccgcgacaggcgacaacngcgacgcaggcgcaccgcgcanacgccggcacgacnaggcgacgccagacgcaaagccgcgccacacatcgacgacacacgcagccgacgcgccagcgacgcnnaacggagcaccgacgcaccgacgcggcnctgncctgacgtgtcgcatccagcgcacacccgcgagcgcgccgcgagagacgagcgagcacgnggcgacacccgcgcagacagcagcgcgcgcgcgcgagcgcgagcgncgaacgcgagccgcgccgcgcgcgcgcacaccgcggcgacgcgaccgagcatcgcgagagagcggaccgcncnccgacgcgaggactggcncgcgtacacgaggtgnnccgcctggacgcgcgaggcgcgcagaggcagccggagagcacggcgcgcgagagacgcgacgcgtcacacg

SEQ ID NO: 19831 - DNA, 763 bp, Homo sapiens
tgcggtttatcgcttccattagtttataattgttacggaaagcttgatacaaagcaagcaggaaacattttcagataaggagaccagctattaagaatgggcatcaaggtcttcagcagtctaaagcccaaaaacaaaaagaagagattctaatgcctacctggatgtttctctgtctgaggtccttcttgcctggactactctgctccagcttctgcccaagagcagcttattttagcctcagcatggatgggctgtacataaagagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgtgagttttgaaggaaaatgaaaccttaaatagctccatcctgaaataactatagacagcatgtgaaaggagttgagcaatagtattccagctctgctgcatgaacccagtctagggaggttaccataatgcactgaaacagtggtgtcagggcaggagtacagcagaagcctccgaacccccaacagctaaattttatataaaatgtattcacctatatgaagaaatatgaaactgtctattatcttagggtgacatgtttgcatgatttttacttttcaaatattttataagctaaatgtaattcctttctaattataaagccgatcgcaag

SEQ ID NO: 19832 - DNA, 889 bp, Homo sapiens
ttcaaactatgttttaactgatgagcaatcactttggattggggagcggcaaaatcagtttatcaactactatctgaaaacccccccgatggagaaagattttcaaagatggtagagcatatattaaacactgaataaaactggaactcttggaaaaatgaaggttgcccaagttttgtgaaagaaataacatctagatgggggggggtactataataattcgagaatataacagcacccgaggactgcctagggaaaggacccaccaaaaaatttctggtgggaaatgaggaagtaacaaagctttggaatctctaccctggtaatagtggagccttggaatgagtagacaggggaaccctggccgactgttgaggattttttgaaaatcccttgaacaagcgaactttaaagtatggatgaacagcattaatatttagaaacagtgtcaagttaacgataggtagccctggagttgtgagcactgtggaggtgtttgtgtttagtgcgcagcaacgttgatataattggtgattgcggaggatattgaagttatagagtcggggctcgcggtggattgatctgatttcttcagtcatagtatggacgcgtaggatttcattatgcggatctagttaatggcttatagtgtgaggacgcgaaggtacagtgggtatatgaaggaggccgtgaggggatggagatatgtcaggggtgtggaggttgcatacagaacattacatgattaccggtgcttcaattcaataagaaagtcaggacgcgaggactaatgtgtcatcgttcgcacccctgtacggaggagttccactgctaatatggtaacagctcaggcgaaactatgtagagattagatcagaaacttgaagta

SEQ ID NO: 19833 - DNA, 1543 bp, Homo sapiens
  misc_feature (1)...(1543): n = A,T,C or G
aaaagggggggaagaggggggnnaaaaaaggaaaagtaataagtaaaaaaaagataaaaaaaaaaaggagagtgggttggggggagagaggagggaggaaagaagttaagggngnnggaagaaaagagggagaagggagggagaaagaagagagaaagaggggggttagggggggggaaggggaggaggnaaaaaaggaaggagaagaaccgcagttaaccgtgattgnggngaataagnaagacggatgggaaagggagagatgaaaggcaacagtttagcgataaagaaaaagtaggaaagtagaatatacacgaagtnagaatttatgtggagcacttgtggaggggttggtgtggggcggagcgaaganaagacgtgttnatcaaaaattattnagtgcaagctgcaccctccgctatgctactacaacatatatttatataattgtagcagtacatctacttatgtgcatgcccctacatatggagggcagagccgaagtggggcgacgtcttctttatgtcatgtctgctctgcgccttgctctgggcccgtgctatgttctgctatctcgactgtctatcctattactaccactaagcaacgatctttcgtcactaacgtgcacgctctcaacttgaccacggagacactgacgtcgcgtatgagcgtcacgcntgcatagcaagtatcgatacgtgtcacgtcgcntgtgttcagtgttagtgttgctgtctttatgatanagcgatatncncgcatacatntcngaacctatatatctctcacgattngtggcatcgngaagancgtgagaatagctacnctgcgtacctttgagtagtgtgancgtcgggagcgntngnngaatggagtcgacctgtagtgttgncacgctgagctatgcaaagttgtgttcngacgnctctantgattagtatatacggataggatttagangactactgntagtagtgattagtgtagtcgcntngcgtgagttgtgctatctangtatngcagngctgtcgttcgnactcatcacacaattggctcgcgcgtcagtacggcnacgcctcatactctgttgcgcnagtaacacactcactctcaagacgctagcgcagcatatgctgtatggtcgngtgagtgaggagcatcnatgtcataatactacacccgctcgtctctactacggatgnagcgacgacncgcagcncncatcggcgctatcttcgctgactacgctagtgctcgcagactgttgtncgctcgcgcccaggacgatntggtcgcaactcagtgtgctcgtcgcatcatagtgtcgcncngtatcttgacggcgnctcgcgctctacatcagttagtgatcctagcntagctcatacntctantatatatatctcagtactnatcnnatgacggtcgtnctcactctctaatatcgcatcgatgcngcttgaactgcgcgcctgangtgcgctnagtcgcgattcgactcacgctctcgtatgcatcattcactgtacgtancnntgct

SEQ ID NO: 19834 - DNA, 879 bp, Homo sapiens
ctgcctgtacttccttgatatgtattagaccccctgttcaggtgagtacttgccataatgaacccacggctccaatcgtgcccaagagaccctcgctaacggaaatatacatacctttccataatcacctcacccaaaggaggacggtcacagctgacctacttgacactatatgcggcttcatcagaaactatcaaattgtcttcccaaacttctagaccaggatgtattcaaaatctaaagtgctcagcgatggtaattatattacagacttaaatccctccaccctcagctgacattatgcatgcatgtgatatcgtataacatgcacatattgattatcgatataacaacattcagacgactctgccgataacttactccatagctactaaattttctcttaataagctcactgaactgtttcaacatgacatgtcagccgattgcttaactgtatcactgacctgcgccctgtgctaccattaagatattgctgataaactacgtgcggatatctctgcgactaaggcatgccacataagtaatcctattgcacctggattttacgtggtactcactacccttctatctgaccttctgaagaccatatcatcggatcacgagattccccgtgcactcgaactaggttgaacctgtgcattgaacagaagaatctaatcagacgtgcgcgcaaaaaacttcagacttttctgtctgctattacacagaatcctgggttgggatcgttatgggctgcatgacggattatgccgatcctcaaggcctactctgaacacagggtgataattgataaagcattaaagggctgttgcttcccggcgatctctatactttccaggacaaacgccgaacccg

SEQ ID NO: 19835 - DNA, 1028 bp, Homo sapiens
  misc_feature (1)...(1028): n = A,T,C or G
aaagaaaaagggagggaaggagagaggaggaggggagggggagggggaaggggagagggagagagggtagaaaggagggaaaaaaaaaagttggggggcggggagggaggggaaagaggacagaagagaganaacagaaaaaaaattaaggagggggggaggaaaagaggggggggggnaaggaaggagggggccgccgcgcggaagggggggacgcacagcaggggcgggaggcgggaaagccacgaggacccaaacgcgcgggagggacgaggacgcggcagacgagccgacgggacgagaaagagcaggggcgagggagcanggcagggagaggcggggggagcagcgagggagggcgagcgcgccaccgggcaacgcgccgccagaccgggcggcgangcgcgcacgcgccggcagggcgcgccacacanaccgccgcccggccgagcagacagccacacgcccccccgccaccccacccagaccaaccccgcgccgcgcccgccgacgcccgcgcccgccgccgcccgccccggcgaccaccagccccgcgccgccccccccccgccgcgcacccacccgaaacgccagaggcaggcacggggccggagcgcgcgggccgcagcccggccaacgagcggggagcacccccacacgcaacggccgcgccgagcggccgggccgcgaggcggagggcggggagaacgggcaacgcgagcggggccgcgcgggcgaagaacgcggggacgacgcgcaggaagacgcgagcgcgacccccgccccgcccacccgcgccagaccagcgccgccgccgagcgacgcagaagcggtgcgcgacgccacggggggcgcggcgaagcgccccgcggacagcagcacgccacgcggccccggcgccgcacgcaccccagacccgcacagcgacccgcccacaggcgccgacagcaacgaaacacagccacgaccgccagcggggcgaagccccccccgacggagcgcggcgcacgggaggcgcgagagccccg

SEQ ID NO: 19836 - DNA, 848 bp, Homo sapiens
ctctgagggtgggggcggagcttgttatttccccactttgccgaggttctaaagcggaggatggggcgggagggacccgttgacatcctccaaaaagcgacgatacccgcgggtggttgagaatataggcatggttgggatagaaagatttagtgatttcgggaagcttctcaagcattcaattccttttaaaggtcccggatgtttcaggaagaatttgccactgatggtttggtaaggtcttaccttgccctaggccccaaggagaacggtggataagggggggggtaatcaggcagaatgccagtctcataagtagtctaagacccccaatttcagtggcaggcgtcgcctcttcgggcctcgttggcgcaaacagcagttggtagcagggtctttcctcagggtctgttggaattgctaacatggtaatagcatgtctaacccagatgtaggtgcaagagaatggcaggcatttctgtgaggtatattacgactagagtattgggtttgagatcagttatgggctggcgtccagaattatgcagttgctgcatgtgcctagtggtgtagacgaggtcgtatatgtgatccgagcatcaggagggcctgttttattcatcgggcgatgggcagagatcagtgccaggggtcacagtgttgggaagctttgggtctttgtctctgacgctatcaccaaagtttatgtgtccactgccctcgatcatgcctagaaatcgcatattgagcccattaggtcaagactggtatgtgtggtgtgattctcttctccaggtgtccctatctcctcacgcatagagtcgggaagtctgtctctacgcacggaa

SEQ ID NO: 19837 - DNA, 922 bp, Homo sapiens
  misc_feature (1)...(922): n = A,T,C or G
tgagctgagatgttccgtggagcatcataccaaaatgccacgaaactgccctagaagcaaatggaggaagcacacagcaggactgggtgtctttaattgccattgcgaacgtgtgtccatctgcaccacgtgaatgatttgcggcacagccgggacctgnctcagttctcttgacacatacatcaactcacaagcactgaagtggcaaggctgtttgcagaagacgtttaaggcaaaaatagattgcatcttaaaaattcatttcattgttgatgttgttagtcaatgacctggaaaataaaacaaagtaagttagggaaatatatatatgaagttgctgatttttatggcttgaatttatcccttcaaaatgcatatgttgacatcccaacacccagtacctcagaatgtgatctttttggaaacagggtcattgcaactatagttagttaagatgaggccatgctggagtaggctgggcccctaatccaacatgactggtgttcttttaagaagaaatggatttggacacagataccacacaggggagaacacccatatgaagatnaaggcaacaatgggaatgatgcctttgcaaccaagtatgccaaagatcaccagcnaaccaccagaaattggaaaggcttgaaatagagtcctctcattggttttgagaaggcaccaccacctggnggatggcttaatcttgggcatctggactgtaagacaatgggggtctggtgtttgggtcacccagtctgnggtacttttggttccagcagccccagcaattgaatnccttgggaaatgtaccaattgnaaaattnatttttagaaatcctttggccttaaaccaaanaantaananttnctcttntntncnnnctaanaaatatataatttctctccccncccccgccnt

SEQ ID NO: 19838 - DNA, 1194 bp, Homo sapiens
  misc_feature (1)...(1194): n = A,T,C or G
antacatacacatatgaacgacatatatacaaagatcaaaaatatggcggagatgacgctgagtatagngagtagagtaatagattcacgatctgtgagatngagtagcgacgagagataacacgtgagatgtaacgacataagtaggaggcagaaggaaacntgctgngtatgtagtcgttagatgtatanaagtcgcaaatagcagtagtacgagtgggggtacgnatagtatagacggggagnacgcagtagaccggatcacagatggaatagtctcggtgtgagaatgtantagtgaaaggtatacaagtcgtcatctaattagagatcgtcggaagtatcaggattaatctatattatagacatgatgcgcntatacaatgaatacttattagcatatattcgatatacaacaagactaacgtgagaacgtcaattacaagtgatactatactacatacgattatcactttcagagtacgataatcaacgtgatatagtcgcatgtgtatggnctcaagagtcaggagatatacagagatatgtggaacgatattatattattatgtagtatagagatgaataatactagatgtggacgagatgaaattgctacactgatgcgagtgagaatgtacgctagaagtgttggtgagggtgcctagcaagtagatcaataagtcgagagatatatggatgcgagacaaaatagtgtgattatacataatgatgctgaactaagtaagaaatattggtcataataaaataaacaccacatgcatacaggttataagttgaatgtcacttgtttcatattacaacattgagtactgggactctaattatgtattatcctattaantattttcttgttggttttgttgggtgaatgcattggcacaattggatgcgaaagtgcatcattacccatcgaaacattaatcgtcaataaacgtgtaactcaccgatgttgaagtatgaagtgttataaatcgagttgcgtgttaaacaggaacgaccaagacaatgatggaattagtgagcccagccaaaaaaagcatggcctcatattaacttaatatagatgctagccccctgatagcgcaagccttcgcatagtgaagttttgaggaagacagggtaaaacacaacaaccaacattaagatttactgctctcgtattctgcatcg

SEQ ID NO: 19839 - DNA, 312 bp, Homo sapiens
cgtagctgcactgactctcttaagtttcattttccatttgttgagacttacactgttgaggaagtaaaagttcatccaaggaataatacctggtggatataatccagaggaggagaaggatgaaactgcttcagaaaattgtttcccttggaatgtagatggtgatttaatggaagttgcatcagaggtccatattagattgcatccaagacttatcagtctttatggaggaagcatggaagaaatgattccaaagtaacatgtaattgtttctaaaagaaatgtacaaactagaattttaataaaaggcga

SEQ ID NO: 19840 - DNA, 301 bp, Homo sapiens
  misc_feature (1)...(301): n = A,T,C or G
gggggaggganactcctccgactgaagaattggagtatatttctccagcccctaatggtgggtttagtcatgtgtctagctttggccactggaatattaatctggctgaccaaaaacttggaatgtatgcattcattgtgtgctcactcgctcctgctatcaccatgagaacaagcccaggccagcctggtgctttcagcagaagataagagacacccagagccaagcagagtttcccagaaatgctcatgctatattaaccaatcctcacctgaccctagatccttgaaaaaaatgacga

SEQ ID NO: 19841 - DNA, 316 bp, Homo sapiens
gctaagcgtgactgactctcttatttaccaccgctacagactccaactccttcagttttggaactcggatgggctttctttgctccacaacctgtagatggcctattgcggaaccttgttattgtgatgaggtctggtttagcagagatacggttcctataaagtagagtgaaaaagaagaaaggatttggaagctgaaagacaacaagttaaaaattgatggagtttgtacatcttgctgcttttttattggtttactttttttacaaagtcgataaagacaacataataaaataaacaagacaataaacaacga

SEQ ID NO: 19842 - DNA, 836 bp, Homo sapiens
  misc_feature (1)...(836): n = A,T,C or G
atctatacgttattcagcggggaatttaacagcgctacaggttaccttccgaacaagaatctatcactgtattattaacagccaaggtgcgatctgtctggacatcttaaaggacaactggagtccggctttaactatggctaaaggtctcctgctccatcggctcacttcttacagatggcggccgctgctgacccgtgtgggggggagcgagcggcacacagggcatgactcaactatagcggaggacgaccgaggaggcacgccagaggaccaagcggcgcacggcatagggggggtgcggaaagacgacccaggaaacctgagaccaacggcggaagcgagaggcagcgggagggggggggcggcgcgcgcagaggggatggagacggcgaggagcgggcagacaggcggggggagggggagaggcgacaagggatagaccgcccgggcgccccctgaccgacgcacacagacccacaccgcacccgaccccacaaaccaacacgcatagaatcggccaggcaccgaaacacacaacaaaaaaaccaagaagagagaatcanacccgcaacgaaaagcaacaataggtaaagagagagggggccgggggacggtagcgggggggcgagagcaggaggccgcgtcggggggggcgggggggggagggggggcggcgaggcgcggacgagcgcggggccggcggcgggacgcaaggggcacgggaattggagacgcggaggcggagaaagccagcgaggagcgggagggtaagaaagcggcagacggagaggggagggtaggggaggagagggggagggcgggaagagggggga

SEQ ID NO: 19843 - DNA, 539 bp, Homo sapiens
aggagaactggaacgctgagaagaggtcccccaccttccacctgggagatgcagcccacctccaggcagaaatccacactggcagccacatgccactgccgttgtttgtggaccactgccctgccaccccaacaccagaccagaatgcctttccttattgcaacactcacgacccgcccggactgtgaggtatacggcctcacccgtgcccctctttgtatccaaacgccctcctcccacggccccgtactctcccccctcacaaccgacaccctccctcttccggctcgcgctcccaattcgctgttctcactcccctaccctcctgcagccaaccccatatgttcctggtcgtagctgcactccactccggccggatctctcactatcttttccactccccggtccacatagtatattttcgcaatcctccgcttagcccgccccgacactcccccctcctgcaaccattttgggcgtcgcgggcccttccctcttggcgccctcgcttacgttctgttttgactcattacacctac

SEQ ID NO: 19844 - DNA, 647 bp, Homo sapiens
cggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctatatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaagatggagtctcactctgtagcccaggctgtagtgtaatggcataatctcggctcactgcaacctctgcctcctgggttcaagcgattctctgcctcggcctgggtgagcaggtggaattacaggcaccagccaccacacctggctaatttttgtatttttagtagagatggggtttcaccgtgttagtcaggccggtctcgaacgcctgacctcatgatccacccaccttggcctcccaaagggctgagattacaggcatgagccaccacacccagccaattctttttttaaataaataaataaagagcgggg

SEQ ID NO: 19845 - DNA, 1038 bp, Homo sapiens
  misc_feature (1)...(1038): n = A,T,C or G
atatatgagaaagacactcaataaatctcacactgtttgaagggatataagccctatgggagtgtgacgtgcgaagctaaacaatcatcatgagcagtaaatatataagcacgcgctccacccgtacaaaccacaccacggcacgatctacaagcataaataatcaatatctcctgtgatgtgcatacatacgactgctatgcggtctggtctaccacgganctctcaataccatcctccagctagtcgtatgatggagaaaagtgctaacgacggtcacgaaagcaaacggattagtgtaaccggcgtgacgctccatcgacacgcactcggtatcgtatactaataggataagctgaagagcacggatccggttggagactatagacgcgcaacacaaagtaggaacgccaacacgggcgcagcgccagaactcagccatgatatataatgaggtagcgagcaacaaatgcgcacaacataagaagaccgcagggacngtagacgagaatgtagatgatggcgtaggtcgaacaagggggaagaagcagaagagtaaacagtccagatccgtcataccgagaacagcaatggtccatacatggtgaaaatagtaacatatagaaccattcaatgaaacaacgtaacagtcgaaaatccaaaacctcctcccaccatcccaatatatatcatcgactngcccgccccctttttttttaattagcctcgcgcgttctctccctccgtggttttgtttgcttcgttcgcgcttgctccgccggttgctcgcccgtcctccgctcggcggccctctcctctcgtctccggtcccgccccgctcctcgccgtgcgctggcggctgggnggggccgcgccctgggcgtcggtggttgcgcggccttctgcgccggtgttccctcttgcgcctccgttgcgggccgtaaatttttttttttttgtttctcttttaagttttttttactaatattcaagaataaaatctaaaaaactaaaaaacaaacaaaatattaaataata

SEQ ID NO: 19846 - DNA, 771 bp, Homo sapiens
cttaagcgtacgtgactctcttctttaaccaccgctcacagattcacaggtacatgtggacgtttgttacctgggcatactgcatgacgccaaggcttgggatatgaatcatctcatctcccagcccctggcaaccaccatcgtactctctgcatctgtatgttcaactttttggattccatacaagacatcttcaaatcaattgatggaagattgagagaaagatacttcaggtccaggtgctgtggctcatgcctgtaatcccagcactttgggtgactgagaatttcagaagagaaagagtctctcagcatttctcactggacatgcctgaagaagcatgtagtcttaattgctactgacatcatcccataaccacaatggaaaaggactggagatattgtctgagagctcttgttatgtgctaaccatcctgttggacaatgggaacaaagatatgagactccttcaaggaaggactcaagctaccaaaggtaaagctttgaaaaactattacaggcatttcttgaaaacagtatggaatcatctgataacactgaggtgatatgaatactcctttaaccggcaatgtggctcttaggaactgatgggcatgcacatcaggatatacacaaaagatttcccagcagcactgtttgtaatagccttgagctagaaacataaatgtccaccaagagtaaaatgtttaaatatacaatggataccagactcaatgaaatgataaactagatgcggcgcttcctaatgagg

SEQ ID NO: 19847 - DNA, 1403 bp, Homo sapiens
  misc_feature (1)...(1403): n = A,T,C or G
atatgtgctagatgngcggagctacgtttanaagagtgataantcataaaatcatcctactagtacgtgctctcnttgnctccgcnactgcacgcactatatcgcacatcacgcactccacgcaccaatcagtcacatgcatatctagacgatcgtgctcgcagcgtagataccatgtctctatacgtactacatatagtctatgncacnctctctgtgatatagatcacgcatacatcnagatgaatagagacgctngcagacgtgacctgnaccactntacactactacctnacacactaatatctcatgggaatcgcaagacgactacaggacggatcgaggtccacatcganagtcnccttacgagcagagtatagcacccagcgaccacccgatctgcgcggtgtactacctacgtagaggactgaacgactatagcatacgcagtgttgcagtattacgaagtacgtgtacaatacnagtgcgagtgtatagtgtggagatcacactacgagcgtcgtcgcgcgtctcgtacggaggtcngttcgcgtgcgcgngcgcgcctggttcgtctacacttacgcacgtcgtcgactgatctatacaggtgtacgctggcgtgcaactgtacatagtgtcggatagaattgtcgtactcacattccttacagctagtcgtacagtacacgggcgagagaaagncacactatgtgaaacattaagtagtcggtttgacgagtatacatcgagacactcgctccgccagcggtgcacagacagcgaacgtcatagacgaatgatgcgagtgagtagcacgagtaaaggacatatgtatgcgcgtgagcgaccttagaacggccctactccggacgaatcctccctgctagnttcccttcctccatacgattcaggcctgcggagacgcgcgcacttagcttatgaccacgcgactaccccatcacactcatcaccaccaccgtcaccaagcnacccncacgcccccccaacgccagcgaatccgcctactcggccactatcactccccggctcgcgcctctctcctcttctctatacttcatctactaatcctggctactatcactacgcaattccgcaccctaccgacacttgtgtgttgtatatagagtcgaattactgagggtgatcgtgttcgcgggacaggtatacccactcgaccccgcggcccgagctgctgagagcaagccgagggaggtaaggtctcagcacccagggcaggaggaagcgagggaggcganaagaaacgatgctcagagaaaacaatacacccaacgaaaccaacacaccacaccaggaaataaagaaacgataccgaaagggcgaagaaaaataaaanaaataaataaaataataaaaaaaag

SEQ ID NO: 19848 - DNA, 208 bp, Homo sapiens
  misc_feature (1)...(208): n = A,T,C or G
taccttatataccatactttcatcaacttatcctataagcagaaacagccttgactggcacagncagnaacattgctcaggaaggcggatgaggccatcgccctattccagaagatgctgtgatccaccacccagcttcacccctcacccccagcggctcaccatggggatggcagcaataaaatattttcccacaaaaaaaaaaaaa

SEQ ID NO: 19849 - DNA, 1438 bp, Homo sapiens
  misc_feature (1)...(1438): n = A,T,C or G
ataatcgcgctctcttgacacactcctctcacctactcaacgttaacacaggagagtacggaggcccctaagtgaganaaagcaaagcttagagactggtttgcccgtagtaagaagtcccatataacgaagtcgtatagtgatgaacactatgggtatggcaacacatatctactacgcgcacgtccgagcatatgagtagagattttcacaatcgatactccatacacaccctgcgcaagataagagtatgagtgtgtgctcactcataggagagcactcaggaagcataaagtttggatatacatgtacagatgagcgtcnctacgtggttcgaagctcctatcatagnctataggaccagagagctgtgctcatagtaacgagtcgagaattttcgcattcgccatatcttatattaggaagagactgatggagtgggatgcatatacnaccgccacgactaataattgtgtagcaagagagacgatgcataggatctcatttcctaatacacgaacatatatgtgtctttggttgaagtacgatgctcgtatgatcgataatatttgccagaatcagcacnatgcgatagtggcgaccatacattaaacacgttatatcttataatcgacggtatattagaattggccactatggtagactatctcttgtcaggcagtgctatgtatctagtgctcantgcgccacacgtaggtacactcttctaggagaantatctactaattctatattaatttgacaaatattgtatcggcatccaacttctcaactacactagaaagaaatgagttgancacatgcgnctcttcagtgctggagtctcttcatacgcgagacggataaaccacctttctaactatacgactatctaatcatgttgtatggcattaggatnattaacttcactactacaccgcgttantgactccactcttgtgccgtcctcagtcgtantatacaggtgttatgatatatagtttagcgccggagcgagttctgagttaagtaatatctcgttatcatctgaatgctgcggtagtttagtatatcatgacatatcgcatagcgcgataatctatagagctagctcttacgatgancacggtctatatactgatatagttgggttgatatgttacactatggagtatggtcaccgatctgtgttagctacatatctactgtcatctctangatcgtgtgtatgtcatgcgaattccgtcaaataatcgtatcgaaagattcgagtcatattatgtacatagtgcggagtgtagcggtaatagcacctatatgacttcagtgagtatctctatctgtcttagtatccactattganatgacatccttcgtctgcgtagactatcntaagtacactcgtatgactctgagtcgtctgaatgtgttcanagct

SEQ ID NO: 19850 - DNA, 433 bp, Homo sapiens
  misc_feature (1)...(433): n = A,T,C or G
taaacatcgtgcctctaaaagccccatacatttaagttgacattgctttaaacattcactccccntcgcnttggggggttaaaaataaaccctaccacttccaaatcaatattntctttctactatcaacaatctaaacaaaatnaattactacactattcctctnttaatatacaaccaaaacacacttcttttcacataaattccatacattcaatnaacggagaggggtcttaccccacncatnattacaaaaaatttaactttctaaccactttttttttaaacattttaacatttntaaaacaaaaatancacactaaccctcataatantccttatccctaaaattttttccacttttatttctatncatatcacctctataaatcttaattattaataaaatttccaacactcaaaaaaaaaaaaa

SEQ ID NO: 19851 - DNA, 1020 bp, Homo sapiens
  misc_feature (1)...(1020): n = A,T,C or G
cctgtgcggtgctgtcgcgctctgtgtgttgcgtccgcgcgtctctcgtccctctctcccgtggccgcgctcgggcgcggtcgtcgcgccgcgctgtccgctcctcgtgttgccgggtgtttccggttgtgttcgggttgcctctctcttctttggtcgcctctgcggctcgtgcttgtgcccttcttcgatccgcgccggtcggcggcgttgcgcgggcggctggttgtcgtgcggtgcgtcctgcgcgccctcgtgcgtctcccgggcgtccgcgtcttgctctgcgcggttgcgtccgcgcggccccgcgcgccggcgggggcgtactgcgcgccgtggcgcgctcggcccgccgccgcgtacgtggccccgcgcgccgcgcgccgcgggtcgcgccggtcgcgttcctgtctcgctgtggtcggctgtgtgctgcggtgcgctggtgtgcgtgcgccgcggcggggcgggcgctcgtcgccgccgcctgcctgcgcgcgctgttctccgccctccgccgccgcgcggcgtggtcgggcgtgggggtcgtgggggtgttggggggcgctgcgggtnctagggcgtggtggcgcctcgctggnaccgttgtcttggagcgcttggagcgcgcccggcggctgcgtgtgcgttgctccgcggcggcgttgtgccgccgtgctctcctcgcttgttttttatttgaagtgtccttttcttttttgtctcttctttttctttgttttggtcggtttgttgtgtctcttcctgtccttccccctcgctcgctcttctccttccgcgctcttgtccctccctcctccccgcctctctcttctncgcnnccgcccctcctttcctctnnntgcctttttctcctcctttttttaattttttttttttttttttctgnntnctctttnnnggttttnnccnnagaggntttttttttttgtttccctttaggttttttttcttttttttttttccttcccccataaaaanaaacttttttccccc

SEQ ID NO: 19852 - DNA, 750 bp, Homo sapiens
  misc_feature (1)...(750): n = A,T,C or G
tcttcccgtgtcctggatccgataaaataacattctctnccctaancaacaaaaaacaattattaacatttttttttcaaaatattctcacattccatcctcttaaccaaataaaccttctacattttaccaatncctaattaactacctaccataatcttactaacgacatacaatttttactctctctatttccattatctcccaccatttntctcntttactaaacacaaatatattcttctctctcaatttaatacaaatcctacttatcaaaacttccttaaccactaaaaattattatacattaacaatcacctatcctctccntnccaattaaattnctcccaccctcttatcctataaatacattaacctttcctaaaactctttttctttttctctctctacctttaccttccctttacaattattaacccttcttttaaactctcttaaacctacctttttttttaatttccctaactttcccccttcttaaacctctcccctcttatctcttttaccccttccctttataaacacctaattcctaatccctccttacctcactaccttaccctacactattccactttcacctatcaaaatcacttcttccctacccccctcccctntcttcccccactttatcctttttctcaaaaaaaacttcttatcccccctcccccccaaattcccccttccttaataactccctcttacctcctttccacctttacacccccc

SEQ ID NO: 19853 - DNA, 1351 bp, Homo sapiens
  misc_feature (1)...(1351): n = A,T,C or G
cagcatcgagcgaactgagatatacncacgagcgtganccatcatcgtgantaagacagcatagtctactaactactactgcgccganccactgaaacttattcaacaagatgcatacaacccattacacacatacgagagagaagagagatcaatagcgagacagtgntctctatacgcgcacacgcaggagataaactccagtaagatgattacgatagtgaagcagtctcagactgatggagcatacatcgaaacacacgccgagccagatacctacactacacagctacacnaatatcggatcgtgatgactgagtacggagagatcgaacgangatgatctttcgtagctaccatacacatacttcagtngtcactcgtcagtaacacgcgcgcgccagctcgtgccacagtgagtcggcgcgctgactgaagngagtgtctatcagacagcgggcgcgtggtcggtgtngcnatcacgncggtgcaagncccacgngcgctcactacggccgactcctgcaccgcgcgtgcggctcgcggctcgacgacatcaattgccgctcgtctactcgtcgacttcgtgacggcgacgcagtccactgaacacacgancatncgcagagactgtgagcatgnaccatacgctaggggacgagacgcgccgcgcaccgcacaaggcgacagttgacgatatagctagactacaagtgtnngaactgactgcagaagagtaaagtgcgtatnagacagaagagtaaactgacgtgcgacaataagacataaaataaaacaagtaaaaaatgagcacaaactaactaccatatcaatctcaatgagaaacgatcgagtaaatagcatgcaaattgacgtcgagagaacaccgagcgcgccacttaatatcgtattaacgaagagacatggataagacacatcatagagggcatctagnaaaaaccaaggagaaanaattccgaacgggaggagtttgagagtgtaaataaactcagcgcttgtggacatattttaccatcattgttgcgcattgcccggaaggagggaggaacagaacgtggacgcaaagagaaaacaaggaatataataattggaattaaaaaacataaataacgaataacagtaaaagaagaaataaccgaccattaaaatnncttattctacctatctctccgccctcttaccttttnctctctcnncctctctnttccatcttcttctctcntttgttacnntctgtggaaatttcttttttttagtttacctcttaaattatccattttcatttaaaacctatacacaacaactnanaatttctcaacctttcttactc

SEQ ID NO: 19854 - DNA, 1026 bp, Homo sapiens
  misc_feature (1)...(1026): n = A,T,C or G
cacaccccccaacccccccgccatcccacccaaccccccccttcgggagacagaagctaccgtttagtctaaggcccggtgctatcattattgcttcattcatcaacgcaagaaattctaggtctcactggtcagccttctgatagcctcgaagaacacaagaaaattcctcgatcctcctatcacacctattttgcgtatcttaaattgacgctccatcgccccccgctgcccgcgcgtaggcacgaactgtttccagtatgtccttctcatactcctcanctaatattttagcacgaaccgctctacgcattaccacttcatacacgtactatctcattgctccctacgcttgtccacatcaccatacctactcctccgcattaacaaacacaccacacacaccccggcgtccgcactcgaacttacgcctctgcgccgtttatgccggcccctctccccccttactatcgatgtggctatattttaacgcaccccaccctcctccactccgcctcccactggcccatcgctctccttacctcacccgaacacggactcggcctctcaatactacgccccccattgcccacagacccgngggggngggggnngngggggcnngnttcttnnggggggnnnnnnntttttccccccgtgcgcccgcccggggcggcgcatcacctcacatacaaattacaaaacaacattaatttgtctggnnnnnnnngnnnnnnnncnnnnnnnncggggcgntcgggtgggggcgcccagcgcccccctttcccctatctttgaactatcatctcatcttcctcgcgaccgagtcctccctcccgatcgcgccgcgctccacccacccttcctactcgcccctctatcccatcacccgctcacattctcaccacaacccctccctctgccccgaccgtccaccacgctctcatgctttcacctacgtcccaccccctcacacctacttctatatattcaattcattccaacccttctccacaataacaaaat

SEQ ID NO: 19855 - DNA, 1356 bp, Homo sapiens
  misc_feature (1)...(1356): n = A,T,C or G
ttaggttgattacacgtacatagatatacacccacgcactcgaggaggagaagaggggnggggggcggggggccctttgngaagnacgnacnncnngccggncgcnngtncttagaggaangggaacaagacccnngcacagcgacagtcaagaagaaagaacagaagnactatcacatacactagctttacattgacgcgatatgcgcatatattatatatgtacagacacacagnacgctacttacgtatatcagcacatgtcgcgagagaanagttgtacacgatgggcgcnganagaggcccncctagtacttgtnagtgacgagttgtaggctaccccattttgcacncttctacagaacatgtgcgttagataggtaagtacctttatttnattgtnangntngcactatgtncttgcatgctgataccanaatggatgcataagtctcttggttacatgttgcatttatnactgttatctttttctttnagagacatatatacacatagtagagtcactcgctngtattgagatncttgcntacgcgtagatagagtagaatttgtntatgctgcagttcccactncttacgtctgcttntnanangaangnctctcgntnatactagtatgctgatacactatacagcctatcagcttgggacgatgacatctctctcgtgtttngnacataanagtataacaagattagacaggacataagccatggtaataacacaactacaacgtaacaacgagtaggatatatatacaagtctaattactatcaagtaatacacctgaagattaatctgtcttcgataaagaaaaccattgtggaagctattatatgctctcctcactttgtgccttctcataccaggaaataattggtccgaagtttccttctgctgttattatccatgaaggatacacgtacgaagcgcgacggattcactcaacataatattccgacccatacaatttcaatagatttcgaggaaaccccgctacattgacctacttaaataaagccgcgggaagttttatttttcattggaatgacttcactgcgggtgcatctctctactagatataaaaactctttgaatcattataaacacgaaccactctgattccgccatttatcctctcaatataagaggacagncagttgacatgttcttcttcattacatattgaggccatccagcagccattcttacactcccgcgcagagatacaagtattcagtgtataagtacatctcatgattggtgtatcaaanaacatccgcgctctatttatcgcataatccctagagcggctcttactcctagaaatctaccg

SEQ ID NO: 19856 - DNA, 1686 bp, Homo sapiens
  misc_feature (1)...(1686): n = A,T,C or G
atattcatggtacacgtcatagcagttatgtacatactgatgctcagttaagtcatatatcaacctctanagcaccttcataatattntaatactctatttatcnctatcgctattgtgcgttggtgtctgttgtgtttattagttcgcatcatgggtatatgctgatagtatgtcacgncagtatgatatatgtgataagatatcaggtaagtatatagtgtacgatgntagtggagcatgtgtgacatgtgnttccgtctgcatntataccttaattacttatcatnctgcaatagctacagatacgctacacgttctgtctcattgccgactccacagtgacgcgagagggtatgtagtgctgaacatcagtggtngctcntctcatgcaggacgcancncgcacgagtactctntatcctacatatgcactccaccaccgcggacgcaactgcctacgtgatccgtcgagtgtcgcgtctcactataggagtatatgcatacgtctacgtgcatcgtacgtacatgagtctganatcgtagttgatctntncattcagcgtacgccncccgtcgccgcacgcgacccacgncnctacgcgacgcagcccgtcgtacgcccaggtcatgatgcaatgtaccatacagtcgagntgactacgtctgacgcagtgctcgtcgcntaccgtctcatcgcttctctgctgtgtgctgtnagtcgatagcgcntagcactcgtacctgatcgctcgctcgagcgngacatagtagattataattgttngantagttgatgtggtgtgcgtngntgaatattgtnatggntgtnattactgagagtatgagtcgtctcgcgtctcgccgtgttctacctatcgtctctctcatcgtctctctctctactctgtgcgtaccgtactagcgctaggcagtgctnctcgccatacacttacagtatagatgtattactcacatacgtgactctcaccatagcgcccgtcatgtgnacatattggagggatcaagctcaactagggcgacgcgcgcagcgtcagcgttcgcacgcgttagctcaaggcaggatgcactatagcataagtcgttgcagtcgctcgctggttatgcactgatatcatagcctgtgtgtcgttgacacgaggtctctataatagtacctagcacatacattactactactgattgctctctttcgatctactctgtcgactgctacgtcacatagtatatgtggatagtcatgagtacttatactactcaatccnctaccactctctacaagatctctcggccgcgcgtcacgctatatactcgtcctcatctcagtatcttctcctctttagagagtatctgttagtttatgtgcactgcgacgtcgcgcttcctctatttgtctatcatagttctctctctactcctgacatgtgttttgtcatactagtacttcgacttctgactcttccatagatcatacttactggcgatggtcgacagcgantgtgtcgatcangatgcacagtattcatatagataacnnctctatggctattaaatgagatctcgatctgctcactactcacgtatagtatcgatacttctcgacttcaactttatctatgtcaatagcatatcagtttatagcgcgctaatcgcagtcctcgatttg

SEQ ID NO: 19857 - DNA, 954 bp, Homo sapiens
ggagtgagaatataatcacagtaaagtttcatacaaggtttatagtagatgaaggatagtaagaataataggatagcatctgaatctaatttggtaattctcagatttcaatatagggagttcagctacgactccgctatataccattatcgagacatatgattaccctccgttccggctgaaccattaaacggtcgctccttgacctcagatacacccctccccccttctctagtgctgtatcgacacaatacaacgccgagagatatgtgatcgctgcgagggcgccggcgatcaagcattcaacctagaattatgagcatataatcattcctttcgcttcctgtattgacgtgaattactatacaattcatccactataatctataatgacaaccccacacgaaacttccccttcaacactgtatgaataaaacagtagttaaaaggtatattatcataaatcgagcctagcctctcatcaagggtgtttgtacatgcaccccgggcacattgcgacataaggagtttctgatcccgccgcgcaagattaataaacactgatattaatgtcacccttattatccggtctccatatgtatattacgtttgtagcaccgccgcgttataatatgtgctgctacgacaaaaactattatctagagttctaatgatatattataagctcctgtgtttagagtactctagatatcgtatcaaaccaattccactaaattcttggttcaggcccaccacgcaacagacagttcttacgaatcctacccactacaatcagaaagacaccatcgtgtagggcaggaggcaatagttagatacttattatatacagcttattaataaatattcgcatattatatgggcaggcgcgaaacttactgatattataacttacatcattcatggtacgtgactgaagacttcccatatctattg

SEQ ID NO: 19858 - DNA, 1424 bp, Homo sapiens
  misc_feature (1)...(1424): n = A,T,C or G
gtgatgatgtagataatagttttgtattgagattgtagtgtancgtanagtcatcacatatatcgtcacaacacagatgatatntgtcacgtgcgcgaggagtacatanttgtatgccatacactgtgtctacctcactcccacganngactagcacgtatctaatatatcacatnactantgcatcggtgcgctgtatgagtactanatntagtgntntgacgcngatcgcgcgctgtcagtagagcatcagngtgagtgaagntgtgancacgttgacntctcntgctgtcgttgacntatgacctctagcgactatcgcacatatnctactcagatcnaacgtcactntagccacacatagtngcgacgtcactattgtcatctctactccacttnaccacttcttacgattctatctatnagcgtaccactctcgatagaatctctctaatcacaatcaatgaatcatattcatccacaactcgtaatattancatgtatacattatagctgtatgtactctactcactcacgtccttcctagaatcactctactacatattcttctttctcacattctctcccacctactacataacacgtcggtagcaacaatcggccataacacctcaagagatacgaataagcaagtgacggcactaatctacaatcagatgagaacgacaatatataaacagacaaaacacacacagagatcgatctcaccagcacantgctgcaacctcgcaccgtgcgatattatacgaccgtgttgaagagtgttctctctgtccaccttacgtgtagacgtcagatagggtccacagaggatcagttgagacactgtgtactctattataaagacaagtattatcgcgccatatctgatcagtattgatctgtatctattagtctttctgtcacgagaaagaagaagcctaacttatacacacaactattgctcactatccagctgtccggcacacatgtcgcacttccgtcgtgaacgaatacggcagtgtaagccacaagacacgcatgcccgactcactccgagttcggggtcttggcgtctgataacgtgcctctcggctcaatatgagtagatatggggagcggtagtgctgggtgggggcgtgcgataggacgaccatgcgctctcgcgggctttggcactgcctatcgtaatttgggtcagccggtcttgagttactgcaggccgctctccctcacgcgttacacgtaggttgttcaaatgaaatacaatatcatttccgcgtgttattgtagcatctgataatgtaggatgctattgtcaccgagccacggtggagcgagagtcctgtatgcgaggtctgatcgtgacacgcacaagactcgtacgaaagttgacaacatcgagtattataagcccacaatac

SEQ ID NO: 19859 - DNA, 3322 bp, Homo sapiens
  misc_feature (1)...(3322): n = A,T,C or G
ttttnaaaaaaannccgacagaannnnnnnnnnnnnnnnnnnnnnnnnnccnnccnccncccctcnccccttcccnncccnccccaccnnnnagggnancaaaccgccaaacaaccaacaaaaaaaaacaaaacaaacccttcnnnggcggggggggggaacaccaccacnacgagagcaagagagcggccccttggacacccccccccccccaaagcgaaccccccagcgcccaccacccacccncgccccccccccaacccaccccaccccacacaggcgcgcgcacgccaccccgagggccccccgccgccacgacaacccccaccccccaccccccgcccgcgccccncccccccccccaaacgccccccgccccncccctcccaccccacctcacacgccacacgcgccaccacactnccccccattccaaccagcgccacagcacgatgagagaggcgcacaccaccctctcccaccacacgacaacagagccgcacccgaaggagcccaaccaccccccccagacaccccaacacagacccgacgcagcggagagcggcccgcagagcccgccagacaccacccacgcccagccactaanagtagcaacaccaaccccgcaggacacaccccaaaacacacaaaccaccacaccctaccagccanacaccnacgccgcgcagccacgaccacacccacacacncatccacacacacccccanccaaacatacacaacacccacccctcaccacacaacaccacccccccgacacccaccacaccccgccgcacgacacgacccaaagcgaacgacacgacaanccacccacgaacccacaacaccacacgcagacgccggccgccaccacccacgccacacaagaccaaaccagagcggcgccaccaccccgcccgacccaccacacaccgcacgaccccgccacggctccggcacccgccaacaaccgaacacaaaaacacaacagcacgaaaacgaacggagaacaaacaggccacacagacgggcaagcccgtggaaacacaacacaccacgcacgacacagcgccagcaccggacggcgccacacgaccgcacgcccggccccaccccacaacacgaaggcaaanacagctgacgcgcgcancgagcggacgagtataccacgcgacgcgcagacncgccacgcgagacgcgcagcggcgccgcgcgacgaagcgagcgcaacatacagcgacgcgncagccgcacacgcagacacacgccgaagaaaccgacggnatccagcgcgcgcgcgccccgcgacaannncccctcagagcaacacaccgcacgcgacagcacgacgctacgcacgcgcaccagacacgagcgccgngcagcgnacacgacgagcgacgncgcgnancagngcagacagacaaangcgctgccacgacncacagcgcacgacacgaacggcaagngngatcgcagatcttgagacgagcagcgacgcacgagacgacgagcatgacagcgccgcgatcatcagtncggtccaacagccgactagcttagagacgaccgcgccgcgaccgcacgagcagcgcgcatcagcactgagagagacacacacagcggagcagagcagcgcaacgcgccaacgacgaccacgacagngctgcacgncgcgacacagcgtgtgacggagcgtaacacgccgnangtaacgtangtgagcgcgcacgcacagacgtgaggcacgccaacgagcgcagacacacgcgacaacggacgcgccccgagtcgcaacacacacaggagacaancaagagagcgagcagagcgacggacgcgcacgacatcagngcaccaccacgcggcagagagctcgtacanaccgacgacaccgagcaaanagacaaaagaanatggcacagacctcgcgcgcgcgcacggtgcaacgtgcacgacgcaggggccgacatgaggcaacgacgagcagcgacgaacgaacgaacacggacgcgccgcacacgagactgccagtcacgacaagacgcgtaacgatcagatcgcaacactccgcggcgagacgcgaacgagaggagcacaaggaaacgcncnttacgcacctcgcccaccgtaccacaccancaccaatccagccgangctcagctgagagtacgcagcaacgccgactgcacacgcactgacgaccacgcagcccaagcgtagaccgaaccgaggacgatcaagccangtngacagaccgcccgtacggancagatgcacaanccngatgcagcgcacaacacgaccggnacgacngccagtancagctacnganacgacgaagcgtaatagtacacgccacacgcgagagacancggcgcngacacnaggggggacagaccgcacnagcangtaccgctccacgagcgngatgagagacacgancagatgatgcgacggacaccggacacgaggaacgacaaggcacacacgcgcgagcagcacaggaacacgtcacgagaaaacgaccaacaccagacaccgctacgcaagcacgacaacgcataaccacatcgcagcagcccgcagccgaggcctccccctgttcccgcagactagtagccatnccgtcntgtggttgaagccacgctcanagacgacgacgtcagccccgagcntgcgnanacnagacctgacgcgacgaggcgacgagtactcgcngcagcccangcacatgnccacgcaataaagacaagtcgtnagcagatcgcagcgtgcgacgccgccgcagcagccantacgagcgacgaacacgatcganagactgcgacgaccgcaccgaacgacaancgacccgcaanagccacatcngcggtacgaaccgangcccccgcacaccaccgtccgcagatacgngcnacganngcagccacacggcaccnactgacgacggtgaagaccaacgacgactcgatcgacgagtggnaccgcctgctcgacgctgcacacancaacaggtaatcagcaacgaccgaaccgcangcgaaccgantagacacgtagtaacgcacgtangctcgccaaacacgagcagcnaggagntccgcacccgatgcacgagaacagcagcgtaccctggccngaacagatncagtctggcnctgtnctngtagcacactgcactcnaaggtgnatgcagcaccanagactacgacngacggcagatcgacacnnacgananntgacacagcncgccaagcaacggccnnattccctgagccagcacccnanncacnacagacttacaacgacttcgta

SEQ ID NO: 19860 - DNA, 1257 bp, Homo sapiens
  misc_feature (1)...(1257): n = A,T,C or G
tttatacgggcnnnnnnnnnnnnnnnnnnncnnccccntctctccccnncnnnnnnnnncctacttttcatctgtgnaagcaacaaattcaaaactgcttgnaacaagtctncccaactggaaggaaaaactggnaggctgtgcgaccacgaaggaagccagtgggggaccatatgcaaaaaatggttcttgtgaaagaccagcgcatccagaaattgcaagcctgaagtaaaagcttcccaagagcaacttatagcccagaaactaaagcatgaaaagaaagtgaaaaaactacatactgatttggcaacagctaatgccatcacagttctggaactcaatgagaagataaatactctatatgaaggaaagccagcccctacagaagacagcttgctggaagggttctgtggaggtctcccacctgtggtaagaaggtgtatagaaaaatttaacctagataataggaaacctgtcaaacccagtgtttaccctttcagaacttgagaggaatttacttcaatcttgaaaaggaaaagttttgggcacggaaaaaggggaaagggaaaagtattgcaagtcaaggccttggaaagtcttcgaaccgggaaaaattccccccattcccctacccccccaaggaagaggttcaaagggggaacccctttccccaaggaaatggtttttttaaccccaagtaaaaggcccccccccaaagcttttattcctttatttaaactttccaattggaaaccgattcccccccaaaccctcttggtcggggggtccctccccttgtgaattgggaaaggaaaaaatttttggggccaagaaatttttcccccccaattttaaagcgaaaaaaaaaacccaaattttaaaaaaaagggttttttaaattttaaaaaggtttgggtccccacaaattttacataaaacatcaaccttcttttaccatttgggggccccatccccggttaggggggcccctttccaaaacccgggggttggggccaaaaaccttccttgggcgggggggccccccgctctttttccccctttttttttaagatttggaaagggggactttaataaagtcttccattgggaaaatccccctttcgaggcttttaaactttggaaactttccgcgccttgaggaatcctctccggggttcccgttttccctcggggcttttgccacgcgccccaaaaaacccgggggttattttcccagggtttcccccttttttcaaa

SEQ ID NO: 19861 - DNA, 1662 bp, Homo sapiens
  misc_feature (1)...(1662): n = A,T,C or G
cagcgaagcagacaacggacgacacgagaaggcacgcggagccgcacgcgcggagcttcgcgggcaaatacgaagggggnggaacggggacgcgcgcgncagatttacggcggcgggccaagacccagngncagcccgcgacagagcgccgccagagaaggagagagacccgacgcgcgacggaggacacgaccgcacaagaggcgcgcagcgcgaccnaccacgggcggcgcgcgcgccgcaaccgagcagagacgagcggacgcggcgagagcacagccgcacgagacaacgacgacagcgcagagaganangancagagnaanacgcgacngcagcnagaganacacgagacagngacagcacnagacgcagcggcagcaccgnangcagncgacgcccacgnaccacgagncgcacancgagacagcagncgagcagagcgcgacacgcacagncgancangccaagcgcacgagncancgagcaagcgcgcataaatgtcacgtacagcacacgcggcaacgcagagacgcagagagcagncgacagagggagacgcgaagccacacagccagcagcanancagnggcacgagagagacagnangcacgacaggcgacacgacaggcgcgagcacgccacacacaggtacgcgacgancgactataganagacagcgccgcgactgtgnacgagacctacananagcgaccatcacaacangctacggcaccncgctgaggtacgagncgctagcgagccagacgagacgtcaacgagtacgngacgcacgagcgaagncgtagcgcgagcacagcancaccgaagcggctcgagacgcgtcccacacgacaccgcacgcagcgcgaggcgncgcgctgcngccggcgacagagcagncngacgagcatcatgcacacccaagncgagcggcatgcagtcgcgcagacagaggagacgacgcagtagagcatacacgcaccaacgcatccatcaccgtcggagccacgncgcacagacaacagtganacgccgaacagagcacgccgcgcacagcgcgcacgcgaagggcggatagagcgcaccgcaccgaacggccacaacggagcctacggcgcaccagagacgcacgacacacgacgaccaggcgaacgacaacgaacacgacacacncgcgtcgccacgccaaccagcacgancacggcacagcgcgcaccacttacctcgacgcggaacaccgacaccgagagcgaggagcgcgaagaacgcgacaggacgagagagagagagccgaccgagacgaacgcaacacgcagctgagcgcgacacgcgcagacagagcagcacaatacgcacaatgagacgacaancacagcaacaccgaacacagccaccacgaggcacgcagcgcacgcagagacacgagagcgccacacacanacaagacagacgacacgaccacacaccgcacgaccagagacacgacaacacgaacgaggacagagcgccagcgagccgcggccgcacgcacgcgcgcgtagagagaagagagnagacactgccncgaaccgcgagacgccggcgngagcgaaagtagcgagagcaagagacgacncagagagcacacacgcaccngccagagcaagaccgcgaccacca

SEQ ID NO: 19862 - DNA, 1701 bp, Homo sapiens
  misc_feature (1)...(1701): n = A,T,C or G
atgagacggacacagagtcagtcatactagagatgcgctcacaaantcgatacacancccggagacagcanagacagaagagggncctttacgagagagggagaagccanagaacgtctacaagatagntttttttgngnactagatagagcaaaaacccagaggacacgnttacgcgcagatgcctacgtagagaagtacagagcgatcgncggtatagtgtgacgatgagacagcacatgagagcatgtcgccggatcagtgacgcgcgcgaaacatgacagctctcatcaatagccgcacacatgccagtagncggacgtagcccgcaagtaagatgcacgacgcagactgcaatgcggtatatgtacgaagatggcgaccgcacacgnctaccactctcgactcggaccagcctacgaagcagcngatagttcatcagttgagtgcatagagacatgtangagatcttaaganatgtcacagccgcatgcaacgctcgtcacagagtgaatatagtgacatatacagacgacgagcgcatacgtcacacgggtaggcgaaggaggacgcgacccgcacggaggatgacgcgggagcggccgntgcactcgcgacctgcacgtctcgaacgcgctcgcagcagcgcattatcgcgtaccagctactattatatcacacagacagcccagcggtagcattacatcgtagagcagcagagtacattgacgnancgcgatgnatgacatgatctagcgacagataatcgcatataatatcgcgactacgtccgaacacattagacgagctgattgaacgccgcacatagatantacctgcgccaatcgacctctcnacagagcgtagaaattnacgtcactgactcagtcctgcgcgtcgcagcatgtacaacgtacgcgacgcacagcccgacaatgcatactgacacaccgctatcagtgagnagcacagcgcgagtgcntgcgagaggaagcgcgacgcgagacagatacaatacgaccgctgtgtcctctgccnacactacgccgattctatgtcnantcgcacatctncnatagactaaacatatacgttacatcggcatcgacagacatacggatgctctatcgcgtacgcgccgcagtantcgcgcgacagagtcaggtatgcgctcacgctacaacatcgtcgcnanggaatgtattaggtcgcacgaggaacagtcgcatgnaccagtcgcacattgcagatgagaatacaatcgcgccgngcgtgatatcagaaactagatatatagtgtgatgacgtaggcgagcacatgcgctgatacgagggcgccgctgaacanagtcacggcgtataaatatatgctaacagacgactccggcgacaaccagacgcaggagatgaagcaatatanaacggcctcgttcgcgcggccctgtggtgacgcatgacatgaacctcgatggcggcatagattgagttgacagctaacgaagcgcgcgcgtgcgcgactcgctaccgcccatcagtcgaacgaatagacgatgaagcgcaggtagcgcccgcaagaagcgacgcccgccagcanatgtgtattcnntttctcggatcatatacgcagcgtgctattgccacaagatgacctcgcgatcacacgattcactcgctcacacaacatactacactaattatacg

SEQ ID NO: 19863 - DNA, 1211 bp, Homo sapiens
  misc_feature (1)...(1211): n = A,T,C or G
agcgcgcggcgcaggcgagtggacgtcagcggacgacgatgagtgctgccgttaccaagaaaacccaaggcgacaccgattcagagaactgccacccgacgaactcccgttccaagagcatgaggaaagagctccaaccacaccatacgccaatggagagggccgagcacacgcatgaaactactacgcacnacgagaaacctcgcgcagacggcacaacaagacgagtgcgggcagctgggcgacataccagcgccccatccggagcagaactgaagaagtcacaatgacgaaaggaggaagcgcacccaccgcgacgcgggacagagagcatgatgcgagtgcgaccacggcggcaagtgtcacctcgagggatggaagcgagtagcgccgcacatgcgaggacccggcgacagacgccgggaagcagagccggcacaatgtgcgtagcgcaccagcatgggcgcaaaagacgacgcgcgatggtaatgaaactgcgcaggaaggcgcggcgcacaccgccaccgtcatcacagagagaaagcacgcctcacccccgccagagcctcggccgcctcccagattaaaatcggatnagtcccgcgcccacgacagccgcgacatgcggagggctcccgagcagagagcgcggtngtggccctgaggaggccacgaagacagcgcgcacacggtggtagtgagaggcagcgcccggactgccgccgcgcactacgaagacagtcggcccgtcgcatacggtggcgacgagcggtagtgccacgccgngagtgtagctagaagcggcggcgcggngaagacagattagaagagaaggcaatggaaagctcgcgtccgcccacggaggctcgaaggaagacagtgtgagacaacataagagtatagtagagacatcgagccacgagcgcgcggacgagctccagtagacttgctcgcccgtaagtacccgtatcatatgctcccactgaacacacgcaacgccgcggangagcagttagagagagatcacactccccgccaccaacaaaacagcccgcgcaggatgtgcgagacgtgtatagacgatggcgagaccgaacgatagtctggacgggcggcgccacacgcagatccaacagcgattaggagcgcgagacgtacgaatgccgcgtgaggacaagatcgttgaggagngactcgaatgattaatctat

SEQ ID NO: 19864 - DNA, 313 bp, Homo sapiens
gtccttagtcatcgccctcagctggagcgacgcacctttgaagcaggaggaaaaactggataggggaagaatctggggcacaatgaacccaaattgagaacgaggagaaaagaagatgctccggccgcagataaggaggtcttgagtgttacagctctttttgaatttgtctagcatgctttctgctttttactggaaagcgcccccccccaaaaaaaaaaaaccgatcaattaaaatagaaagaagcaaaagataaaaacctgaatacaataaaccataatggcctctgtggcctcagcgacgtagctatag

SEQ ID NO: 19865 - DNA, 1792 bp, Homo sapiens
  misc_feature (1)...(1792): n = A,T,C or G
ctgggattagctgactgagagatgtgatatctgtacgcgaatatgatattaatngtcactctgctatntcactgtatncagcgaacagttggcgatctttatccgcaccggtcgagcggcaccgctcgcgncgcatcacgcgcgcgagtgtctcggatcagcgntcctgcgtagagtggcgagtggaactgtacgctatagngatgtagcagtcatgtgaagtgcatngcacgtcatgctctcgctactcctatcacgtaacnacagtccaactatcagtgttcgctgccgcagctgctccgtcgactatcactatcgagatcacgatgacggcgatcagagacataaacagagcgacgccagtattgtgaatacagactactgcagtacaagccatggtatctggagtgacgagagtgtaggccgtccacatgcgcancgtagagcgtaatgatgacgtcattcagtgtcgtaccgacatntactaccncacgatgtacatagcatccacacctaccgcgcgtgcgtcgaggtacttgatcaacatcagatagacaagtctagtcaccaaatagcgtaatagtttgtgtcctcctatgtgtaaagtgtattacgcgagtctgcatcctgatgtcgctctcttacatccgctcggacgtcaagacgtaccgccgaattattaccgcgtatgagccgtgtcgtacgataccattcgtgatcgccgatctataagccacgtgtccgtatagataatcagacncngcgatnccgnctaattattccngataccgcctgtctagtacctccgcccgcgtcgcgcgcgagacgagagtacgtcatgcgatcgatacgggtnacnacttcgtagtcgtacatcctgtctgtctatcgctcntcgtcgtcgcgagncacgccgcgncaggntgtcacgtngacaggcactgtagcagcgcgtttaatgtgtaccttgtcggcacgcgtagagnatctctagttatctgtacgtccgacagcacagaggagtgcgcanataataacaccanttntcagatcgacagtgatgtgagcgagtaccacgctactatctcgacgtacgcgactctntcttangcatgccgctcgacatagntcgcgatgcaatacatanttcatctactctgtagtancacatcagcgcacntcatataatatatactctnagtactaagagatnatagcaanacgcccagcatgtgacgatagtattgcgacngcncngcggcacgtgactgttagagcgattgagaggtatgagtgannacatgagcatgatatcgatgtagtncacgcgcatctcattacctgancgccnacgatatgcaatctacatgtccatcntgcgcagatgatgacatttacacgtactantaatccgntntgtatgctgacgctgtcgcgacgacgtgaagacgagatatatagtcantagagtcagaatantnatcncgtcatcgnccatatccntagaactctcattttattagctactagcacacggatgctcgtgctgatatataatgatgtcatacctnccatgctcatcttatgtgctcncgtacgcgtatatcgacatgcgtaatatattaatattatcttgccctcgacgctacacagtccacttcgacngcgccatgtccgtctcactgtatgagtagcatgataaaatatatgngnctccgcgcaccaaccagctctcgcactagngctatcattagatatacagctcacctctcgtgtcctgtgtctagtatat

SEQ ID NO: 19866 - DNA, 1175 bp, Homo sapiens
  misc_feature (1)...(1175): n = A,T,C or G
cgcaggcgcgtgctcctggccgcgccaatagctgcgtacctcgacgagatatagatactctgagacggacagactgacacgcagaagactttcttcgatagacggcaccaccgccgctcgggacgtacggtatgtagttgagccggatggcggtataacgatcggccgaacattattggccgtatgattcataatataacgtctcctagcttcgattcagggtgttcggcgtcttgcctcactgtgatttaacgatgagtcgagatgcgttccagttaccctcatcgaactatgtcatagactgttctgatgtgttgaactaatattctcatacccgcagcgatggggtgagcgaacacgcgcggcctgcgttaacgctcggaacgacttctctgatgcgctgtacggcggggtctatacggcccccgcctcggtgtcccgccataattcagacaccgcatagtaactgcaagagcagtaacaacacatgatatattcgttctctccatatacgtaaccacctatcaccttgaccagcagagtcagataaacactcctccatcgctcgcgtgtctatgaagcatgaaaataacacgaacgccaccacattccactccgtgtgctacgctggcgccggacacctgcggcagtgaggtagaggtagttactatgcctcgctcgattcttaagtcccgaaaatcgcctagcgtctaaagacattgcagagcttacaccgccaggtgccaccgctcgcacaatttcccggccctttggttaagaattcatctatctacagcacttgagacccgacgtcgcccgctctcgtcggcccatcacaacatgagggagagtaaaacctatacacgtaaggcgtgtcgatcactgtataatctatatcactgagtgagtgntcgcggatgaccggacagtacaactcccacgcatcatataaagagatacacatatgaatgagtgaacgcggcgangacattactgccgnctagcgcgctatactatgtagagagagtactatcgncatcgacatcgagatcgccatctctccattcaagacgcacatattgtcgtgatttctatatcgtattcgcatcgtcnaaggcagagccgcgcacaaacttatatagctctacacacacgtctagtctgtagtgatactt

SEQ ID NO: 19867 - DNA, 1994 bp, Homo sapiens
  misc_feature (1)...(1994): n = A,T,C or G
aagataatgcgcaggtgcgcacgtcagcgactaggagtatgtcgacntangtagtgatcttgctacgcgtaagagacgcaacagaacgatatagatacnnctaacaacnangagaganagaacagangangagaacgcgcangggacctgttttaanacgatgcagcncaaancaccgacgcagcaattactatctactcaacatcaacgtgctcttgttcgtaccnctggtcagtacggctcacgatgacgcggcgagtcaagtgtagtgagtgacgtgcaccgtgatgcgcacttctgcgagacgtatgcgacggcgaggagtggaggtgtgacatagtgtctgatgcgcgcnagtatgtgtcgtncatgtgttaattatgcgtctctcgntcctgcgtagtctgcagcgtcaggacgncacgtcacttacccagctnaggaccgacatgacgcactcataatacttcagcgactatgcaatactcactatatgaccgtgatcatatgtctcactcagcagctcaccgcccacgagatcgtagtgcgagtgctgcatngcgcacgatccgacacgcgcgtcacacacgatgtgatacatgcgcgcacgccttaatggaagataatagagagatgcgtcacagtcagatgctctgaccgntnagcatgccgcagcacgacctagcatcgtgcgccatcatctatagtaggcgtgcgtaccacncgtacagtgtgagagcccgtcgtacgcctgatccgacgcctntgatcatcatcacctcgacgcgtcgaccgcgcgncgctctgtgcgccacgctcattatacacgngttgctgcngcagncnagatatcagcgnctgagacgcgcacagaagagatgacgttgacantccgcttgctncgcagtcgtgnatagcgacgtanctgntacgatacgcgagcgacctcgnctcgtcccgcgtgagnaggtcagcagacacgagctgacatacttagacgactcnctacactatcgagacggagcacgattgnctctgcgctcatatccacgtcgacagattgcgtcncgcgtgcatagngcgtacgccagggtccacgctancagntgcagcngcagttcnacgtcgcctgtngccngtcgcgcgcancgtgtcggtgacntgcgacgcgtcgcgtaacgtatatgagananatatcactanctcaacgcgccgcgtgatganttcgtgcgcaaacgtgacatacanctgngatanatcagacacatcaatacggctcctcncacataagctctatacacacgcgtgccatcatctatcagtcgcagcgcactacccgnacgcactgcgataatgcatcttcactcccgcgctcacgatacgtcanctgcatnacacagatacacgatactatcagcagacntgacgatatntagacgcncttcacgtagcgtntggatgtcagccgncatatcgtatgcagtcacgtgattgtcacgtcatgtaatcatacanatgctgacttacncgcnncagcgcgacgtcgncacncnactcgagcncacgagttgagtccagtnagtattgtacttcactcgcgaagacgacgtcgagtctgtctacatagtagcaactctacacgnacaccntatcanntgcactcatcgtccgctgtatactactagtangntcnaatgtgtcgatgatncacgacttcgcggctgnctgcgcgagtganctacncagagctgcgagcgcgcgtcgctgtgatatntagactagtgntnatcatacatcgtcntctncgtctctacctccagatctccgtcacccnacngatatcatctcccatcagattattgcatacgtagtgntcactactgtacgagagcnacncacctatcgacagtcacatcgagtcgacncgnangntgcattagangagatatacgctcgtatctcagnctgatacatgcgcttcgtgtctctntcta

SEQ ID NO: 19868 - DNA, 1166 bp, Homo sapiens
  misc_feature (1)...(1166): n = A,T,C or G
acacacgccagcgcgacccacgcgcagacaaacaacaagacgacccacacacacaccacancgagcgacccctcgagaaggggaaaacaggcgcagcgcggggcgcttcgagagagcgacgcaaacccgcagcagancacggacaaagagacagaggcgcgcaggaccaaggccgcgaaacgcccggaagagagcgcacgcagaaccaanaggccaaacgagcgacacagcaaggagaccgaccgcaggccgcaggaaccacgcgagcagcagacaaaccaccacgccgcaaaacaggagccgccggaaggagcgggcgcgcgcgcggccgacacaaaccgacgacccccaccagggaacagagagaacacgcacgcaagcgcgaacgcgaaagcaaagaacggaggaaaacgcaaccacggcgacgcagcgcagcccgcgaaagagccgcaaaaaacgccgcaaccgcgaacgagcccacgggacgcgcagccgcaccgcacacacacacggcccacagaagaagaagaaccaggaccagacaggcgagcgcgcagcgacccgagccagggcgacagcacgaacaccgcagagggaccggcggagcgagcgagcgcagacgcgaaacggaggcagacacgccgcgcgcgaagaggcgggacgcgaaacagcccgagcagaacgagccggacgcggagcgcgaggcgaagcgcaagtcacagaggtgaacgacgagcntgaagcaggcaggngaagagacgccccgccgcacgggagagagcgagagacgcagaacaaggggcgcaccacaagaaggagcaggaagggagacgggaacgccagccagaacggccggccgccgcgagcgacacaacaacacggcacacaacaaggccgcgacaagcagccgagcgaaagaggcgcgaagagaagaagcgacgagaaggacacaccgccgcgagcacccggagcgagagagagaggaagccacacacacccggacacagcgcgagccacaacggggggagcgaagccccagacggagaagcacgacagaaaagcgagaaaagaacgaaaccaacgcaaacggtcggggaggcaaagaaaacgcaaagaaggcgcgaacccaaccccgacggacaagcaccccaccgaaccaaagaccc

SEQ ID NO: 19869 - DNA, 2035 bp, Homo sapiens
  misc_feature (1)...(2035): n = A,T,C or G
agaacagcacacacggcagaccgctagcgacagcccacagcgcgncacagctcgntacgcacccgtcagcgcacagcaagacgcacgcacatcgacagcaaccccctcnananaggaagagagagaacaagagagacgcgagcgcgagagacgcgctcgtgatgccacgagcgacgcacacagacacacagcacgagcagccgcgcgcagcacgagnacagcgagaganacgngagcgagagacacgcgcgacaggcgccagggcacgcgcaggcgagagagacgacaccggcccacgacgcgcgcgacacggagagcacagcgcgcacgccgacgcgcagcacnacagaagagaccaacgcgccaacaacacagcagacaacgacgagcagagcgcagaagaaggacacgcgagacgagcgagaccaaccgaaccggacgagagcagacacgagacagcgaagcagcgaggcagcagcggataagggaggcacgagagacgcgcgcagcncccgccgcgaacgcgacgagaacacgaaagagacgacaccacaccgcgccgcgngagncaagcaacnacgaccgaangcgccagcagaggagtagacaagacaagacgcacgcgacgcgcgcgaggacaccagagcgtctcgncagcgcgacaagcgagaacgactcgccacnagtcatagaagcgcaccgccgatcgacgcgcgaccgcagcngcaaccggctcccgacggagcggccgcatgcgacacacgcaaccgctacgcgcgacgatcgtcctcgcgcagcggccgcggcngngatcagggtgacccnatgatgacgcgagcgcacgaggcgcgcgacggacgacacagcgagcagcgccacgancgcgtcagagaagcgagcgcaggagcagacgcccgtcgcggcacccgcnccgngcgagtgtacgacgaccgacgaacacaacgcacacacatacangnacanganggagagcggcgcgtgacgaatcagcacgcgaggcgtggcacgcacagacgccacgcgagagaagagctcagccgagagccgcaggcacgcgacgangcagcaagacgacactnagcgacacacacacacacacaccgcagcacgaccacgacagagccgcgagcaatgcgagtgcgagagcgcgcgcgccacgcagcatacacgcaacgcgagncngagaggcgacacnagagacaaanngaattacacacgacagntgacgtcagcgcagcgagcagcgcagacggcgagccaacacctcancgagtgcgacgacacagcagcacccggcgcgccgcgccgacacacacacacagcagagcagcacggatcgagcatacngncagcgcgccgacgcgagtaacgttcgacggcancacaagcgacaggcgacgcgngcgagacagacgcagcggcgacgcagcgcgncgtacgcgcgatgatacagcgatagagaanncgagcgngcacngagcgncgacncgcngcacagnggaacancagcnaagacagagatcgtgtacaggccagngncagcacacatcaanancncatcacaccatctacngcgcgctacgaccacgtgacgaaccggaccgacgcacacatacgangntnacggntcgacgactcntgcgcnagncntagcgacgcagcagcacagcagcgctcgcacngctgcgncgacgcagccgatcancganntngcnccgccgatgcagcgacgacgancggagacgcgatntggagcgcacgncgccgccgntcgcnacngatcatcgacgctcncacgacngcgcagacacagtcacntgcaacgctactcagcagtacagcgcatcngccaagttgcagancacagcatcagtcaatcgatcgctatgctcggcatcgnancagcagcagnngntcgtcgcctangacagcacgacgcngactgnatacctagcacagtcgnccngctcnganacgacgaacggancggcanagtnatcagtatgatantagt

SEQ ID NO: 19870 - DNA, 923 bp, Homo sapiens
atactccccaaccaaccctcgctgaacaaaaaaaataccctattgttactgtccccaagctgagcgagccgacctttgaagaggaggaaaaactggcattggggaagattctggggcaaactgaagtcaatttgacaaccaggagaaaagaatatgctaaggccgaatatcaggagggcctgagtgttccacccctttctacccctcgtctaccacgccctcatgccccctactcgcacaaccccattccaacacaaaaacaaaatttttttttttcaaacgttcatcactaaccccccccccggccctcccctgccccaacctctcgcccccctagcaagcatctatgcgtcacaggcggacggacgaccagccgccgcccacaaccacctgacgcccccctcgcgtcaccccgaccgctcctctggggtctatctctccccacacatcggtcccctgctcacaccatctcccgacactctccttagtccctcgaccggtcccctggcaccgaccgcacgcccgcacccctcaccccacagggccacccgcgtacacaccatcccccccacgcatgccacccgacactctcgtggtccctacaccaccaatccactccacccccaccaacccgccaatgcgcagccgcgctcccccgacgctcgacgctaacacactccggttatgcacctcatcacacaatcccatacacatccagttattgccacaactctcgccctgacgcgcacagcaagagtgtagcgcagcacctccccgcatattttactaaccctagcatgcctcaagccgcaatcgccaatatcgagagaggaggtcctaacgccccccagcgcaccaccagcctcgccaacaccacacctctctgcgccgcacctacagacaaaccactgacaccgactcaa

SEQ ID NO: 19871 - DNA, 1111 bp, Homo sapiens
  misc_feature (1)...(1111): n = A,T,C or G
ggagagaggaggaggacggaaaaagggagggaaagaagaagaagcagaggagccttagaagaangataggccaccccaagcttgcaggggagcgaaacacccagaacaggcaggaaacacgcgacaacggccgaagcaacagcggaggagggacgcgaccgcggaagaccaagaaaacaagcagaagacaaagaagcaaaacggcaagcaccgagcggcggcggcccagaaaaggacagaaagagaacgagcacgccacaaaagcgaagaaggagagcacacagaaacgacaaggcagaaggagagaaagaagaaaactttttttccaaaaggagccggagaagaacaagcaggagaacagccaacaggggacgcagaaccaaagagaagagggcgggagagaggaccagagacgaacggagcgcacagaagagacgagcgcgccaccagagagacaggcggggagggagaccgacaccgacgaacacagcaagccagagaaagggcgcaggagggaaggcgcggaagcacaagacgagggagacgaagaggaagaggaaagagcaaggggacaacggagcccacggacggcacaccagaggccagcggggaggagagcgacgcgcacggccgcgggccagcgcaggacagagagacggcggaaaagcgagaaaagaaagagagagccaaaagacgaggagggggcgccgacagacagaggaggccgagaccgcacacgcacgcagcgccgcagcaagcganagacgcggcgacccgagggcggagcagcggcgagcggggagacgagagaggcagagagcagagcagaggcgcaggaggaggggaccacgggganacgagagacagagcgagacaacaaaagagcgacagacaaagagcaacgcagcaggagacagaaatcacaggacaccgcccgccagcccggagcaccaagcggcaccgacgagaaaggcccgacacaggagcgacccagagcgagcggaacgctccggacaaagcgaggaacaggagcgacatagaggaagacagagagagaaggccaacagcgccggagaagacgaggcacacgagacagagaagcacgaagacg

SEQ ID NO: 19872 - DNA, 143 bp, Homo sapiens
taggctcgactggcttgttgatgctgcctgaagttggggttctggctgtaccagttatttaccctttgattaaaaaaatactttaattctgattgaaaatcaccagaaatgaaataaaaagacaaaacagaaaaaaaaaaaaa

SEQ ID NO: 19873 - DNA, 825 bp, Homo sapiens
  misc_feature (1)...(825): n = A,T,C or G
tcgtttagttactancggatccccncttttgtcaaacaatcatgtctatctgaatggagctctcaagaacatgccattgactaggaagactggactggaaactcattttaaacacacccatgacaaactctccacatctgataaccatcgttaacgcaaacaaacgccccatgaacggcccaacgactgaacacctacctgaatcacaatacataacacaacaatacaatttttttgacaaactacccagacaacaaaccgcctgaagacatacatcaccacacacaccacacagaaactaaccacctccgcccaccgttcccttatcccccacccctacgccatctcacaataccaaaaacacactcccactacacacccaccaaccacctcctacaacactaacactaaagcccccagaatccaccaaccccagaaccaacaccgaccaaccaccccaaaaatcaccacctcttcctccatgaataagcccagacccaccgctacaacacaacccgacctactaacaacaaaaatacaacactcaataccacacagataacccacgaacctcaacttcagcacaatccaccaccctctaccatagacacaaaccgccatcaccgccagccgccaacaacgacaaataccccacaaaacacacaaccaccgaacaacaaactaccacaaaccacccaaccaaatcccttcaaaagcaccctacaacacacaaacaacgcacacaacaaaaacccaacacgccccacacaagctaacatagccagatagaaaacaaacaccctaacaaaaccagccctcactccg

SEQ ID NO: 19874 - DNA, 1285 bp, Homo sapiens
  misc_feature (1)...(1285): n = A,T,C or G
cgagtcgggtagcatactctcgacgccatcatctgtctccattccaaagacattatatatcctatgcgggaacttaactacgtctctggcgatgttgtatattccccccgcgccctaaccagcttcaacgaacacgcactgagtcatatgactctgtgtatgtcagattcggtagcgtaacgcacccgtgagactctctatcggacgtgtcatcacgacctgacgctctcattacaccataactgcagtactacactgtccgtctctcggtctattctcctcgcggggtactcggagcggaacgaccttgtgttaatcgcttatattcctctacgctacgacggacgcctctntatcgtgccgtagccacgtcagattgtgcacatcgcagatctcattatatgaagtagttggacagagcggttagcgtcgtactctcttctcactactatcgccacgctaccgtactttgccatgcatatccgcagaccgtaacacatcgcaaccaccacgatagtacgaaatacgaacgaaggaagatgaggagaatgaggataacacgagaacgtcatagcttatgtatctactctacttccgtctgcgcgacgtngggcgtgtgaggatagctacctgtctgcgtgacgagtgaataaaatataaaagagcggcggagtgcactataccaactatatacgcgcaacgcttaactactgancagtccacccgacggattnagtagacctctcgtctcaccatctctccatacacattgtcgcatcatcacacacttcanttnncacaccacaccacactcccaantcnccaccctctcagcgcctccacactcctaccatcacccgcccttcnccactgatcttcctctccttctccacgagcggtgcgttatcattttaactntaaatttaataactatacatactcaaatcatagcatatatgaattttctcgcctgttcacgtccgttgcgatgtagtgtctgaatcacagcagattgtgtttggaaagctacggagtgttagntaccgacgnatcgaacgtaggcaagaganacggagaagccccggcgccgagcgggcgcgaagataataanataaggtgagacgacaaagaaacacgtgggtaggtacgggagaggagatagataacaaacaacaaaaaagaaaaaaaaccacaccacccaaccatcgcaacaatagaagtaatatacacagtatagaaaacacaccactaatattaaataataaaatantaaaaaaaaaaaaga

SEQ ID NO: 19875 - DNA, 860 bp, Homo sapiens
  misc_feature (1)...(860): n = A,T,C or G
tcgttaagtaaccncagatcnttggtttagtcagaccatcatgtctatctgaatggagctctcaagaacatgcatctgcttaggaagacctggctggaaacttattttaatcacacccatgacaaactctccagaactgcccaccatcattcacgaaaacaacccctagtggacggcccaaaactgagcaacaccctcatacatcacccatcacaaccacccactctgctccgttcatagaaccacacaaccaacaacgacggctgatcactcatgcacacaccaaccccctgaaaaaatcacaacaaaaaacatcaatgcacagcacaacaccccaaccgaaaaaccacaaaacccctccacatccaacaacgccaacaacccacatactactcccaacaaccatacaccccaacctttaccaccataacacataacccccacaaaaaacaccccaagacaaccccacaccgaccaccagatcgcaaatcaataaacataaccaaaccataaacaagtacacaacataacaccaacataagacaaacaacaacataccaacacacaaccccatacctactaccaccacctcaccacgacgacaactaatantaatcataaaaagaagacaacacacacacccatcaacataccgaccattaacaacaccagaagcagacacacccaacaccaatacatatcacgacgacaacaacccncacccacccacgccgacggcaccaccacaccccccaccacccactaccatacccaataaatcttacgaccaccaaaacacaacaatccaacaagcacagcaccacactggtagatacataaaatacaaaacgcaacaccct

SEQ ID NO: 19876 - DNA, 929 bp, Homo sapiens
  misc_feature (1)...(929): n = A,T,C or G
gtgaaggatactagtcagcagtattaaccaactcaacgctgaagacatggatgaaattgaaaagattgactattgaagaaagaactttattgcttgtgcacgatcctactccatgtgagaatgactcaccaggttcatgaacgcaatatcttcggagccgatgctctttgagacagaaattgtcacagaaggcgccattacgtgtcgcggtagctaggctctctgacacgaggacttacataaaacctaatcacataagcgcctctgtcaaccttctctcctttccccgtcccgcctgtctaacttccacaccaccctagaaccatcgcccactccccccttcccaccttcctgctaccccctcccttcattagtcctcatctccaccggctgcctccccaactttatctaatccccacccctccacacctcgcagtnccccggtacgccgcgttccttatacatccccaaaattggcgtactcgactcactctacgcccctattagtcgtcagncataccgcgatcctaatatgggacacattganatcgtgcacaggccccgacacgtaatcgtcacactcacccaccgacacgactacgcatcacttcgcgcttgtttctctcacgcctgcccctcccgcgcgcacaacacttactcagcacacctcgtttgcttacctgctatctgtgatggcgaatgatgttatctcgcatgtaacatcgctaaccacacgtcttcgccacccattgaagagatccatttctacgaagcgtaactgttttcaagccgataggcacattatcgcggacacctcggaggcgcgcactgccgccatttggtgatgagagagcagcgtctctccagctgcttgcacacctagcgaggcacctctcctctccgtgcgcgagaagtgcgctatgcccgcg

SEQ ID NO: 19877 - DNA, 987 bp, Homo sapiens
  misc_feature (1)...(987): n = A,T,C or G
taagtcaaatagtatagattctacaaagagaacttgcatctcattcaggcatcttgcactcggctatcgtccgcaacaatacataagctagtacggtgcanatataaccacactcgccatccaacaaatcantccaaccgtccgcaactggaacaagacaactgcccaaccgacgctgtctgtgcctccaaatacgtacggtgtatcaataacctcccatcntatataaaacgctaccatcagactataaaacgtcatcgaatagcatgctactgaagagatcgctgccccgcacaangacagtcgcggcgtacaagccccatactgncaagtagcatcaacccgataatcgtatataaccttaataggttgngttggtgagatcttagacacctctcacccaggcttcactgcaactcacacctcgcatctcttgatcagtgtgaataaataaaagaaacaacgtagaaagtctgttttaatctcggagcatccgtgccaagaggtcaaccaccccacgcccatatgcccaagagcgctccgngagttctagtcgtcccgaccacgctttgctcgcacaatgtcgagtggtaccatccgtcttnagcacgacatgtgcatcccacagcagatgcagcagtccgacgacaggcaagacactcaagagctacctaacaggtcaaacgagtatcccacgtaaatagctctcacggcaagtatccttgagccatcacgtagtggaatcgtatctgcatagcgtctcagagggtctattacatacttgcttcaggccgtgcaatgacggttattcaggtcccagatgggcaggactcaacgtcactaggcactaagatatatgccatgcagctcctgttggtgacagccttgagctagagccagtaactcgttccgcctaaagtaaaaggcatgatataaacaaataaaaacctggcctcgttggcctacagcggtgagactatgcggcca

SEQ ID NO: 19878 - DNA, 164 bp, Homo sapiens
accaggttgtcataataatcctcatagaaacaaagggggggctcgtggggacagggatccagtggatagggcaacggtttaaggagaccaatagaaactgggcttgtcgagacagacaagactcttgcgtttctgataggcacctattggtcttacgcggccgc

SEQ ID NO: 19879 - DNA, 1937 bp, Homo sapiens
  misc_feature (1)...(1937): n = A,T,C or G
ggagaaaagaagaaagnangaggagtgaagagngagagaganaggaggagaggagagagaggaagangcagggaaggagtnnaaaatatataaanagagagtgagngaggggagagaggagagagngggagagaaggtgggagagagtgntttnaagagagaagganggagnaagagagaganaagaaagagagagaagagctttaagncgagnanaganagagagaagaagcgnnagagcaagaacgngagagagagagaaaanaaggaggaaaaggaagagagaggaaaagagacactttaggnaaagngagagagagganncgnannnagagaaaggaaagaagangcgaanaagagagagaaagancagcagcgcgagcgcgcccggcgggaacgaggaacgcaggagacgcgagcgagccaggaagagcgctgacgagacgcggcnagccggagtanaacgcatcgaacgaaacaacacaacagagaattaacacgagacgaaagccgaaggagagaagagagagagacgagaggacgagagagagcgaacgcgcagagagaagagnggagaggtatgagcanacatgcagaggcgagagaacagagacgagaagcgagaaggacacnagcgagagagacagaaggaggacaacngacgancccggcgcgacgaggcagcgagcgngagcgagcaangaacggagaggcagccacggtcggcgcagngagacaccgacggcccggagcgacgaggccgcggcgcgtgacgagagcacagagcgaggagagagnacagaangacgacgcagcagaggaaacacgcagcagcgcagncgcacgtangcgcgaccagcgagacgagacgaagcgcgagctcgacgcgcgtcagagaacagagngangacgcgcgacgaagagccggccgacgcacancacgagacagcgagcagcacgagcgacacgcggactacccggacgcacacgcagctgcgagcagcgcacggacgagccacagcagacgagnagcgcagacgcggcgcagagagaggagcggcgcggagcacgcagcagcanacagcgagaagcacacgagaagaccgagatgagagcaacacagagcaagcacaagaacgacgagagatgagcagagacatacgcaggaggagnggagcgaggagagagcgcggagtcggagcgnagncaagcgncaggaggaagagaacagtcgagtacgcatgacggagacgcnagccgnacagcganagcnagcgagcgagttgagcagcgcagaagagagcagagcgtnacagcagcgcgagacgatggaagcataggagcctagcagcanggcgcaanaggcacangacgacgaggagcgacagnagcgcacagtcaccagcacgcagagcagcgcgnacgcagcctggcacgacagcaccggccgcngcgatcagcngcgtccgagncgnccagcactgcgcagncgatacacgaggcgacgcgngcaaagcgatagcangacgangcagcgcngaaaccgangcagacagcgacgcgcgacgagtcgcgagacgcnacagagaccgantgnacgcncagcacagcacgacgagngacagacgaaccgtcganatnagacnacncgcgtccanacgacagcagcatcgcgcgacgtgacgcgagaccagcaggaaagcacgccanacgcagcagccgaacggcagcgcagcncgacncgtacnagacagccagcgcagggacacgcgaggcacagcagcgagacgaagcagagcgcgcnncgcncacgacgaagacgacagacgcanagagagatggcagcgaccgtagcgcacgccncncgcanacgcacagacgtcgagcgagcanagtcgacggcagcgaaganacgacggcatacgagccanacgcac

SEQ ID NO: 19880 - DNA, 1448 bp, Homo sapiens
  misc_feature (1)...(1448): n = A,T,C or G
aggttaatacgcaactactatacaagtctaagcactatantcagcgagtacgataacagcacttgccatgctacgccacagtacagactcatgatcgcatcgttccgcgcggtctagtattcaagcgtcgctaatgttgctccagcatatcgcctgatacgatcgtaactcaattctgtgtagatacatgctatatatacgtacatggttctaactnacacataatctacatcgtatatcattatcatctgctgacgagtgtggtgtgtctagtatcacacgtagatgacgaggcctactacctagtagtacagtcagtaagactacacngacagtaacgagcgatgatccaatggttgtctngcagcctattactaatacagcatcgtcatatacacgctcttctcatagcgtcgaacaggcacttatataacactgagacagcatagagtgcgnttagtgatctgcacgtagaactaatttaactaaacatattatataccttgagcgacaagacgatacagatcgattagcatggtgcacgtgagcactgaacgcaggtgtaaggtgcgtagacgagtatacacatttatgtagtancttgagctgtatcgtaacacgaatgacactgtgaccctgtagctatagatgtgaacacgcttacgtcnttacactactcaaatcatgcaccggtcgagagtcacgctactaaacagtctcaagagacatctgagttcgcacgtgcgatagtaacgcgagcgtagcacgctgcccgacgacctcgtacaactgatacgagcttctgtctgtatcttcactcatctctatacgactgcatgcttattcatctgtctccctgcctcacaaagatactcgcacagaccgcgctactgcggcgtgtgtcacactcgacgcgctgaactatcagcgcgagcattctcagatacgatcactacattaagttctagtcccctgctcacgttttcacatctaatatactcatgagtacgttgtattcaatcatgataggcgcgtaactggcagtctgtgactacatactaatctcaataaagcaaagtacaaccacacactataccttctcntatagccgctgcgtcgagatgcactctgcacacacgctcgacccattctattttgctcaacctccaacacgttgtgtcagatataaagtaaggtataagaagtatagataatagtgaacgaacatatattatattattcaataatatatttatctctctcttcatcattctcgagtatctcttttcntattactataaccatcgttgacnccatatagatcttattatcatattagaattataagtnagaaggcgacgacagganaggatagtaagaaataaagtagacgacgagagaatatancagtacagagaaagatagaagatatgataaatgtaaaataa

SEQ ID NO: 19881 - DNA, 1294 bp, Homo sapiens
  misc_feature (1)...(1294): n = A,T,C or G
cgaaacagaagaaacaacacacacccccaaccacgaacgccaaccaacancgccccccncccnccggagctttgccaagcnngacccnggccgcgnggagagcctcagggaaggagngnagaacaagnngcngncnccnncagngcnaangngcannggnngcacgggaacgcgcaactcacaggcgcacgcacacagacgaaagccgccagcgcacagccacacacgcacncgaaacaagcagaacacagccacgcgaccacgagacagaggaanacgaccagccgcacnagccccaccaagacagacaaacgcacagaggagcccgcgaccacggacgcgcggagcgcgcgaagaaangcaaaccncgccacgacaggggcacggaaacaaaaacaagcgcagcacgcacgaagcacacacacaagagaagccccaacacgcgttatttctaactacacgaaaacacaagagagacgaaagacgcacaacccaacgacaagacgaaggaacaggcacacaaaagccaagcaccccacgacaggcgcacgagaccacacgcagacaacaaagcagcgacagggcacaaagaagaacacaaacaccacagccacgagcaagcacggacgaagaacgcacgccgagacaggcacacacgggcgcacacgaacccccgaggaaaaccccagcagaacaacgagacggcccacaacgaccgatccaggcaccggaaaacaanaacaccacgagcacaggacacaccagacccagcaacccgcgacacgacccccagcgcaccaccaacaagcgagaacgccagaacaaacacgagcgacgcaagacaagcaagcccccacagcgcaacgacacacgccaaaagaaccaccgccacaaagaaaggagcacgcacaaacacaggagcgcgacgcgagccgcgagaaagncacacagccaacaacagagccagaaaacaaacaccactgaggcactaacgagacaggcccacacacaacacaacacccggaaaacacccaacccacagcgccgccaccggaaaccncacgacacaaccacgtcacacacacacagaacgatacctcacaagagaacagaaaagcgcgaacagccggcagacaaaagccgacaacagcacaaacacggagagggaacgagccacgacagccagacacgccacagaaccaaccgcgacagaaagagagggaaacaccagaccacggccgcgcgaagacgcccaccaacacaagacagaccaaccgcgaacaaagacacaaag

SEQ ID NO: 19882 - DNA, 342 bp, Homo sapiens
  misc_feature (1)...(342): n = A,T,C or G
gtggagcgggggatagaataagagaaaaaaaggaaaagggggngnnnttgcttattagccacaagacccaatgtgggactcagacccacaacctgctcctaaaaaatgaaaacatctgattcctccaccatagtnaggggggggctacacanaaaaacntacaaaagaacatctccagaggaactgctgaatgaccacgccctgagagaacagaatcaacccccaccaaatggaggaggaggaattcctacaaataacgactgaaagacctaaaaagtattaaaaagctggggggggcaacctttggcaatgaaaataaagattgagaagctgaaaaaaaca

SEQ ID NO: 19883 - DNA, 1222 bp, Homo sapiens
  misc_feature (1)...(1222): n = A,T,C or G
ccgcttccgctccgtgctcctcccgctccttctggtctgcctccttctctctcgatcgngcgagccgcncgtcgcgggcggcgcgttgtntgcggcggcttgttcgccgttgttgcgtcggaccgcgtgcgagttctcctctgcgcggctggtntcttcaccctctcgctcgcgtcatctcggattgtccgtgtgctgctgctcgtcgtttccgcgctcctgtttttgtctcgcggtgcgtcctggcgtgcgtctcgtcccgcgtgggcggcgctgttctcgtgtggtcgcggccgcgcggcgtcggtccgtgcgccgcgcnctgtgccgcgcgcgctcgtctgtgggcgtgcgtcctcctctcgccgggctcggctctcgttctactgctcccgcgcggccgcctgcggctgtgagcgtggtccttggttgtgggtgtgctagtgtgtcacggtggctggcccgtcgcgcggctggtggtcgcgcgtcctcctctctcggcgcggctcctgcctccggcgcgggctcgcgtgcccggccggtccgcggcgctgcgcgctcttgtccgtgcggcgtctggccccgcgtccggcgtgcgtgctcgcggcgttctctgctgcggtctcgtccgtttggcttgtgtctcgtcgcgtctgttggtcgtgtctgttgtgccgggcgtatcgttctgcgcgcggttaggtgcgggttcgtatcttgtttgtcttcttttctgatctcggcgggtctctcggttcactcgcggtgctggtgcgtggtgccggggtgctgcgtgcctgtcgcttcgcttccgggctccgtgngtatgtgcctgggtgccagagagatgtacttgctgtatgctccgtgtttttttcttctcctcgctcgcgctcgctgcggtacgttcttgttggtcgtacttgtgctctgctcgcgctcggcgccttttctccacttcttttcgctccgctttgtttcagtcgctcttgccgtttgtgctttgccntngtgtcgggtgctccccccctttntctcttcctatccttttgtcctctcctcttnctaaattttctcctttttttctctccccngcttcctgttcccgcccggttcttcctcctttgagccttctttnttnntgttttccccctaaggtttctccttttcctctccctacttttccccctccctccattnttttttttttttttttnnttct

SEQ ID NO: 19884 - DNA, 1630 bp, Homo sapiens
  misc_feature (1)...(1630): n = A,T,C or G
actattgagagctagatgagnactatcacatgcacatgangtgactgtgtcgaagtatanagccgagangcgcatgngatgatgacngtgacgtgtgctgaccttactgcggcgatgagntgaatcgtgcactgatgtgcntctcgtgagtcgactaactgtcgacaatgccagcgaggtacctcacagacacactncgactgtagcagctactcacatcagtacatctctacgcagngtagggacgactctaccgcaacgnacgtcgtcgccatcgcgtggcagtcgctctagtctgtnctcactcgtgtgcgtgatatcccctatgngtnagctatgatcaagntgactcagcgcgtaactctcgtatgtacacacatagtgaggagctctactnttcanatnangngacactagatcgctctatctctacttcatctagtcactngatagcttatctacctngagacntgctcgtcgattgagcgacatcatcacgcagactcaacaccgcagagggtgntanctgagagactgaaanggagtatagacgacccacagcgcgaacgcacgcacgcgacagggagagganagcacgctcgagcgcgaaacgagtctgaccacatntcacgcangcaggannnggnacnacacctgtctgagagagcagaaggagngnaagacaatatagcatantgtgtgtgaggtaacttgcanacgagtacgtgagctcgacgacntgctcttctacgtagcatgtnanccagctgcgacacgcactactgatctcagncacatntggagagcacgtaaatgacgcgcgaacatacgcggcaacatcanaagancctgatctatctcanctagtagaaacatgananaaaagacatanaataataatacactgagatgactgtatgatgacagganaantaacgcgtcaacantaactcatacggctccgcgagcatcagagnaacaacacnagtagcacagagcgccgacgagttccgtatnatatatattgtgtgatggtgccgcgcactctatctgatgcgacacgatacaaagacttacgannnnacatcgaccgcaagtgtgtcaacgtacttanccacataccaaccacgagtgaaacagagggagtcacgagcaaatnacaactacacncctatagacactcagtacagtgttgctcgtcggcacgacanaaactcgacagcatacaatcgtcnttcaccgcggttatacacaccactacttggaagccacgcagagcccaatacaaganncaccaacaacaacacatcatacnnctctcacgtncactnttaaatattagatacaaactannnaactaccctctgattctctgttatttaattaaataatataacataaatccaatatattatacctctaacatctattnnaataaccctatccctcctactccaccctccnccaccccncctcccccatccaacatcncnannnnnncttcnnncactacaccncccccccttacaaacccccatcccccgnncaattataaaaaaattttnntacataaaatttaaannnagnannnaaaaagagaagaacttntttgtgttttataaaatttgtc

SEQ ID NO: 19885 - DNA, 1054 bp, Homo sapiens
  misc_feature (1)...(1054): n = A,T,C or G
ccgcggcgggtggggcgttcctggtcgttttcgctctttctccgtgttccggtttcgcctctctctcgtgcgccgtcctgtggcctcgttgtggtctctcggggttgtccggtcgcttcttcttcgcggtgtgccctgtgtttcctcgcgtttctcgcgtgcggtctgctctttttgctcgtgccatgcgctcgttcttgccgcctgctgtgtcggtgtgcggtgtgtccggcttgttgccggtttcgctcgctctgctgttgcgtgtcttctcgggttttgtgtttccgcgttctcggcgtccgccggccggtcttnctccctccttgttcgctttcctgctcgggtgtcgttggcgcgtcggttccttctgccttccgatggccggcttggtggtgttcgtgtgcgttccgtccggtgtgtccgcggcgggttgcggtgttgtgcccccgtcggttgcctcttgggccggttcgttccgtctcgccgggcgctgccgtgttctgggcctgcgtctgcgtgggcgggttgccgtggtgcgcctgccgcggtgcgcgctctccccgccgtggctgcgccgtttgtcgcccgggtgggtttgtccggtccggtgttcctcctggtgggggttggttccgtccgctctctccgcgtgtctgtcgtcgtggcgcgtggtctgcgtcgatgcgtcgtcgctgttcgtgggtaagaacaagcgttgtcgcgcgttgtcggttttctctgttctttcntgctgtcctccttgctcgggcgttttctgtgttcgcgtgcgtgcgcgtgccgtctctgtctcgtgcgtggtttgttcgccctgctgtcgcccgtcgtcctggcccctcttctcctcccttcttcgtgtcgctgggctttcgtcgtggcgcttttacacaagttttggcgtttgtttttgccgttccgttcgttatgtgtatggtccttcgctggctttacggtcggtggttgnctccgtcctttctaggttcttttttttgtgtttcgcgctgtctgctcctccgtcctgttcgctgtgcgt

SEQ ID NO: 19886 - DNA, 751 bp, Homo sapiens
aaacatgcaggcttgtttgtgcatgtcagtgagtaaatgagagtggattctttctttcatcagcatgatcagtgcaacttgaacaagcacttaccacatagggattcttactattactcagtgtgtggctttctttcccccgcctccttacctcccgggcatagacacatgcctatctcattccctgtcgccaatagattgcacacaactctggaaaaagggcagatcgtttgtatctctgtttaccccatagtattcaatagatttacaatagaagacatctttaaattgtatttcccaaagatggttgcaccagtgtatcccaatcccatatgctgtgtgtactgtatgatgctgacagtcttcccattctcctgaatctgggtaggccagtgactaaaaacaaagtgacactatgtgacttccgaagttaagttataaaagggcaacagcttccacctcatcctctttgaggtgcgtgcactttaaacccagcctccaccctgtgaggaagcctatggcacatggagaggccatgggtaggtatgcccactgacagccccattgaggagttgaggtcccagctacgagcttccaacaacctccttctgacatgaatgggcctcactcccacctttgaacggctccagttcctgcctataaaacagacttcccctgctgaaccctgggcaaactgcaaacttgtgagctaaataaatggtcattattattttaaaaaaaaaaaaaaaaa

SEQ ID NO: 19887 - DNA, 875 bp, Homo sapiens
  misc_feature (1)...(875): n = A,T,C or G
ccgtgtctcggccggcgtggctacggccgctgtgcgtgtgtgcgtgcgcggtgggccgtcgattgcgggggcgcgtgcggcgccgcggccgggcttgtgcccgctggtgcgcccgcgcgcgggctcccctccttcggccgcgtgtgtccggtcgtcctcttttccctccgttccgtcgggcgctcccggcccgcccctcccgcgtcgcgctccccggctctgccgtcctcgccgcggcgtctgcgtgggtcgcgctttgcccgcggttccgcgcgtgttgggcgggctgctcgcttgctttctggtcggggtgcccccgtgttgcgtgcggccgtgtccgtgtggcgttttgtgttgtgcccctggctcgggtgtcgggggtggtccgtcctgtgccgggaggggtgggcgcgcgctcgggtccggtcgccgcggccgctgtggcgcctgcggcggcggtgttgggggtcttgcctcgcggtctgggtctgtggcctttttcgtcgctggcgccctcgggcttcggtgtcggggcgtgtcggtgcgccgcctgggtctcgggccggggcctcccccttttgctggggcgccggaaaaacggttttcctggtgcgcccggccgtgggtcctggtgccgtgtgctgcctcggttgccccccggtttgtgccctcccttcgccgctccgtggcgttgttttgctgtggcttgttggttcgggctctccgccctgcttgctggggctcttgccctgtgctcatggctgttccccttgtgtgcncttttgttctggtttcgccggccacggcggggncgtgtttcccccgaggttttctcttttgccctcccctctgctgtccggcgtcttgtttgtccg

SEQ ID NO: 19888 - DNA, 745 bp, Homo sapiens
gccagagagaatctgccaaggtcatgagctgcttcagccaagaggtggaagagaaaactatgtttttaatctgcaaccattgacagaggctcactctccaagggagacagtgaatgaaaagcccaaagaaggctgactaatgactcaatgttatgcatagtaggagtgacatgcttggcctacctgctcatctacaacctgactgagtgcatcaccagtgtgaccacctggaataggaggacctcaagccagacaaataacaatgaccatggatggacaagagaaagtgatgaagactctgttgttggataacttactgacagcgggggatgtctagatctcagagagttaaaaagaaaaagaagaggtaaggtaggagaagtggtacagtatgggctctggcatggaacctccagagttcagagcctgactcggctgcctctaatattaaattaatcaggacattaataggaattatccaataggattacagtgattggatgaggccatgtttgtaagcagagaatagagccgagcacatggttcgtacttaataagtattccttattattaagataacacattctttctttatatatcctatggaaagccatgcacactctgctatgtacctgcagaggacaaaactaggaccaataaatgaggttacaaagagacagagttaaattcaagagaagaaaaaaaatgaataaagtttgaaatttgtgaaaaaaaaaaaaaaaaa

SEQ ID NO: 19889 - DNA, 732 bp, Homo sapiens
atgagaccttcaagcttcagattatcatgcaacaaaggttccagccaattccaggtgaagacaccgccccagtgccatcaagaaactactccacctccactagacagaacaggatgccaagaacctggacaccctccaccattaacaatgcctgtaataccagcactttgggaggctgaggtgagtggatcgtgtgagcccaggagttccagaccagcctggacaacatggcaaaccccatctctacaaaaagtacaaaaattagctgggcatggaggtgcatgtctgcagtctcagctactcggaaggcttaagcaagaggatcacctgagccagggaggttgaggctgcagtgagctgaaatcatgccattgtgctccagaatggacaatggagagagaccctgtctcactaagaaacaatcattataagagcaaattaaataattgagatcatatacaccatggtctgtgaccatactggagtcagattaaaatcaagatcaggataacaagaagtcctccaataacttgcaaataaacacctgactactataagatcaatgagtcattaaatactttcttgaattgtgacgaagaatcgttgtccttacattagatgaacaggtatcggcggggcgataacagtaggtagtcccctctctaccctggcattctgctgggatggtggtggacaatcctccttcacttacgagaggagctctgactttgg

SEQ ID NO: 19890 - DNA, 351 bp, Homo sapiens
gctattccccacccatccccccatctccaacggacggacgaacctcggggaccatatttgctcttgaaacgagaacaccgtctcacactgaaagtttcctatcgtgaggttcagcgtcatctagagtcaacggatgaagcataagcgttcactgtggaatttatacaacacacaaagaagaggctcggccaaacaacatccactgaatattgaacctcgccccttccccattaaaaaatcccacgcaccaacaaccaaaaacggccctccttttttctcaacgagaggacctctgcaggcccacaacctttactcgcgggctacgtccaccatcctacatcccctgcctac

SEQ ID NO: 19891 - DNA, 946 bp, Homo sapiens
  misc_feature (1)...(946): n = A,T,C or G
cttccgcgtgatcgtgagtcgtactaagcnggggagaccaagatcataggaactacaaagctaatcccatttcatactggtgaaaacatctcgagggcttcctttttgtatacctgtattaagctctttattccactgctgagttttttgaccttgacacacaaatcttaaaaaatcaatatccaagctatactgctttgacctaaaaatctggttatcttctcttctctttattgtctcatctttcccttctctatattctttatcttctgtagctccaaaacaccccctattactgagtaaaacacattttgatctattgcaaagggaatatcaaatttgctacttcacaaatgactatacttactcggacctccgtttgcgcccttaactggttggtaccctctcgcccctcctgctttcttattgtagcatcaggacgtattgatcaatgaatactcaagcatatctcgtactcagatcgtgcctcaggttcattgacgcgatattctgtcctatgtataatatattataattacatatatgctgcttctacactggctttttctcacaacactccatagcggattctcttaagagcaacgaatcctacgttactctacgcatgccacacctttatcgctcttgatacttatattgcagagtattctctctcatagatgctatatcacatagacattcataccttctacgcactaagtttacactatatacaaagacacccttaagttctgatagatgctcacatcctccgacccgagatacaagactacatccaattgcttattacgcttctgactacaataacatgtatagttgctccttctgattgcgacaccaagtacctttcctaaacttatcccgtcccacccgtatatactctgtattacacccacccacttctttccttcctcgtatctgcacg

SEQ ID NO: 19892 - DNA, 747 bp, Homo sapiens
  misc_feature (1)...(747): n = A,T,C or G
cttaaaaacctcgggtggttccgtccatttccccagcagctttatgaacattcactgtcccataatctccccgctgattgaggcttacagcacctactttcacagaggaaataaaggtgctaatgcagccaggaaccacaacaggagcaaagaggggcctggccttatgcatggaagctgaaggactgaaatttgcatntgatcatcttcaacttctggcacctgttgtcgcagttttctgagtgcccactgagctatccacaagctggcctcctctgaggagtacaacactcccaaactacttctctcagcttccacctaactctgcagaactcccttcctttagcgagaccaaacttagctagcagttagaggtcacccaactgtgccaattcctactaaattgtaacagaaagcccccagacctctgcaattgaaaaagaatcagccatacttaccaccactagtacaagaagaagggtccacagctagcacagataatttgtgccctctctcagtaagcatttttccaaaatattctataaatgttgattttccagcaccagggggcccagacaatcctacggtggaaagagatcttctaattcaatgaaacaaatgaagtcagaactacgatcagttttactgagtaaaatattagactaccttctatttcccctaagtgtattaaaaccaccaattaatatatttcaacatgtcctaaaatggcaaaaaaaaaaaaaaaaa

SEQ ID NO: 19893 - DNA, 1759 bp, Homo sapiens
  misc_feature (1)...(1759): n = A,T,C or G
ctgtagggtanggagggtcgaggagatcatatataatgatacatgtatgaggacaangagtcgcatatatggagaatcgacatcagaccagcacatggtgaacatagtgctactgtggcgcgctcactgtgagaggtacatggcgctcgcangcntatcctgtgagtagtagtgatctgcgtntggatgactgatgagacgtaccgcatctgcgccgagcgcggcgctgctgcggcagtgtgcgtagcgagtgcangaatgacgcactcgacgtagtataggcgtgagtgtatgctgcagtgataactgtagtaccagcgcgtgatctgagttgagangaggnacaatgtagagtgatctacgtgagaggactgtacagatagcgcnagactgtcgtcacgcgattgaacgngagactcggttgacacttgtagcgacgcnagagtcncatgtgtanacgatcngtttaangagagatacacctcaatgtagnaagtatgagagggggacgctcgcgtcgcgtcgcgatactataggtgagtgtctatcgagtgtgtgcgcatggatagatgatgctgcaccaatacactgaaagtactagatataactgtacatagaatctctctactctatgtgtacttaatccattatgatcattgtttctgtgcgtctaagtagctantatcatcatcagttcnattcatcgtaacatntntnaacacatgtgagcnanaacagtgagacacatagaagtcgggtacgctgtcattacacgtaatagcacgacaagctatataccgtacagaatcaccatcaatgtaagaagtactgagangagaanatacgtcgagacactcgagaggagacgtcagtgaagtactagaagcagatgntnattagcgcgcagcaatgtagaangttgagcacgatanangacatantatcatgtatagntgtcgtcaataacactacatgatcagacgagactgcgatagagagcttctgaatatagttgtgtgtgagtacatagtatatctataatactttgagatngtcagtgagatagggaatagtatgtgatgtactgtgaagttatantgtctaaatgctctgtctatgatagtntatacttgatagtatntatgtatcgactatagacananatgatcactatatgattataacattatcgtanatatacgtcaatacaatgcatctacaatctngtcctctcatnttatatcatatcagaacntatcgtcacntatatcgaatatctatagncactcatatacaattacatctcaataagtagcagccagtagagatcattgctaatcctcatgnagatttgtacgctgaccaagccacgtctctgtagaggacgtgaggagcgtctatcgtncgttgtgtgcgtcgagtcacagaggtgatacttattcatagtagataatcggtaggtatcaatatgacctgtcaggggcgtgggagngcgcactctttgcagtctcacactcagacacacacaccatcgctgtcctctaatagatattataccaatactaacattacttctgccctagttgttcataactcatgtgttattttgnnggtgtctcgcgtggtgctgtgcggatgctatncgcacgacgacatntacatgcacgagagaacggcagcacactctgaatgttatcattctagcctgtctcaggatcgaactcacantaccccgacgcgctcatctcgcagctctcca

SEQ ID NO: 19894 - DNA, 329 bp, Homo sapiens
tcaacagttttttgaaaaatccatcttcttacagcttttgaaggctcatgaaaatgctttagaaaaacagtacagtgaaattacaaaccataggaatatgcttcttcaaacctttgaggctataaagaaacgaatgataaaggaggaagacaaatttattaaggaaattacagactttaataatgattatgaaataacaaagaaaagagagcttttgatgaaagaaaatgtcaagattgaaatatctgacttagaaaaccaagcaaacatgttgaaaagtggtatgaataaatatcacctcatttgtcttgcaaaaaaaaaaaaaaaaa

SEQ ID NO: 19895 - DNA, 878 bp, Homo sapiens
agtctaagtacattcttacctccataagtaaaatacaataattattgagtgtaactccaaaaaagcttgttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattagatgaataaaaacaaaaatattaactattattaatataagactatccccaaattactacttatgtatatctaacacaacatgtggccctctttcgcctaaactgggtgaattttgagtctctttccttttgttgggggtaatttttatattcttggctaacttttttcttaacttagacattttcactgtaataacttctttcactacccctcacacgcttaaattatactttctcctctattaatgctttggcgtcgaataaaatattgtaacattatcccaataaataggtccctctctcttaatatagttctcttttttccctcttgttcaatttgttttccccacttaaaatcacttacaaatattccctttctaatgtggggttggttaaatatcacggatttattaaataacgctgtcttacccccgaaaattaccctttgactatccatttattaaaccacctcccactagaatcggctccctccattaatcttaataaaaccctccgtcatattttaaccatctctctaatcccttcattcgtg

SEQ ID NO: 19896 - DNA, 1168 bp, Homo sapiens
  misc_feature (1)...(1168): n = A,T,C or G
caaagctagaaactgcacactaccgagagaccacacgccgaatcggccgtatcgacacatcgaggaccgctcgacaccctgcccaacttacatagtcccatcaatctcacactaacgacagtccgagagtaattaaatcatataagcaaaaggtatgagcgcgagaagtcgaggaacgcgaggtgttggttgagaggagtaaggatggctgccgttgggaggtgagtgagaggtggcggattatcgggctgtatgacatcctatagggataaatattttataacatgggggcaacgagagacaataaagccatccgtctggttccaccccgcatcgacgaggctactgggcggccgcagcagggatgcgaatcgaagaggcgcacgcgtagtgaccaccagggacatctggtcctacagcggcgctaggacaccacgaagtccgacctgccccacggttgacgggacaaggcctgagcacctacgtacggacagctagagaacgagatatctagaatagcgccagacgggaggtgtgtaagcgcaccgcagcggcgagacggctaggtcacacgtcggctcgcgcagcgttcggacgagtcgttttctaccgcctgtcgtggcgtcgcgcgtctcgtgcgtgcgacggagtggagatgcatgctgggagtgtggtgatggagtggtatggatgagtgggcagaggcgggtgagtacgagtgcgggtggaggtacanctgatgtgcatagagagagagatcacagcatgagcacacatctccatctccgagcgctccacctctggtaacagtgtgcatcagagagtatcatgtgacatcgtgcagcgtaatccgcacacgcagacgctancccgtgcgcagttgccactatatacaacagggctggcgtgtgctaggagcgttggcgagggtngcatacatgtggtgggagcggccgctcccttctactctctncgcggcgccgttgtcgcgcttgggtgatgcctcgactaggaccattatagtctttcacttggcacttgattcgttcctgctcgtatngaccccttgaccttggcgcgtgcccgcctacgtggaggaggatgcgacgatagcggaagaccgaggtaacaatgacagacgtgagaacccccactagacttcggcaga

SEQ ID NO: 19897 - DNA, 734 bp, Homo sapiens
ctcgtatgtcgcagcttctttttgcctaatttgtattggactgactcgctccctccggggggcaaatcatgtgtttaatagggccggatgacacgttgcgcggtgtctattgtgtgcggttgtcttggaccgcccggtgtaatctccccggccgacccggtgcggttaataagaggccttgtagccgcgctccctcaatatcgcccccaaatggttttgctgcgcgagccgtttggggtgttcgagcggggtggaatcccgtgttagttttactgcccaacggggcccttcctgcgaggaggttctctgtggcgaccttgtcgggtttcccctcccttattgaatagacggtggtgagtggtaggaaggccccacgcgataggcccgggggccccccctcgcccctggtcgcgcgttgttcgtcttccttaaggcctgcaagggtttcctcccacgaaacggtttattattatcccccccttctttatctgccccccaccccattggagttgcctaaaaagccgggttgggggggggccagcgtggaccccttttggcccttggtttagttgcccaaattgggggggggagagtgggaaaagagcaaataaagaaatgggcgttttttttcggggtgaaaaacaatgcttttctcattggtctttggaaaagaatagggccctccccttttccgggttttttgtttttttacaaaggggttgctgcgaaagagg

SEQ ID NO: 19898 - DNA, 148 bp, Homo sapiens
  misc_feature (1)...(148): n = A,T,C or G
ctccgtattatcactgacaaaaaggccgtcncgagaaaacaagagaggaacaacagctaccaccagcgagcattcgtcaaagccccgtcctcgcgtccagtcctcacaggcttcgcagtgaaataaaaaagtggcctcgttggcctca

SEQ ID NO: 19899 - DNA, 301 bp, Homo sapiens
ccgcgcccacacccccaggggcccggagacgcagggggaggttaggtgttacagtttgagccctgcccatcaagaggaggggtagagctaagaccatggccctagttgacatccagttggatcaccatgaacgatgtgattgtgtgtgcaggtgaagaccgcctggatcagagaatgagcccatgcttacattacggactgacagaaccttcagcgtaacgagggccacatgacacaccctcacgcgccgagctggcgggcccacttctttcgggcgccgcgcggccgccacacccccggc

SEQ ID NO: 19900 - DNA, 1042 bp, Homo sapiens
  misc_feature (1)...(1042): n = A,T,C or G
cgcgcttgtcgtgtacaccttatccgcgagcgcatatttatctatacctcgacccccggagangancaccactagcccctatggacttttttttccgcgatatatccatcgcacgtacgcctcgcccgcgcccnataggcgcatgcggagtttctccgtnggtggcctccaccagccaaggcgcgcggnnctctccctcacttcccccatatgaactgtctcnacctccctcgagaccctggcccgcggcgccctcgcgccgcgcacccgtgtgngatcctccttccggcgtgcgccgcnggcacatctcgcttccaccacttccgggacctcttctggcttacatatctggnccaccacgagaaggtggtagacctcttctcgctcccgtgcncctgctcncccttggacccaccatcgctcacctcttggtaggcactgtcgttgtagagancggccgctcggcgcgcgcagctcgtccgccctcccaccccctggacctatctctcngaccatcgttactcaataccgagnacatanagcccacaagccccggactatgagccttatantccaacgaccgcgtgcgcggttaccgtagagacgatataagcgcggagatcggagtccgcttaaacccttgtgacccctccttacttaaccagctgggtggttgatgaaaatgatctacacacgggctttttcttgttgcccccttgtcccggcttcgcgcggagcaaacttgactatcggcccacgtggcgcgggcatgacatggggtcgggtcgggctttggtttgctttggcttgtgtgtctctatgttgctcctanctagcgtctggtgaggctttgtactcatactttatctcaggtatattactctcgtccccatccctccaccctcccaccccctccccncccccccccccctcctnccactntccgccctngcgccccccacccccncccctnccatacnnnacttnnntccttaacttaatataatnatacgagccaaaaaattcaattacagccgttgcg

SEQ ID NO: 19901 - DNA, 927 bp, Homo sapiens
  misc_feature (1)...(927): n = A,T,C or G
ctttgttgtcctcttttcgtcctcgcttttacacctcaatctgagatgcatattacctgatgctaattggcgattataatataccgggacgactgtttagggactcgattcctccgtttgaacactataacgcgtagtggacgttcgcgacctgccactccgagttagcgcatcatatcggaaccagtatcagttaagacatctctcaggatgagtctagcacgtcgggtcgtccggaatgtaagcttcgggttatcaagaatcatagggctagcaaacgcgggggtggacgactgacgcactatgaacacgggccgtagtgattttgtagtaggtgtgcactgtagaatagatatgtactaaagaggaatcggttgtaatggtacttgctggaaccctctggaggcttgggttatgttagatggtaacgaaaaaaccatgtgacttttggcactccccaggcgggacggcccggatccggtggtgggtgctcgttagtctctgagcaactataaagctccgccggtgcagngtattgtcgtgtgctttcattgtacttcctcccgtttaacattctaattaatataatagaataatctaatataacactgaatagttttgttttattaaaatgtgcgtttggttgttgaaaataacatattatccacaggcattgccccatcgatgacacctcgcggcgtagaaggaactaaaggtgagataaggtggtttgtgttcatggctgtnatcaactccgcaccgcgcngcgggctgtcgtaagtttgtttnttttntcgttctccgcatttttttggtttgtgtgttgctcgtgcgacgttctttcttctgtnttcgttttaaggttttccttacgatggtccactttttataatgggaggtatttnattttatattatattattaaag

SEQ ID NO: 19902 - DNA, 856 bp, Homo sapiens
  misc_feature (1)...(856): n = A,T,C or G
gggggaaaagggaagtnnaggaggnagaggggnagggnnagggtgnngtgagannnatcgaaggccgtacgtgtctgtatcaaccggcgcggtctgatccggagattggcctaaatatgtgccgccagtgtttccgtcagtacgcgaaggatattggtttcattaaggaggactaagtgctcttctcttcagaggattatccgcgggcatatactcaatgaaaaaccaagatgattcttcgtgtatcaaataaaccggaggcctagttggtctcatcggaggagctatgaggtcggtgtcctttagcgaggtgcactgcactgatcctccccgactgactgcccgcccctcgctcctgcgcccgccgccacccgcgagcgccccctcagaggcgcccctcaccgggcctcgcccgctccccgggtcgccgccggcgcgaacatcgccacctcccgcccgcgtgttgccagcaaccgtatagcggctcacatgttccagcgctcctaccatagtcctcaanactcccggagggtctgcttcagtgctagagnatgatgcacgcatgtggtncagatccgagtcgtaagttccagcacgatcgtcagagcgcccnccccctccccggcctctgctacagccgtgccgccccgccgccgcacccccaatcccagtcgcgnaaccaggnctcgccctnncaaagactccccagttttacgtttacgctcgccggtccacggctncctgaggctgggatccatcaagacgcgcggcgagtgtcncccgcccgccgtcgcctctgctccccctggcnacagaccgtaatccccgcctccctaccagcgctcacacctcctac

SEQ ID NO: 19903 - DNA, 965 bp, Homo sapiens
  misc_feature (1)...(965): n = A,T,C or G
gaaagaatatagaattaatataggatatttctcaattagtgatagtaactaggtagttcaattggccacggaaaaaatatggggtgagaaaaaattcgggtagtgtgacagaagaaggaaaccaagaaacggtaaaagacactgaaaatgaacagccgcgcgcggcgaacacgagacaaagaaggaataaaaaactaagagtgagttgaaatagtgagactaagtataggtggatgggaagagatgagtagatcggtgatagagctgagatatgaaatgtagaaaacatagtaatatcgaagtaatggaaggacaagagtcagtacaatagggacaaacggggcgtgtgagaggcaaggtagacggattctccaagaaaaaaaacaccaaaatacagaagaagtaagtacagggtgtagaagatggtggtaagggggtggtgtataaggacggggagtaggagtagtaagaggtggtggtatatattaaaaaaatatgagcaagtgaagagataacaggatttataagaactaataataaaataaaaaatgatctcggagagttctttgttcattgtgcgggcactggtgttatgaattttatatactctgataataatattatatatacacaaaaatacagcacattcaaaaaaatagatcccgtctacagaacaaccaaaaatatatgnngttgnaaagaaaagaagaaatcataaagagcaaggagtaaatacataaaacggataattgtcctgtacgctctcaggaaaaaaataaataaaaagtaaaataatgaataccttgccctattgctgtgttttttcttttttgtttcaagagtcctccctcccgttgtctcgtatagttccaagtactatcatccacctaccttcgttctaaagggcgatgataatcaaaaaaaaaataatataaaaaaaatttattttttnnaaaaaaaaaaaa

SEQ ID NO: 19904 - DNA, 246 bp, Homo sapiens
gctagaatgagacaaacagttgtctttaccatcccagacaagcagatgaatggtgaaacgatacagcagagaaagagagaagaggaacatttgaacgccgagaggagttcagccgagggtggtcggagaggtttggccacccagcaggaagattatcttcccgtgccatccccgcttccagctctgcatccatccttcagagaaccccctccaccactcaataaaaccctggcctcgttggcctca

SEQ ID NO: 19905 - DNA, 306 bp, Homo sapiens
ctaggggcctgctctgtcgcccatgctggagtgcagtggcacaaacacagcggactgcagccttgacctcccaggctcatgcaaccctcccacctcggcctctcaagaaactgggaccacagcccccacctaggaactgactcagagcaagaagacagctccgactccctgtgatttcatccctgaccaatcagctcttctagctcactggcttcccccaacccacgaagttgtccttaaaaactctgctcccgactgctgggagagactgatttgagtaataaacaactggcctcgttggcctca

SEQ ID NO: 19906 - DNA, 182 bp, Homo sapiens
gacacttgacccactcctacgcacatgcatgcttatcaaatcttcaatcaactctttcttctttaggaaggaggtccttaggagctgagaatatgtacctgaaagtagaaaagcggaacttcataagatcaccaaattagtttcaggttaattaaatatcaataaattatctttaaaaggca

SEQ ID NO: 19907 - DNA, 903 bp, Homo sapiens
  misc_feature (1)...(903): n = A,T,C or G
catataaacacacccataacaaagacacgcaaacgacccttgtgtggtggaccaaggcaagtgncttcagatagctgccactctgcaagcagttcttaatgaagtttgtaggcacagaccgctgaatgggggtccctttgtggtacgtgctttccttcgtagttcaacaagctgaaggctcacttactgaagattgatccatctgttgcctaaacaagtgcacactgaccaatagggaaaaagaagatgcctcaactgtggcgaattgtgaaactacttttcacggttcgaagaagcaatggagaaaatgatcacacaccatacttcttacatctgatgtattgccattgatcatacttgaaagcgacccctaacactcgaatctctctctgtcctttgcagattcacaaattaaattccctctgccgctcgctcacacaagcacaaatataaacctacactaactataagaaaataaccaccctcccccacctcaccccttaattcaagcgttcatatgccaatcacacctcgtatgccctatcgatctatctcctatctcatgctgtccagaatgctagcacgatactataccaacttaataagagcttacccgccgccagatccattctccaaaacatactctcaactctacctgactagcgacaccacttttacatatctaagacctacattataccccctcactcacatcaccaccgatgcaggaccccaccgctaaaagcaacacgagtcaaacgaaccggtagtaaagtaagatccatgaccatcatgcaacacccccttaagacacctttatcattcaatctcattcatactttgttctattcagtataagacccaataccacccaatatcacaatcacacaactcgataaacaa

SEQ ID NO: 19908 - DNA, 1334 bp, Homo sapiens
  misc_feature (1)...(1334): n = A,T,C or G
gggcggcagcgccgcgtggagaacaattgttgagatgtcgtgannaccatctggcgtatcgngaatgtctgtctcgtggttactctcgaactttctctcatactatagngattaccgtgtctgtgtcatccacgtggataaatcatcctgatgtgagcacattgngcgtgtatcgnctgctagtgctcgggngtcacctctctaggngnaatactgttgagtcgcgaggttgagaacggcgtgtgtgggacgtgtgatgttgcagggngccgcgttgtcgcagtcatcggtagcatatccgtcgctatnntgtgcgctgtgtgtccgcggagccagtgaacgtgcgcggacaatgctggcggatatgaacttgattatactatgataggtnacnctatataatcantcgtaggcactctgactatcatgattatttatcttttgnnactgtcgtctgcgacctatacatatcacgatgataccatagttctcatctgctcactacatcgncgcgtactnagnatcaaatatatcacacgtatcgtactacgnngacttaatanacagtgatncctccacgtgtctgattctgcgantanatcctatatgtatancatagcctacgactcgttgtaccactatagnacacttcagcagatgcagaaagagacggatcatgcgannnaccgtttgagggtctgagcgtggtctcgccggtctgatgacngcttgtagngtacactggtttcatcattcgccgagcgngnctgttgcacatatgnatctcgaactgngactcaccactgtcaggcgcactatgtgggtgnagtctctgaacttatatggctctagcaatggatcgtaagataggtgtactatatccattaatattacgtaatcactanttaccgtanatcgtatacttactctattatcatatcaatcantagtaatatatatgacatatcgtataaatatatcacatcctatacactatctatatgttgcgctctatctctgtntcttttacgtgtacgtcgtaaagntntatcacgtgagtgcggagagtnacgttcacataatgagtatcatttctnaaataacannnaaactaaatnntcacttccatccacgcactctcttccacncgatcctccacctctcctccttcngcctccacatacttcctcttccataatnnncactaaccctaaccttncgtncaccttctnnctncctcttnnnncatcttccacttntnnctcntcnnnnnnnnncntncttcnacttttnnnnnnnnnnnnnnnnnnnnnnnnnnnnnnnnnncccttatt

SEQ ID NO: 19909 - DNA, 412 bp, Homo sapiens
cttcagtggtcacttttactgggtaggcattgagtgtccaggtttggataacagaggcgactcttttggaacagggaaagctgtggtgaagaaggcaagtcatatccatgttgtgtcctggcctgataggaggttatcagcaagaaagggagaagtgtgtatttcctcgttcacttacacgttctcaatgtctatctattaataccctcaaaccagtgactttcattcatgtttataaataaaattatatatatgaataccctatcaaattaataatgattatttctgtttactggaattatggaatatttttccttcattttgctgatctaaatgttcattgatgattgagataacatgtttttcagaagagaaatattaaaagcacaatttttcttgaaaaaaaaaaaaa

SEQ ID NO: 19910 - DNA, 464 bp, Homo sapiens
ttttatgagtactttttctttgaagttttagcggtcaatttgcctttttaatgaacatgtgaagttatactgtggctatgcaacagctctcacctacgcgagtcttactttgagttagtgccataacagaccactgtatgtttacttgtcaccatttgagttgcccatcttggtacacactagttacattctttgtttgaagtgcccctaatttaacagttcactttttacagtgctacttactgaagttattattgaaatatccctgacctactaaaaacataaaataaccaccttataccgattctactaagttccactcaccttcttgcatctatttacgattattttttcgctcgtcatacatttgattggttattgtattcgccaatttcgccgctttcttttttacacacctccccgtctttttctagctctgcccccattattcctcttggagccac

SEQ ID NO: 19911 - DNA, 332 bp, Homo sapiens
  misc_feature (1)...(332): n = A,T,C or G
cctagatccacacgnggtgacattgttcacgactcctttcagccagaggatcatgaagaggcgctgagagaaaggacagttgccgatgctttctccatcgattccagcctggaaagaagagaaccagtgtcctgagtgggcaggtgcaattagcaaggggaacataagattgtaacacccaaatgcaggtctgaggagaccttactaaaaccatgtcccagcaacttcaaagggcggtagcctgatattattcgtttttgccttaatgtccacgcagggcaatgcctggcagcatgtaagggctcaataaatacttggcctcgttggcctca

SEQ ID NO: 19912 - DNA, 772 bp, Homo sapiens
  misc_feature (1)...(772): n = A,T,C or G
catgggggctcattgcagtcaagaacacgccccaagttattcgtcagtgaggcagaaattgtggtgtccttgtgctgaaatgcagtggcgtgaccaggatttcgaccagaagtttgactgcagcctcgaactccttctaacaaacaatcctgctgccttagcctcccgagtagctaggactatgggcacatgccaccagatctggcatattttaaaatttttgtagacatagggtctcgccatgttgcccaggctgattctgaactcctgttctcaagcaatcctcctgcctggtcttcccaaactgttgggcttacaggtgtgagtcattgagcccagcttgtattcttttgatttaaaaaaaaaatatcctgaatgtgatccaccaaattaatttcaccatccactaataggtagcaacctgaatgaaaaatactgttataaactttacacaaaaccagagattataaacatttgcctccaaggagatgagagaggcaaaaggtacttgtttggtctgatgggccctgtttccttcagngccaggaagagtggctctcagacctttcttctggcatccctcatgtatgcaanggttggttattattttcaagggccttggaaacaaaatgccccttaagagtgaccagtcagacttgacgaacatatttgtcatatggtggactgacctgaaccatcgagttttaaacaggaagaaggtnttctctttcacttactgcgttcaagaaaacgaacctgctcacatacgctc

SEQ ID NO: 19913 - DNA, 811 bp, Homo sapiens
cttttgggacatactatgaagctggcttccatcattcacaccaaactatcgcaaggacagaaaaccaaacactgcatgttctcactcataggtgtaaattgaacagtgagaacacatggacacaggaagaggaacatcacacaccggggactgttttggcgtgtggggaggggggagggatagcattaggagatatacctaatgctaaatgaggagttaatgggtacagcacaccaacatggcatatgtatacatatgtaacaaacctgcacgttgtgcacatgtaccctaaaacttaaagtataataataaaataataagtaataaataataaaataaaattaaattttaaaaaaaagaagttaagagctgggattctcacaatatggcttgcagactacaagtgtgaactgaggaggtccccaaagtcacttcttactaaggtaatattgtctttgtttttttttaaagagaggtgaattgctctgacacccagaattggagtgcaaagtttgaaatgatagataactggaaattattacctaatatggagctagccatggctctcaccttaatcctatccagaaaactaagagtatagtgcgcgcacaaaaggaacggctgtaattaaaatgcgttcatttgtctctcattatgcataaaggctttacttcgagccctgctacgaaatcttcaaattaatatatacttgtcaactaactccgtttcacccgcgagccccatcttgcggttatcgcctccaatccttttaggaataattgcaatacttcacttaaccgtatatattaat

SEQ ID NO: 19914 - DNA, 803 bp, Homo sapiens
aagtcctgtgactgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgaatggcctctgaaattcccttgggaatttgttagaatgggcctgacacaaccaaatgttatttcttctctatgggccccctggatgtgctaaaaccactctggtgagggccctggccacatcctgacactgttgtttcaatccagtcgatctggagctgcccctgctttctccttttgctgtagatttacaatcagtctaaatctcacacccgtccaaccgcagaacaccgtcacccaattacttatccctccccgctccatacacaattacttatcccactctaccccctcaacagaaaacagtctacaatgtcccgctcgaggagccatcagttgccagcacacgtctaagtggttactcgcccccccccctacaacgtacccccccccccctctacactccatgtccgaccaccgacccccattacgcacactcaattcgaggttctctgtaatatcatgcctcgatctacatatagctcagctcactcccccttctagcattcccaccctaatcaattatcttcccattagtatctcttagcacctcaccacaatcgtacggctctttaagacgattagcctgaccacatttaagatatctcaattagccgacttctccttcaccccctcgtcaccacccg

SEQ ID NO: 19915 - DNA, 1194 bp, Homo sapiens
  misc_feature (1)...(1194): n = A,T,C or G
acgaaccagccagcgacaaccaaacccaaaaagaccggaaagggccctagggggctacgaggggacccctttagagccagaacaggatcctattcttattctaggaggcatgcccactcccattaactcgagatcctggacgagagctcgcgaagagacctggcttctagcccagatcacagcccacctcaccaacgcacaacagacacgctagccgctcgagcaaacacgacccggagacaagccaaccagcacacacgcaccagcgagaaaacaaaccccagaaaggccgaatggcgcccgaatagagtacaagaaagcgttcctcacttcacgacagaagctcgcccactagcacagacactcacacgtacctcttacaagctcggaacacagcccactacacagcgaacagaactcaaacagtcacacccagaccacacaaccgcccctacacgacgcaaacccacccaccaacaagacaccccgagcacagcacacaaaatcacacgcgccgccaccaaaaaaacctccgccgcacccgaactacctcgccactgacccgcaaccactaaagaaacggcgccctaccccgacacacgaaaaaagacacacaacacaccaggaacagcacgcacgaccacaataagaaagacaaagagagacgcgagacggaagcacgcagcgcggcgcacccgaagccgacagagcctcgaactcaaccaagaagccagcccacacacnaacccctccaccatacccgccctacaatcgcgcgccaccagcaaacgacagcgcaccacgacgacgaagacacgacctagcgcgaagaccagcgcgcacgcacaccagaacaacacaccacgcccaacccactaacaccacacacccacncctcgactacaatagcaccgtgcacctcccacacatgcngcaagacatacacagatatcaccgaacnacgtactagactcacatnaatacgatagcacagtcgnatacgacgcacactcacgacacataccaagccgngngacgacgcacgacgtcccgacacgcnanacgcattnatataacgagtcngatgagcgagacgagcatcacacacnacagcaacacacgaacgcgaagcctcgacatcanantaagnacgcggctacaatcacaagcaagagaagaccgaccagacacgcg

SEQ ID NO: 19916 - DNA, 926 bp, Homo sapiens
  misc_feature (1)...(926): n = A,T,C or G
tgtggtagagaccgcaccaacgggctcccccgccgcacggaccgacgaagggaaaagagcccctcngngcgcanacaacaaaaaaaaccttanaaagaggcaaaacaaaagaaaaaagaagaaaaaagaagatgaaaaaagcaactgggagatggatgaggtcttttccctgacaagtctacgcctatggtctttcgcgacccatggcaaatgcagatggaagatttctgtgagtgctttgggagccaaattgcatggaggtcccacaaattcgggagtgaggaacaaacaccctttttttttcacaacccatcaaccacatcgcaccagaggcgcccccccaacaccgcaccaccccccccacgacgctcgaaatcctcccaccctagttgaaccatacaacacaacgacttcctagcactgtttcctctccacccacgagccgccccactattcatcccccacacaccaccatcagagagacatgcccgcctcaccccgcctcaaaatcaacaccaccacatcaacaccccatcaacaaccaccccaccacctccatccccacaccaacatcaccccccccccgccaccacccacaccaacctccccaaatacaacactccaagtcacatacaacatcagcctaccacacccccatactcacacccccaacgtcacagcacccccacacagacctcaccccacaccaccacacctaactccactcaccccacaccacacgccgcccaaccccacccaacccaccccacaccccaccgcacccgcccacatacacttccaacccaacacaccacccactctcaccttcccaaactcccccgccccacagattccccctcccgcctaccacacactcgcttcctcacccgcagcccatgccgacaccccagaccgacgtacaatcg

SEQ ID NO: 19917 - DNA, 830 bp, Homo sapiens
  misc_feature (1)...(830): n = A,T,C or G
cgcggcgagcgagcgggggccgaagaacacaggctaagggaacaaagggaaacctacngggaaaacgaggaagggcggacgacagaagagcggcttggggacggccgaagccgcgccgcgcgccgggcggcgcggcccggggagcgccgccacgggccgcgcagaccagagcgacaccccgccagagcggagaaaggcccaccaccccgcgcagcgcgacgggccccgggcggcgagagccggcggcgggccgcggcgccgccgcggggaagcggacgcaggcgggagcacccccgcgcagcgggcgggcacacgcaacgaggcccaaggcgcgagagggcggagacgcgccgcggagagacgcaccccacgcaggccgaacacaccgacagcgcgcaaccccaagagggccagcccgcgcagccggcacacagaggcgggcagagaccgagaggccggcgagcaagcacagcgccggcccgacgcgccgtcgcccacgcggcgagacaccaatcgagggacccggcacgcgggcggcgcgcgagccgcacccacccgaagggaaccggccgcggacgcacaacaaccgaagcccccagagaccgaccgcgtgccaccgggcgaagagggccgggcacacgaagcacgccgccagacgaagacgcacgcgcgagcgcgaaccgagcgagagacgcacaagccacaacaaaaaccggactcgccagaacccacgcgcacgtgcgcagcccgctcgcgccggccgcgcgccgggcggggcggccccgaacaacgcaagtagggaggagcgcgcgagaaagagacggggagat

SEQ ID NO: 19918 - DNA, 777 bp, Homo sapiens
ttgcatataaaggggacggtaatttatacactcatagtggataaacaatggaaataaaatcggcaaaagggaggaataggagagtgcgaaaaatcttgattataaattttcggtgcgtggggtgtcttatctacgcataaatacaatgagggaaatcgaacaataccatactagttaaagtcaaatgggacttaccaatataacgctaaagatgtgacaagatttgaaatagccgcgttcacgtgctttcttacaaataataaactaagagcgggagagaatgtaaacgaaaagggggcatagttattttaaagttcccaaaggaacactgtaaaaccatttcattcgatggtgcaaaaacaacgaaattatttcatttcgcgaatatagggggcgtgttgagaatagagtcgagaggtagaatcctctaagttaagcccataagattttgttaggccatattcattacaactagaacagtatggggaggaccactccatgagtcaagttatctccacctaggtctattccacaacatgtggaaattatgagagatacagttcaaatatgagatttgggtgaggacacagccaaataatatcaagctttcatgattacagttttactgtgaatttcattgaagcagttgtcttttctgtctcaagactaatttagcaatttcatatttatatttaagatactgtgggcacaacaagaccatcaaaacctcaatgactcaattaaagccaatgaacaagtcaaaaaaaaaaaaaaaaa

SEQ ID NO: 19919 - DNA, 1326 bp, Homo sapiens
  misc_feature (1)...(1326): n = A,T,C or G
agggagaggagaggaaaagagagaaaagaggaaggagggaggangggagtggacgcgaangggaggaggagttagagagggaaaaatgagacttgattctaaagcatgggaggaggctgaactggggatgaaggagagagaaagaagaaaggtctgtaatgtgtgtgatatacggatgaagaagaggncatagcacgcgcggacgagacggaagcgggcaggaggcaccgatctaccagcaacctactcgactacatagccagagaccaaacacatacaaccatagccccgtgagagagcgcagaggggaggggaagagggtggaggacgaagacgagccgtagggaccgcgccggaaacaagagagaggagacacagaaacaaagaanaggcccacaaacacccgccacgaccagcaccaccacaccccacaccgcacaactacgcaggcgaaagcgacgagcaacgaacaacagaacacggcaagcgcgcggaaaaggagaggccgcggaccacacccacgaaagagaaggacacaccccacacccgcgtgaaggacgcgacagagcaggaaactaacggcgcgcanacgcgacgcgcgcgtccagtagaacgcgatctcgcaccgcgcagcacacactaccgacgcgcgccccacgcacacacccgccaatacacgcacaaacacgaacaggcaaaacaaagcagcgnacgcggatgctgccgcgcgcgtccgcctgccacgcgccgccggcgcgcggcggccacgaccgtacgcgacancaccactcgcaacgcagcgtcagtcnaccagtatgtcatcgccggcatgcacgccaccacgaacgtggataacggcagtcagaagagcgggngcgcagaccgcgtaacattnagtgacgagtggttgccacgactcgntaccgattagccaagcacgcgcgccgtgacgcatcaagntaagacacgcgacagcgcacacacacatacacagagcttcactactcgacganagactgacgcagcacgacatcggctgctacagtcactgaccacacgcgcggccgcatcnacngcatntcactcgtcgcgcacatctcgcgacgcgcgcgaatgcgtgtctcagtgcacgctacagagcaanagcgcactagctacgtaccgaacagcgtcataacacatctatcacacacacgctacgacacgctcacccaaacgcgcgctctgcgcgcgcgatcccgtcgcatgtacacgacgctacacattctctcatctctctaccatgcgcagcgacgatgcacgaccgcgcatgagcagaagacgact

SEQ ID NO: 19920 - DNA, 718 bp, Homo sapiens
  misc_feature (1)...(718): n = A,T,C or G
ctgagaaggcctactgtgttgtctaggctggcctcaaatttctggactcaagctatcctcctgccttagcttcccaagtagctgggactgcaggccctgaagaactgaactctccattcaccagcacaggatcaggacagtggcccactgaagaagaaaataagcaataagctgaaagggcaaagctgaagcccaacacagcaaaggccagacctcctcagtcttcagtgagaaaacagcaaattagagttaatactgcacatttttaattgagtgaagtacatggtactaccatatcaatgcagaatgaaaaaaagaggagattgacctaagtacagcccaaaagagctttgtcatgcacaagaacaacatgaattggcaactgaaagtaattaatcacgtaactgaaagttaccaatcgtatgtttattgtactgttatattaagcatggctcanaatagtgagactatgtttgaagcaagtatttccttccctttcaaccagccaaatatacacttacttagcattttttattntgttgtgctttttcccatggcatggaaaaaacaggagagaatgcacagggatatatgagtttggttatatgaatgaaggataataatatcgggtgtgctctactctaggtatacaagagaactaatgcaactattctttaaaaattataagaataaataggatatgggattaattattccc

SEQ ID NO: 19921 - DNA, 1160 bp, Homo sapiens
  misc_feature (1)...(1160): n = A,T,C or G
acatacttgagtgccacgaattgtgaactgtaacataggagaggagacatgcagttaagctaattaccggacattaatctcaccagtggatctaataaatagcgagtatcgtagaagtagagagtgtgaagtataattagtcaattctatcgttagcaactcgctcatatgacagaagttggtgatatagaagtcncagggtatatatgcgaggnacgttagcggaatcatgcatctgatgacacaagatagagagtgtcaggacctactggctacgcgtcgagtagtcgcgacagcatgagcaacgcgtctcgccagtgcgagtacgaaagagcacccaagatcttgtgtgcgacaacatggttggacagagggcggcggcaccacgcatcgggcgagtaacgactgaagcatcagtagagtatagagcatggggagcacaagatagcggatcaatcaagcaagcaagcgcgaagaaacaaaagaggaatagaggatatagaaagcggaacaggcgagaaagacaagatgagtagcgaaagtgaatgatcgggtgatagtctacttgctacggcgtgctacgagactggagcggggaacaagatgaggttccaggggcctcgtgaaccatagaatggatgtacaacataatgaaaatacaatatgttaacaatagcatgtatataggtcacaantatatcatcacgtaaacactattaatcaaccatccacgacaccaccctcgctttatcaatcaaaacaaatacaaaactacatcgcaaacacccacacaaacataaaacaacgatcaataaatcaaaaaccatacttactcactaacgacctacccaaaacattatcttaantagcactaattttcttcatatcactcacatgattatattttcggtatacaatgtgtggactagtgnagacactcggtggtttcgtcttgttcatgcttgnacctacaggttgctcccgacnngctnccgaaatagtaatttccttcttgcttcgtcatgcgttgcctcgcatagagtcaaagatatctcttctttcgctctcgaaacntaaacttaaantnttaaataattgtgaggtnatnntaaaaaaattgttggatntatatatatattaataataaaataaaaaaataa

SEQ ID NO: 19922 - DNA, 485 bp, Homo sapiens
ctagattcaccctatggaactgttgaatgggagcagtgggggaatgcctttaatgaggaaaacctgttttgctcacaaaagatgccatctattgatgatgacgctactgctgactctcaacattctactcctccaaaaaagaagagaaaggtttaataccccagggactttccttcacaattgctaagttttttgagtcatgctgtgtttagtaataaaactcttgcttgctttgctatttacaccacataggaaaaagctgcactgctatacaggaagattatggaaaaatattctggaacctttattagtaggcataacagttataatcataacatactgttttttcttactccacacaggcatagagtgtatgctattaataactatgctcaaaaattgtgtacctttagctttttaatttgtaaaggggttaataaggaatatttgatgtatagtgccttgactagagatcatagtcagcc

SEQ ID NO: 19923 - DNA, 692 bp, Homo sapiens
gtactaataggggatctgctgactctcaacattctactcctccaaaaaagaagagaaaggtagaagaccccaagggactttccttcagaattgctaagttttttgagtcatggctgtgtttagtaatagaactccttgcttgccttgctatgtacaccacaaaggaaacagctgcactgctatacccgaaaattatggaaaaatattctcgaaccttcataagtaggcataacagctatactcataacatactgttctttcttactccccccccgcatagagggtctgctattaataactatgctcaccagttgggccacttctacctctccaatttagcaccggggcccacaccgaatccctgactctatatcgccttccctcgcgaacataacccgccattccacattcgcagcagcgctgcactgctttcacacacctaacacatcatgcgcccgcacatgagacaacaaagaataacccttgctcgcgccactgcggtgtgtgctctccgtcattgcgccatcccagcccttatcctattgctcgccgtaccatccaaattacgccccgttccccacccgcgccccccctcgatcccgctcccttccctcgccggcaacccggcgctgcgcgcctccgcgaaatccccgccccccccccctccgctcacccatccgctcccacgctct

SEQ ID NO: 19924 - DNA, 864 bp, Homo sapiens
attatctcttaccatctcaataaggagatgatactcggcaaaaagaaaacatacgcaaatataatataacgcgcactataattaaatctagtaataacaatataatcaaataactattctaacacactcatatattagtccgaacagtagaaatagtaggaaataacgcaacgaacacatgacgcaggctaaccgtacacacatatagagaccaatttgggacgcacatcgttaagacacgaagggtaatacgaattcagtttctcgaacaataataatacaacattgaatcgaaagttcactacattaaatacgcgcacggcgacacatgttctagataattttcccataaaataagcggacgcatgaccacacaaactagcatattcctggtatctctcgctatgtgcgagagtaattttgcatatgttgatgaccagtcactcacatcaaagagtccacactggcctcatgtacaaggcactatttaattatataaccagcataggattgagccctgtcactgagtcttccattccttctatctcgcctgtttctaatttatttctctatttattcatttcttccttgactgtcttcattctttgctttttatttctttctccttaaatgacagaccttttcttagatgccatttctctatgtctgcgcttaagacaagaatttttttcctcctagttgttggttaatgtctgcaaatgtgagagcatgtcaacatgacaaacaacaaggaatttgaaataaaactatggcctcgttggctacagcgtggagtgtgcggccgagcttaaattaatttgaggtcggtcgtgggtgatagataaaatgaattgagattaaaaa

SEQ ID NO: 19925 - DNA, 892 bp, Homo sapiens
  misc_feature (1)...(892): n = A,T,C or G
gtggggggagcggggttggagggagcagcggcggggggaggcgagaaccagattagtcttttacttgtgtgaaaatgaacttttgcctagccatccccttgaattatcagaagaaaatttccagctcaaccaagatggggagggagtttttccacattgagaaacattcagggtctatttgctgcgctaaaattacggatggaattcaagggagtgcagcaggttcagacgcttgcatttcttgcaggctcaaatgtgtgcctggatgtatcagaggggtaatgatgacacgtaggggagtagaggatcgtggtagtgggccatgacggacgcgaaggggtggggagacgcacgcttggattggggggaagaggtgccttgcggtgggggagggcgggggctggcgatgcggggacgagcggcggcccgggggcgcgggggccgcgcgccaacctgggttggccaagggcggcggccgcgagagtccccgggcgggatggaggaacggagggggcgaggagcacggnggnncgcnttggnngttnnnnnnggnnccctcnnnnttcactccccctgtggacaaatagagggcgagagtaaanggacgacaatgcgcgattcgaaaaangngggngggggggnnnnnnnnnnnggggnnnnnnggggggggggggcgcaagaatgatgacaaaggcgagcagggcgggtacacgaccgcctggggggggtgggtgggatgggcagtgcgcaaggggacgggcgaggtggtgcagggagggccctgcaggtggcgcgatggcgggccggcgcaggcgagcgggggggtcgcgcgggcggcggctgaggggtgcgggggagggggacgcggggtagagtgggggacgagggtggg

SEQ ID NO: 19926 - DNA, 856 bp, Homo sapiens
atgaagaaattagaaaaaaaagaaaaagaaaataaaaaatagaatgaattaaatctctactttcaatttcgagtttcgaggaacattatataatgttttgaaaatgtctgtgtatctggatttgattttgcatgggtacaaggttcacactattcttgcaaaactggtgatggggggaatggtatcggaaaccattatgaatgagatagtggcacaaatagatgcacaaaatactctgtgaaaaatctgaggctggcttatccagaactccagcccgtgctgtatcagctgtaaagaatattaatgctgctgacatcccattacatattatcattgggtgacatcaatatataagtgctctaacctgccctcttttaaatcaaaatgtattaaagatattttaatgaatgtattcttgggatgatttatttatcattactttctactcttttttcccaattaaacgcccgatactctctttcttccgtctactttcttttaccccgcacttattttattcttattcgtaatttttttgtttatctatctttttattcctcattcatgtcatattccaacttatattctaatgtccccacaataataatactccccccatccttccccctctactcttggcttgtcctcactatttagtgctcaccccctcctttactcactgtacccccttcccccctctcactcctttttattattcctctccctcaccagatatctcttagtatacgaattaaggtaataaaaataattataccccctcctccacctttatatatcctcctcattcatcttctatctacaactgtccacactcttattcaagtttatcatccat

SEQ ID NO: 19927 - DNA, 861 bp, Homo sapiens
  misc_feature (1)...(861): n = A,T,C or G
ggggagggacgggacgagcggggggcggacagcgggngggngcctcggagatacctaagcaattgtagaacgtaatgaaagactaaaagaagagatgttaggtaaattaaaagatcttgggaacttgggtctccgaccttttgggctctccacgggaaatttccagatcaaacaggattcctctaacggctcggactccgatgagttgcgtgcaaaagggcggatagtaacgagagacaaagaagagcaagagcgtggcaggcgggacaagcaagtgcagtgcgggggggtgcgacaaagaggaaaagagccggggcgagggcagagctgtaggaggcggagccgggagagaagacaggggggcgcagggagcgccaagagcgagaggtagacgcgacgggatggagagaccgcgcagcggcgctcagaaggtggaaactacgcggaacggctggagtacaagtgggagacaggaaggcgcgacgagagagaaacaaggggcagggcgagagagggacactagggaggagagctgtgccggccgcgccccgagggggcgcgtgagaagggagaggaacaagagagggccacaaaagaaaaatacaagagaggcggggccggcgccggtcgaccgcggcggggggggggggcggggcgcccgatagcccgccacggaggatcggacgggggcgggccgccgcagggggcaagccgcggacaaatgagcgggacacgagggagggcgctcagacgccggcgcattaggacgtactagcggacccccagagagaaggaagacggggggggagggggcagtattagcgcgggcgggggcggggcgatgaagaggaaacggcgggg

SEQ ID NO: 19928 - DNA, 1172 bp, Homo sapiens
  misc_feature (1)...(1172): n = A,T,C or G
ctactacttctcacntccacactccccgatgatngcgttctgtgttgctatatatagacatgaaggagtcgctgtcctcttnaatcatcaaatggtcgcgagcgatatcacgcgtacggggcacgcgggcgctactcgactcgtctccgctataccgaggcggttcctcctgtttgtggttgatctgtggcgattacgccgaactccgtaacacgtactaagcctccgcggtctgaccgggttgtaggattgacgctatgacaccaccgtgcgttcgtggatccgccggggcgtgagctctaacgtaagggagcgagtgtggcgcatcgcttcatntacatttggacctctctgactctctcgtgttcagtttgtatcacgcgagaagaggttgaacatacacctggcaatgaaacgtcaaattacgtatcgtcccctagtatctcttctatcttatctgtgtacaatgtgaaagacatccgcggcagtaacagcgatatcgtggtctcacattcgtgggatcactgacgtacacatgatctcaggcgccggcgcctcattgttcatggtctttcgttccctcgtttcctttctgtctgtgtgtgtngtccgtctcaccgtgccgcgtgttcctgtattctgatgggcgttttcttttttctctctgtttttgcatcattttcatcccctccccgcctcccttacgccctgccatttaagttgttcttaactaatattgttcttttagttacatttttcctctctttttatacctcaattaacgcgcattcnttccaataaaaattaatatattanttagttttatactgcgttctggtgcccctcctttctctcttttccacatctttcatatctccactctttccactattaaggtcatgtgtcttcgccttctctctttcacatctttatgtcagtggttgttttccgtctcgcggcggctcctttcttctcttctactatttgttcttcttgtgctccaagcttnntttctgtttttttcctctgtccttccgcccccccctcatttgcgtggcgcccttcaaagcccttnctctttttgtttttcgttttaaactccctcctccctttttcctccttctcccttccttttgtttcgtttttttttttatatatttttaaatttttta

SEQ ID NO: 19929 - DNA, 402 bp, Homo sapiens
ctagaaatgcaattattagccttttacctcctcctcaccagatactctctacagggcaagttcatcaaactgtgtgcttagaagctctggagcagaactctcacccaccagaaggttgcctcaagagataaaagatgatttacaacccaaagtatgcccactagagtttttggccatttttacaatgtattcctgcccatgaagatgccaacttgactgcccaacacataaagcaccaaagcaagtatgcggacccccccacacctcctcacttctgctcctgtgtagacccccatctttaaaagcacttactttctcctgcaaaagcaaatcagacccttacagcaggaaggcttttcttcttctcctaaactagctttggaataaaaagttattttcttt

SEQ ID NO: 19930 - DNA, 1004 bp, Homo sapiens
  misc_feature (1)...(1004): n = A,T,C or G
ccagccttctccctgagtggctgctcctggtgttgcctgctgccttccctgccctacaacccccaggagaagattccaactatgtcattcgcccacacgatacagccactgcacttcttcagaacagaattgacaaacaaagttcggcacatcctccacggcatatcatccctgataaaggatacatgtatctaagtagttcactgtgtgaaagcagtaaatgaggcacctggcaagaaaactaaccgtgaactcttcgcataagattggcttgaataatagattggaccgccttctcctctcctcggtatgtcacccagttgtcgtagacgtacgaccctcggccgaccatgcctatatttacctctggatccactctcggttccttatttcgtccgctactcactccatcattccctcgcctaatccacacaagtcgtgtctggtatcaacccacacgagtgtcattcattatgaggttgttntattantttatatccacgtcgtgcgtctcgtttgcttagtcgcttcacaagtttattgtgtattagtttgaattattgtnantcctgtgctctgtagagtgctggtttctctttattcagtttgctccaattgcgattatcagatgcgaagancgagcaatgatgcgnacattgtgtcacactattatagntccagcagtcnccacactcctctgctacccgccgcctcatatcatctgtgttatcattcattacttctagtacgcgantctactacacacctcactcgctcaatcttcttctcatatcctactacttcatacccgatagtattttaaccaccgcggcagtcatcgccgtcgcagtgntgtcattatgatcttgccagctatcatatnacatattatttgttgctccctattgctcagttgctcttattgtcgtctctactctgtatgtcctgacgtcgccccgtcaccgccttctcgcgcccgggagcgcagttctggattgtctgtt

SEQ ID NO: 19931 - DNA, 223 bp, Homo sapiens
agtccatgaagatatcataattcctacaacacaaaaaagctgcagcaacgtcaaaaactaaaggaagcaaaataaaccaagtgatggccttttcttcctcacctgcaatgactgcatttgtggaagctactgcaggaatgattctttttactacccctgaaaaaacatatcaattaaaatatggtcatttctttaaaataaaagagtggcctcgttggcctca

SEQ ID NO: 19932 - DNA, 939 bp, Homo sapiens
tttctttccttctccttacaccattactatctgaatcaaatctggacgatctcgctccttgaacttgtttgtgatgagtgtactcaactaacagagttgaacctttctttttacagagcagttttgaaacactctttttgtagaatcttcgaggggatatttggatacatttcaggatttcgttggaaacgggaatatcttcatatacaatctcgacagatgcattctgagttagacttcttatccttggggactgtgagccatataaacttgtgttcatcataaactaatactcactaacatcaaaaaatataatatctacaaaactaacgattataaaaaatatagcatgttatgttagatagtcacaagctctacacctctcgccttctcttcccccaccccctctggaaagaagtagtagacgccacagagacacccttcgctccagcgtacacgcgcggataagttcctgtcctctctttctcatgtccgtctcttaatgtccagacaccaagacgcacgtttattaccgagttttgtatatttttacctcgtccgagcttgtgatcgcgcacaccatctctaatactatataaattcatccatattgacagtgcgtatctatacataatcgtaatgtcttacgaatcgtctcgtcatccccttttaacatgtctttcctgccctcctcttccgccacatctcctctcttcttcaattcagagtagtagtccaccgctagtatttgtagttgctgcccaccctacacctctttacactacgtcgcgtgattacttgactattgtgcttgcaaatctccctacgccttgtctccgaatatcggtcgtagcgcgactatcacaatatcaccacactctactccctaatcatacgtcctctacttccgatatactttttacccactggccgccgccg

SEQ ID NO: 19933 - DNA, 789 bp, Homo sapiens
  misc_feature (1)...(789): n = A,T,C or G
ctgttccgttttgnttcgccgtgcgcgncggccgcgccccggtggcgcnccacgctgccccgtccgcccgcgccccgcgggcgccgtggtggccgcgcgccgcgccgcgccctcgccgcacgccgcgccgcgccgcgcgccccgcgcgccgnccccgcgcgcgcgccggcgcgccgcgcgccgcggcgcgncgcccgcgcgcctgtcgcgcgcncgcgcggggcgccggcgccgcncgcgctcggcgcgtccgtcgcgcctcgtcgccccgcgcncntgcccgccccgccgcgcgcgcggcgcgcgcgtgcnccgccgcgcggtcgccgcgccgccctcgctcgtcccgcgcgcgcgcccgcgccggcgcgccgcgcgcggccgccgcgcgcgggncgctggcgcctcncccnnngccgccgccnnccgccggccgcgggcgcgccgctcccccggccggcggggcgcggcgacgggcgcggcgggccgcgccgccgccggcgcgcgcgcgccgcggcggcgccccggggccgcgccgcggcgcgcccgnggtgtgtcgcggcgcggcgcgcggncgcgggcgccggcggcgcgcgggcgggggcggcgcgtgggccgtccggggcgcgccccgcgtgcggcgggcggctgggggcgcgcncggcgcgcggcccgcgcgcgcggcgcggcgcgccgggcgcgggggggtggnggcgcgcgcggncgcgccgcgcccggcggcgcgcgcggcccgcgcnccgcgccgggggcgcgccccgcgcgcgcgcg

SEQ ID NO: 19934 - DNA, 741 bp, Homo sapiens
ccccgtgggccataaattcaggtggggaaaggaaaatatatttgcaggtagatttaaggagttgtttgacctggaggaaatttccagtttccctagcctgaatattaagttgtataaagctgtgaagaaaaaccggaggagcgtatgacatcctcgatgaggatgtggaaatgttaaggcaatttttagcaaataatcactttaaagaaaaccctgaataactttatgtgccactgagtttcccaaggggaaatacacacacagatgcacacacacacacacacacacacacacgcacaaaaccccctactacaagaatagaagatagtttcccaaatttgcctcaccccaggcggtaatttttccagatactgcatgtgagtctaggattggggtaacttgttcctagtttgtctctatcagcacccaggccctgggcctgccttctactcatgcggtaatagaagctcttggcaaagtcacactgcgctgttgttgtctgttctcctttttccttatatcatcgtttattattattttaataatggtgcaattatttttaatgtataatcacaaaatgatagtttttaataatatctcttcacgtgaaacttgttattcttttaaacataagtgtagatgattctctctttagaaataatgaaattgactacagtgggatctgcaagtaaatctgaacagacagatacataatgtaatggtaaaaaaaaaaaaaaaaaa

SEQ ID NO: 19935 - DNA, 1600 bp, Homo sapiens
  misc_feature (1)...(1600): n = A,T,C or G
gacgcgtctgggtgtgatattagcgggtatgagctgggcctaatacgctcgcaacactcgatattcctacgacggagcgtggcgcttgaantatgatgtttcgggcgcgagcccgcaaccggcgagccggcacatcgtcgntgtcagcttgcgcggacgaatcgattgagcagagatgattaatatcgtgatcagtcggaagaactgagtggcngtattcggtcgatatcgacgcatcgcggtaaatagcgccgcgagaggctgaaccactatacactggcaccagcgcagcgctcggttactatatagatcgttgcgtatagagagtgatgattgggtatgcacatagtgctcataatgatcgattgatctgaattacagaccaangagaaccgacggcgccgtgtagtgataaattccaaaacattgtataagttgtaggatgatcgggagatgatgtgtgtgctcgngccataacatgatgtcgacattgtcgtatggtacgttcgaatgctcgtcgtgtatgtgtctaacaccgtcgcaccatagcgatatgcaagtcaacatccggtcacatacccgctagtgccactcacgcatgtgaccacctctgctcctcagtctccgtacactgcgcgcgtgcttcgtccncactacatggtgcgcnagcgatgtngtcancacttatgcattcatattgtancagtgtcagcgcacgtangacacgtcnatgcatctaccaccgttgagancaagcggattatgcgcgtatcagccgcgcngctacanaggcaatatggtatcgattgcgtaggnatcagcgcatagtggtccgtggaataactcaactanttcnctcaatatacgcgatattctctctgtggcntcacgctcagctantcgtcgcctcgcatgatctatgattctgtatacttatncgcaatataacatcggnacacagtctcatattcgacgccactgntcgtctgcctcgcgaatgcgncgcgatcgcgctattcgctcacgagtggcnacagcaagtactatcgcagctccaggaacagattacatgtcngtntaatgatagtcatctaccatcgtnctcntagtgtgatcacctctacacncgacctgtcacacgcnctanctgctgacatgtactcacgtcagtctgagcatgatgcnatgcatcatagatattcattcccctacatcgactgactgatgcncgtncacacgctgttcantgtcgtcgtcaccacntcagctncatgcatantgncagtatcanctgatttgagtactantcngncatngtgngatatancgatgnacgccccatgctgtatttccgatactaatctngcttactctctancgacagtcactaactagatctacntgttgagatacaccctatgtagtactcacgtactantgatccnaccttgaccgtgtatatnaatgtgacacccaatatngttgtgacgcangnacgcgtctacancnctacactatttgntagtgagtgtctgatacgcagcgcntccacaccagtcaggtatgtanntgtgatacntagtcgttagacacaatatat

SEQ ID NO: 19936 - DNA, 1307 bp, Homo sapiens
  misc_feature (1)...(1307): n = A,T,C or G
taatatctagggtgataggcacggaaggtacggaggggtcgaccgtcgcgagggcgagagcgcgggaggtggcgagcccgtgttagacgntttcgcggcggaaaaacnnnggngagccggcaaggtttgangcagcgcgcggnaacaaatggacggccgagacggaaagcgcgccgaccgggcgagcggcggcgcccgnccccgcgaaggaggagggaaggcaaaaaaagagcgggggagagccgacaaggaaaggcacggcgaccgccacatgccgcaatgaaacataagcgcgacgaagaggaaaagcagatggttgtcaagtctatattgatgcggttccaacatgctcgaaagatcaatcttatggcatcaattgactataggggagcgcagcgagagaacatcaaatacagttgacgcgcaccaacatcatcgtctctcaattgtcgcgcccgactatacacattattcttatcgaagctggctaattcgtctatgtatctctgttgttgtgtcactagccgctcctcgttgtaggtagtatagtatgattcgagatttcactaattgaacgtagagattgagaggacactgaacactcatatacgcgctgtaccgccggtcagtaattcccatcccttatatccgtcttcgatgatgcgcctcttagtcgatgtattagttgcccattgttctgcgtctgagtatgatacgtgcatgtgtcaagctaccgtccttgcccagcncgtattgtggtatatccccactcgaaanaatgtaatattgcntcagtagcgaaggtacacacgcctatatgaagtgctattccntacgtgacgttcaatatacgagaatcgcgttaagatagtgtgatatataagtagcatgcgtggacttcgatcgtcggtcgtagatatattgcgctccatctttttgccctcgatttattacgacgagcattctaagactgtggctgcgtaagggaagagcttcgaaaaagtggagtctgctcttgtgtgttcgctgcttccatacgctgaccgcaccctttgcataccacctatatttcccccacacatgttaccccgaggcatgtggaccacctcaatttttctgttcaaccatacttacagttatgtggcccctcgttggttattcatcagtgcgtgcccgatcccttttagatacatttcaccactttagcgcatcgagtatcattccagtttgtatggccatcatcgccctcacctgatgtgatggatggccctcacaacatgcagtatatgatactatagtgccctatt

SEQ ID NO: 19937 - DNA, 896 bp, Homo sapiens
  misc_feature (1)...(896): n = A,T,C or G
aagggtaaaaagtggtgggaagggagggggcgagggtggaggggggagaggaaaagatgggagttggtgaaggagagggagtgagggaagggaggggacagggaggaagaagaatgggtggaatgggggagagaggggaggggagggggagagagtaagagggtagaggagaaggtgtgtttgggggggtaggaaagggcgagagggggggggaggaaagagggtgggtggtagagagaggaggggagaaagaaggaaaagaagctaaggggagaaagagtaggtgggtgggggagaaagaagagaaaagaaagggagaagtgtgaagaaggggttgagaaagaggcgtncgaagggtgggaagaaagaagggaggagtggagaaagcgagcccaggcacaaaggattaaggggttgtgggggtgggtggggttgggtggaagaatagaggggggaagggggacggggggagccaagggagaagagtggggaccttttttttaaagagggaaaagggaaatgggaaaaaatggtgttagggagaagggggtgtttttaagaaaaaggtttaattaacaatgggggttaaggggttgaaaataaaggggaacaaacaaaaggaggaaaatttgacaaggacacggtttaaaaagtttatagttttattaggggagcctttaagggggaaaaacccagaggggagaaaagatcttttaaaggaaaggaagataaaagggaataagttaagggggattaaggggaggagagtaattaaggaaaagaaaaattaatggttttttgattaaaggggaaattaaaaggggagggggtttntttaataggactctctacactaggaaaaaaaaaaagcggaaggtaaaaaaaaaaaaaaaaaa

SEQ ID NO: 19938 - DNA, 1773 bp, Homo sapiens
  misc_feature (1)...(1773): n = A,T,C or G
cagagtgttagtctgttacgtgtgctgagtagtacagatncgtntagacaagtactgtctaacgtctacgtaactcgtcatgcgtcctcgagatgtactnatacatgatacgacgatgagtcgtgtgtgatgnacggatgtagcganaatgctgtattancgtagatacattcgcggtgagtangncgatcgttatatanagtatacctaagcgtatgattcaantagatatanacaatatacatatagaacacatngagagcaaagctaataagtcagctattagcgacatgncgaatgactcatgtcatacgacgagaggtaatgcggtagatggatangtatatacagtataacgcagcatacgtcgtntgtagtattaatatatctaccagatctcttttcttcgattganagatgtagtagagtctcgatcgatagcgttatagcacttatatgtcgtgaatatgtnaatgtgtgtgtgataagtgactagttgtcagttctgtatctgtagatanggtaggtgtcatggatatgtccatgatagagtcattagtacaattataatatacatgacaacantacgatacatcagaggtatatctcgagagtgatcatattcatgcgtgaagtgtgatagagttatatgaatcataataattgctcatgaatctagttatgttgttaagtatgatacatgagtcagagagatgagattagcgcgatgagcggattctggaggagagactcttgtgtgacgagagtatgtgattttctagttacacactatatactatacatactgtacaggtaaagacaggactgaggtagagaactcagaacacgtagtattcanttgntcagtgtgantaatgttatantttggtggtactnactatacaatcgatcagtagtagtagagagcgtaagtangacgantgaggtagtatcagtgagataatagctgtatcgcantatacatgtgntcatatgtctgtaggcagctgttatntctnnagtcctntcacagcaccgtgacgtagctggatcaattcatgtngtacgacattagacgnatgcagagagtgtgactagcgtatgctnctatgttatgangatctctgtatcgcagagtntacatatantagcatgtaatatgattataatntatnttattagatgtcaacagtgactgatacgatgacagaatacactgtttcgcgaggcagactcactctgccgcgctgcgtcgccgctcancctcagctgntgcatattctgcgtattggctgantatatattactgcagcgtatggtcacgcgtatcgtgagcgatcngaccgcatcagtgaacctaacatgtagtctgttagcgtgtagtagagttatgtgctgatatcataactcgctcgcagacgaatcgnatacgtactagcagctgccacagactcatagcacacacatacgcgtagtcgtgatacgagagatnaatatatcatccataacatatagttgantaatgatatgtactctgagacacatagaatagctantgaaactcagtactatntaatcatatcaatgtattactaatatgatgtntctgnccaagctaatgtagagaatacataatttctatcgtantctctcagacacatgatacgctatcgacgcgtcgctgactagctnaacactaactcatctcgtntactcatgatctgtnactatactngtatatactcaactaactacaaagcattactacattat

SEQ ID NO: 19939 - DNA, 1769 bp, Homo sapiens
  misc_feature (1)...(1769): n = A,T,C or G
acagatacgactcaacgacacgcaggcgcgcgtccacgccgcctgctcatcgtgcacgctgacacaaacgcccacggagcgaccgacgacttgacgacggncaccaccgacggacgagaacagagcgagggacagatcttctcatgataccagcacttatcgcatactgagattattgcagcacgcacgacgtggtatagaatgcagctagacgtgcagtgcacaccacgtgctcagacaacacatgttgacactgagtatgaccactgacccgtatacactagaatcaggtaaatcgcaacatattgaacatagcatgtcactcattggtgtgcatgtggagtttacacatatctggacacctagcattgatgtgtacctacatcgaagtgacactgcttgactatgtatgatngtgattggtgttctattgaacgtcgcatgtatcaatgtatctngtgatactaatggtgtatcgctgacgcatactngnatcgattgtcttgtgtactctccaatactattagatcttggctacgctgacgaaacgttggttgnatgtgagtattgagtcacagatancgcgtgtggcatagacatgtagantgtcaagcgtaacgcagacggtctcgttgacttgcgtaatcanantgatngtcgagacgatgtctgtgtcatatacggggcgcttctatcatttctgtgtcagtaccatacactgaactgatagtatgcgtacgatcgcgcatatgtggacatgatctgagagtgcaggtcagttagtttcacgctatgtaaggtgtagatgtggcgcgtgcactnntacgtacacatacgtgtgagcgcgtgatgtagttcgacaatngcgntgcacganagtgtngtctactatcgagcaactgtacagttatactagtgcncnaggacntctttgaacatgctnggtatgaatcnanacattctcgtgctctacagcagttatgtgttctgcagtcacgtactatanctgcatataccaacgtncactaagtagtagcntntngctatnatcacgatcgtgtgngcgataactcnacagcaggacatnctccgcatacntngagtaggtggaantcagtctntatacgactaccgagtctcacnctctctatatgtgtatatatctncgacacatccntctctatcacgacgctacttatatgagtgagtcatcagcgttangatgatctactaatatgtcgatcgangtngtgtagtgtcagnctncacgtacgatnctgacgtcatcactgcgtcgcaggatgtagatcnacagatcatcnagattgatgatcagctgatgcgtcatcgtgtgctagatcatcactgatcgtntcangtcgtcgtctgagcaagcagtagtcactgcgccactanatagtncaactannacatnatatatgngnngtggnatgctgtctcgtgnctctnagtagtcgtgagtagtcgncagcgatcatcacagtcgtcacgcancnngtcgcgatctncatancgtcatatgcgttngcncgtagacgtcaactagtgtgagtatgtccgtgtaatgtaacnacactcattctntcgtactaacgtagatatatatgntcgncatntgagcacttcgtagtagatttaatcatacacatttatntantatacactnatcgancntactcatacngntagttgctaactcatagatagactacntctacacatctactacacacacgnttctaaatatt

SEQ ID NO: 19940 - DNA, 1260 bp, Homo sapiens
  misc_feature (1)...(1260): n = A,T,C or G
acctactcacacctcaagatcagcctctcaccaactttcttacgaccatgaccggagnaaacccccctgagttaagnnnactaccgacacnngnnncttccnanggcgnggaaaaacgcangngcgcccgcngacacagcacgcgtacacgtagcgnaagacgtccagactgcccccgcgcgcataacagggatgagtcgcgctcggagctagtctanatctcgtttctagcgaagacagcctgtggcatgcaatagaatagtggaatattcatgtcttcttcctctcgagatcgcttctgatcaagcacttctagctaggtgcaagaccatactaagtgccttgcgcctattctcttttagatagcggagcagctttataactcaaatgagttacaatctgcgcttttttacaaagaaagaaataagcaaattggttctccggttcggcgctgcaagcggtgcgtgagactcgtcgagcgcaccccttacaccttatagcgagagcggttataatctccatcgagcgcctactcctacaacttgaactacagcctagcgactacaggtcacctccgaggatggatggtcgacgcccgcttaatagcactcccctcgaaaagcgcagcgtattanccgcgcgtatcccacccgtaaatcagcgccgcacccaccgaccgcgtacacagtaacgattgtataaggtcatattatgccctatcttagtaaagtgctcacatgcaaacctttatagacacatcgcgtcctattgcaggtggtgtagcttctcgtttactcatgggcatcccngccccctctcgcaccgatcacatcccgcacaatcacccttataccatccaaccccgtaacgagtcaggcagttatacgcccggctacggctacattcttagaaacactctctactatcggccgtgctgagactgggagatgcgtcgctctccgtacgcgctccgttccgttgtgtttcgtagctcttcagcccacgaattctcagcatcccactttcacgcgcgcctattagatacgtctccgggcacaaccgcatgggagactcctatccccggctgccgcgctcacacgcgcgatgacatcctcataacatccgcccgtgtcagtgagtgtcatcagagtacacttntgatgaggtatatagtgcgcacatcgcgtcttccgancgataattacttccgtccggcactacgngcatcgaggtcagcacncctctgcctcactatctgcg

SEQ ID NO: 19941 - DNA, 1314 bp, Homo sapiens
  misc_feature (1)...(1314): n = A,T,C or G
caacggacccccccacccctcatccccacacactttcttcgcaagacagccccacattttgtaacgctgtaactttctagcagccaacaagttnaggaaaagctgtattcaacaattacgtgaatggttgcacgacggattatcaagttcaatacatgcttcggcacaagcaagatgatgcacttatttaccttgcacaattgcagcacgcagtaggagcaattgtgctgcccaggatgaattcctgcacgcaggcaggcaatagctgccatcaactttagggccagccactctctcttgccattccgcaaccatgcccgctcatccttctcctaaccgacggcagtctcgtcctctcatccgcgcccatctcttcccctcgccgtcccccccccttttcacttcgtcgccccgcgctccactttccccctctctcaccaattttaatccaaaaatactgtccattacgccacatgaccggtatcgagaagcagcaccaaaggataggacacacgcgctactattttgccgccctctttccactcctttgccagttcctctttcccccacctttttcctccttccacctcatactcccctttccccctaattcttcataaccttgtatactccccccactcgtcctgcgaggtttatcccaccgccgatacgtccgttatccctattcgtctcctttcgcacgtttcgacgcattcttcccccacctttttcccccccataatccgtcccaatcccccgccttaatatagttttccccgaccccgagtgtcccacccgttacccccctttttatcccacccccccaccacccctttccccttctgtcccatttccctccttccctcctcattaccgcccccttttagcttgcttatccctccgtatcttccccgcttttcatattcccgccccatccgtccgattctccggcatcctcacccaacatatattcggtatgcaatcacccctccacttgccccattcttcccacagatctaatatattattccaccatacttcgattccgtctccgcatccgctttctctatcctcgccctcgctctcgtttcccgcgccgccgttcccgtcctgctcatatgatcctcaggccaccttaattttttccacgcattttctttncttttcttcttccgccctccctccgtcctcttcgtcttccacctcaccgccctctctcantctttatttattggcctctctcccgactatccgcctgttatatacnccgccttgtcttacattcgcgcgcttcattatctgcacttattctcc

SEQ ID NO: 19942 - DNA, 1414 bp, Homo sapiens
  misc_feature (1)...(1414): n = A,T,C or G
cagcagagggagggggagcacaggcgcgcacaggggagagatgcaaacgcggtaaacggtgcgacaggnaggcagagacgagagaataacgcaacaacgaccgcgcgacggtttctcaatcgcgtcccgcgncgtcgccgcgacatcggacccgtcctgcgcacgcgcgcgccgatccgcgcgatacggcggcgaaccaccgaaaatatcggttctcgctcggtgtcccgccacgtcacagcatcggccggacgaagtgagtatcgtatcgccgagagcaccgtgcgaccgtggtagcggaacgatgcactacacgggcgtcgtgcgtcgcggcacgtggagacggagnagtcgctaagtcgagacgagggcacatagctcggcgtgtggcgtgctcatgcggcacaggaaagagggtcagggacgggagaggacacacatagcggggtaccactacgagtgggcagccgaggtcacacggccggagcagagtaggagtggtaaganatagggcntcgcggcgcgagtctctgtttgtggggaccggccgatggccagttgcggacagaagtcgtcataatggctcgaactcntgccactcggcgaccagcggcatggacgaggagccacgactcgcgcgatgcagggagtgaaccgacggggcagcttcacgccaactggcgcgcgccccaagagaacctgagaccgccagattgtcgtacaggaatcatggcgacgaattgtagtgatgtgcgcgagtggtggcacgatacgcgcaccagagatgcgctgcactctcgggagccgcatccgctatgagacgcgctggcgcactcccgaggcgcgcctcgagttggtggtgcttcatcgggcgtctangataatatcataacatgagcntcagggagccgcgcggcgccggtgctcggtgggagcgccaatcgagagggtgcggaggtagaagtacaagagcacgacagtaatgaggtgtgtaggtcaactgtgggagcacgggacgcaccacatgtgtgtggcagtgatcctcgatcnataggttggcctgcacgtgagcgacnacgcacgaccatcgcagtccctcgccacggtggcgagagagagacggcgggtacaccctccagcgagggngcagatgatatcaggtgtagcagacatgcgacggaacgtggtgtggcacagagcaanagtgaggggtgcgcgcntacaagaggcgactgtagaggacacagtaggagtcgcaagcaatgacgatgtcgtccacgcaacacactcgtgatatnagtacaggagtgacaggcgtaaccatgtagacaaccagatacgacagtgaaggcgagagaacgagaagggataagacggagtgacacaacgaaagagtcgataatcagaacagatg

SEQ ID NO: 19943 - DNA, 894 bp, Homo sapiens
tagcatcaacataaaattaatagattatattcgacacaaataagcgggccttgttagatcacttctatcgataacttttgataattagtgagtgtggaaagcaaagaagtcacaggtagggacatctagacaagagtgactcacacacaaggaatgtgttccttcttttattgtgcgtcgttttaacctgactgaatacaagatcatcacgagcactgcactcctggcaatgattacatacgttagaacatggatattgctctgtaaacaacatttaacaccattctattggggactgcattgctttttatcaaatctaaaatatagattcatttgacaaacaaaagaacaaacaaaaataatattactacagaaactaacacactctacttctcaatccaacaaaacagcataaagacgaaaaacttcgtctactacatcagttttccatctcttctcacagcgaattcgcatagatatgatttaattacatgctctaaattcacgccaaaacgtgatacccccacgatacccaaacacattagacaaggatcacatcccgtttcaataacccacaaattcctattattctatctgaccttcgtcttaatacctaacagccacggtaaaaaactctatgcttgaccagtcaaccactgggcctaattagtacccttaagacatactccttaaccatcatttagtatatatcttacatccatcttcaatatccccaccaatatcgtgttaactcgcattatcgtctacaatcaggtaatttatattaagacaatcagactctcattaggcttcggtactgagtcagacatacaatatacttccaactcacgcagacagagctacatgtcgcgcgatattcactatgaatgacct

SEQ ID NO: 19944 - DNA, 1444 bp, Homo sapiens
  misc_feature (1)...(1444): n = A,T,C or G
tagtccaagtngnnatnaaagagngtagtantatgatagtatggtctgtgcatgaagnacaggcgntagttcgaactacaacatagaaggtagagcaganagaagaccttcnactggggaggatgnacccagagggctgacgacatgtgattttctaaagcaagcatcagcnaaccactttctcgccttctcccgtccaccacgccgctgagcccggacccacgcgactgatgatgttaggtgtacaggtggcgngcggctcagcccaagntcaacatcctgagtacactgcgcggccgcntcatctacgtcaacacggaggaccccgcgcgcccncgcccaccaccgcgctcaccggcgagccacacccgacacacgagcgccacgcccccacgacccacccccacacttcgcctctctacggcatacatcatcccatccgcctaacaagccccaccctttaaaagatctcacccgacatcccatcaccctgcccaccatccctcatcaagattgttacccctaatgtatttaatctggcagatcgtaacgcacggtccagagactagtgggcgttttgttgttggccgaccggcggcgcgtagcgcagggagacatagagcaggtcccgccaagacgtcccgcncgcgctcgccgcgacgcggatcacctcgactcactgtccgcacagctccacaccgcccccacccgcccgcgcacgagcggagctctgaggagattgccgtcaacggagagtgtcgtatgctcgtcactcaaagatagcatagtgcncgcgcgtgcggcgtcgccgtgcgaccgtttacgaggcgcgcatcaccagtacgcatctaagatgaccatgctctcactactctatcctgtgtttntctaagtagcttcaaagtcgcancaccntntcgcacgacactcncactgagacaatacgattatatcatacatctacgtactatgaagaacccgncaggagcgagcagaacctgatgagatatgatcttggtgacaggcaacagatcaatgaccgtacagagagcaccactgcgcagacagagaacttancgtaagaatagacacgcacgcgcggcgcggatgtgctcacgcgttgatgacgcacgccactagtactcgccacatcgacgcatccaacacactgactagctcgctctcgtnatacacgcgcgtgnatacgcgcgacaggctacacgacagccacagtaccaccatcggcgtcgcgcctgctacgctctcgtcatcctcgctaataancagcactacgcttatcgcactaccatcgataactatgtancacatgtcagatcacgatagtgtggagcgccacgtgacgtgtggcgcagtctgcgaagggcgtgagcgcggantngcgagaagtgagactagaagcctgtagcgtgacgcacgcaatagc

SEQ ID NO: 19945 - DNA, 347 bp, Homo sapiens
attacaactttcatgactagtcttagagtggtgctcatcgttatcaatatctaaatctgttaaaaaaaaaaggcgtgcgctcatcaataacggttatataaatagccgtggaggaaagttggcacctcacggcggattataacacgaacgctccagcgacaaatcatatcaccagtatatggaattactcatggtaaaaaggtgagttgaaaatgcctaatagcttacgtttacagagaactgtggtattcccctggggatgatttggtcaccacacatattcttattaaacccacatggatatggccaggatttagccggaatgagctattacttcgatattttgc

SEQ ID NO: 19946 - DNA, 426 bp, Homo sapiens
gcgtgttcgttgagaagaacatcgacgccgctccacttacacaacgagtaagtttccagtggcagtaggcacctacgcttgtgtaggtcttgcgcgactaaaatagcaccggatgactatcgtagctacatattttcgtccaggggagttattgggtggagggtgtactggggtgttgagggatgaagtctaggggtctatttttatcatttgggaattcgctccgaggaatgtccttttatcgggggcttgatggtgtcactttctaggacgtataattgtatttttaataagattcattccagtctgattgtatatatctataatgctaatggtgagtcggggctggtaggtgatactacgtaacgaatttactgttttcggtcttttaatgccttaacggtattcagatgatgtttcgatcat

SEQ ID NO: 19947 - DNA, 110 bp, Homo sapiens
agaaaagaagaaaaagagaaagggggggggggggggaaaggggggggggggtggggggttaaatttttttcgtgttttttttctttgggggggggggaaggggggggggg

SEQ ID NO: 19948 - DNA, 1832 bp, Homo sapiens
  misc_feature (1)...(1832): n = A,T,C or G
cgntttcgctntcntgcgttgngccgtctctntcntctgncgttgcgcttcntngtctctgctnctnctgctcctgtngtnccnctgctgcctgcgggtggcngtggtcgctgtgtgggtgccgcgtgctgcgtgctnctcgtncgctgtngctgtgtgctcgtctctngtcgngtgctcgntcntcngtcgtgcggntgtcgtccgtcnnctgctgtgtcgcccgcggtgctnctggcgtcgtggtnttgtttgggtgtggctgtcgctngctnttctgtgtgcgctgcgccgttcgtctcgcggngcgtncntccgtcncgtgtctgtgtntgtccgtcgtctttcgcgttgcgtcgncgtcgcgtgcgtcngcgtcgctctcgntngcgtgcgncngtcntcgcgccgcgtctcgcgctgcntctttgntgtgcgtgctggcgctggtcgncctccncctgcntgtcgccgctgcgctcgctctcgtgnctcgctctgtgttcgtcggtcgctctgtcccgctgtgcgcngcgctggcgncgtgtcgctgnccgcgttcgcgctcgcntctnttgtgctgtggtctgtgctntgccgctgtgctgtncgctctctcgtngnngcggtcgctctcttgnttttctgtgntttcgtgnggtctntctgtcngtgcggtgcgtctgtgtgcttgtttgttcgctgtngtgccgnctgtgtggtgctccttcntctctcctttgcgcttcctcgctcttcgcntctcctctcgcntccgctgtcgtcgtctcgtgcgtcggcttcgtcgtngncggtgtcgctctcgtggtcgtcgtgcgcgtctgncgtgctttcntcttgctgtcggggtcgtcntctcgtctnggtctgcgtcgtgcgntgctctctgcgtgtctgtgctccgtntgttgttgtcgcctgctcgtgtcgtcgtgtgtgctgttgcgggtgtgtgtgcgtcgtncgtgcgctctccgtgtgctctgtctctttcgtcgtggctgcggtcgcgcgcgtcgccgnttgtgtgtncngcgtgtctgtccgcngntcgcntgcgtccgcttgntgtcctctgtcgcgcgtcgtcttcgttgctgtgtgcgcttcgtttcgcgtcgcgnttcgcgcnggcgctcgcgcgtggcccgtcgcctcgctctctnctgcgnttctgtgcgcgcgtctgtcgcggtctgctctgtcggccctcgtgcngtggccgtgtcgtctctctgctcgtctcgctctgtctctgcntgtgctgtcgctcgtctgcnctctgtttctctggcacacacacatatgctnctgtccttgcngtgcgcgtntgcggcgtctctctctctccgcgcctccgtgcttcgcggctcgtgccgtctctgttctcggcttctctntcgtgcgctgtcgtcgtctcntttcttctgtctntgtncttctcttgtcgtttctgtctcgtcggttctttgttcgtctgttcgtgctctcgtgtcgtgcgtnttctgtcgtngtgtcgctcgtttgtgtgngtgtggtgtgttcgtggtgcgttgtgtgtgtgttggttttctcgcttcctctgcgtccgctggtgttgtcgtngcgcgtgtctgtgtccctcgctggccgtcgtctcntgctgccgcttcgctcgctgcgttccgctngtgggtgntgtgntgctgtgcgtccgccncntncaacnccgttggggtgtgntccgttnggntcttcncngcaccnctgtgtttgccctgccttctttgctgcgcggcggttcgcctttctcgtggtggcgtgcgtccttc

SEQ ID NO: 19949 - DNA, 930 bp, Homo sapiens
atttatctattactctccatattcgagcactttataacgcacatgagtcaaattgctaatgaggacaacaggctccccaaatcagcacaccaaactgtcaaagtggtgatccctcttcatttgacatgctcacaaagaggagaataagacaagaaagcaagctaacccagaaacagtgaggtgactgtgcgcctcaaacacaggaaaataaaatgcataactatactgattgtatgctgctcaaatatcactctatcatgccatcgctctcgtacattgtgaactaagttaccaatttctatctctaacttatgatatcctgcaaaactgtaccatcagctcctggctacgctcctaaaaaccaaagaatctagaaatcccttattcaaaaaattataatagaagtactagtggagacattttaggtatataaggaagccaagatactctttgaggatacatgtgggaactaacctaccatgaataccttattgtgactcgcgttaaatatcactataataatcctcctctcttgatcgtaattactatgaaacattatagacagcatcctatcctttttaagagcggtggtattgtcatgaagctccacagaacttaatttgttttaaattggtaaaaatagatatcgcgccttcaccttcatattctctactgcagggcagagcatatcgatcttcctaaccaactaatggtgaattgcctatggaaaacaccatatctgacatactatcgccagcctaatggatctatcatagcaatagaacaagatatgtgtcccgcacacaagttgcttttaacgtcgtccattttgatcttgctaaccaaattcccctgtctacatgcacacataccaaaacaccattcttcattgatgattatctaaattgttgcctcaggagaggtacaaga

SEQ ID NO: 19950 - DNA, 1765 bp, Homo sapiens
  misc_feature (1)...(1765): n = A,T,C or G
agtcgtacgtagcgagcanctgatcatcgcgtanggcgtcgtacnctggtagagacgnntnatatgntgntagtacgtcnatgntgactctgactgatctacttatctaangattgtagntctgacggagctatgtctatatcantgcngntgtgatactggtgcgtcgtgcngtctgagtcngcgtcgcgtcgtccgtctactntttgcgacacgctagccgcgagcggcgaaacacatgtctcagatcatagcgtcntgacttcactcacacatctacantatantcgacaaccatatggtatgtatctatgttcacaacgatatcantccatgtatgacgtgaatnagtgatttaggagcgagttatagangcagcngnagacgagcgtggatggagatgtagacgtgcggtcactctcgcgatgcacacatnagtctcgctnattactacgtcatatgtctcgtgagtcattatctcaatcacgacgacgtatgcagtgtgtcggactgatagagtgagttagatgacagccggagacgcgtgcgtgagcgggcgtagcgctctatgttctatgtataagggtgattatgtttgtgagtcgtctactctagctctcnctccgtcgatatagcncgtgctgcgcgatgctctgatacaacatgtccatattctcactcganatcattatcgtgtgtcgtaagtatcgcgtatatcacacgattagagancataccttagantcgatcactgcgtcgctagcgcgccatgatggcgcgagtcagtgtacgtcggcggagagagtctcacantcgtctcgcactcacgctaggtatgacactcaatatcactcagacaggatngcgcaaggtctatcnttatgtaagtgctgttgagattcgaatcgatacacagggaggtccgcagggtccatctcgcgatctcacatgcggccgacttcaccgtagttcgaatgagtngatgngctgcgtagtactcgatctgtacgctagcacagccgacgtggaggcgtgcagatgtgtgtgtgagtacgtgtatcatntgtantattgacgtgcacgtgagttatagcgtgatggtacgctttatatagttctctttgatatcactcacgagttctatacatatatacgttcgttaagtcgcnagaggagatgtatgattgatctacgtnggttgtagtagaatgaanttgctggaagctacagtgtagtacgagagatggagtacgctgtccggcgcgcgtcggtgtgtgagagtttctcgtgtctatgggttgagtcaggaggcgagtgggcagtgaggacgatcggtggaagcgtatcggtctgacagacaaagcaaatagaagtaatgcgtatacgaggagtgtatgtgttgtatgtnctaacancaccactcttcgtgacacgcaagtgcaatcctctatcgctagtgtatgagcatagtgagctcatgcgccattcgtcggtgncgnggctncggcgctgctcgtcgctcccttagtcatacggtcgtagtcgctcgtgcgtgaccgctactcgtcgtctactatcactcaattacatgctatcgagtcgcagtcgctgtgtgttaatacaccgtgcagnaccgggatggcgtgacgcgtatgcgcctcgctgcgctagacgctganagacgcgatgcgacggaaaacactacttacgtgttgtttgtatacgtgcgttataagtttcgtcttaattatatggagggagttgt

SEQ ID NO: 19951 - DNA, 757 bp, Homo sapiens
agtgagaaagacgagaacaaatgggcgcaaatttattagtggttttggaaaacatgattattttcttgaaagttgagcttaaacgtccatggacacaaatggaggattcttacgaaagatactaagataggacatgggagtaagacaaaaagaggaaatccatgcgaattttgtccattgagaaatccaggggaattgttttttgtacagcgtggagatttcataacatgatagtacgtgatggatttgtctcaaggtgtatgcatagcgtatatagcatcattaaaatccatgggtgaggtttattcgattgcgaaagggcgatcagagagtgaaggcttttcacaagcaaccctcctacctgtcaaagtgggggtcctacttcatttgtcatgctcccgaagaggtgtataggtcaagatagcaagctaaaccagaaccagtaagggacagtgcgcctctaaccagggagtataaaaatgcataaatagactggtgggatggtgctcaaaatcagcctacatgcccatccttggtaggtgtgagcaaagttaccaattcctataaaaaatatgatatactcgtaactgctcaatcagtaatgggatgctctaaagacaaaagagctgcaaaccctttttaaaaaattattttcagtaacagtgttactttttggtataaggttgtaagaataccttgtggataatgtggaacaaaccaaatgaatacttatgtgaatgtgaaaaaaaaaaaaaaa

SEQ ID NO: 19952 - DNA, 1241 bp, Homo sapiens
  misc_feature (1)...(1241): n = A,T,C or G
aagatgtgtgtagatganatgtatgatgttagtgtaagaaaaagacgacgatcgtgtgaatatgtctggtagatgaaggagattgtagttgaagtgatgagttggcaaagtaggantgagtactaatgtttcttaacagatcacgaaaatgatagtgtatcatctgagatgcaataaataggttgtgcttggtgtggacggtgtggatggtatgtgcgcatctcgacattactgtatgctcgacgctattatgaacgtgcgtgagtacgtgacaagaaatgtgaatatgatactgggagtcacgacggaagtagacggagcgtgggaggaaacaaaacgtagtggatagtagtgtagggagtaagacgtagctacgcagaacaaagaaatgcgcatatgagagatatggtaagagtggttgaggtgttgtggtactagtagagtaagtgggtaggagtagtgtccgtgtgagagtcagcgtgggtcgcgtgatgctttggggtgcgagtgtagagtgagttgagaagatagtagatcttagacacgtggaaacaactctgcgctgtcgtctcgaccgatgacagtctggggaaacgtctcaggctgccagtgtcatttgaacgtactctgttatcagaaataatgtaaattcgaaaaagatattggagaacgcgactatttggatgttatgacttatgaaataatatgataatattacagtaatcaggaatatgatcagagtaatagatagatttggagctatacggcggccgcgaagttttatgtcggagtgtgtatgagggtacaacggcagcggcgtaacaccaacacggcagagataaataggagcatagaggagaggacgggcagagagatgcagatgtaagtcgggcgcatataggaacacgtacgacgatatgatacaccagacagaacgccaagcgagtgagatgaagatagtatgatagtcgtgatagctatagatctatattgtttgtcatctaagtaaacgatggtactattagcgtacgtgggcgagagcaactcacttagggttgcgcctgcgtgctaggcgaaaaccgcagccgcgaagtaaatgattttattatttgagtgtagaggcgctatgagaagagtgaagcggactaatgtggtgttgaggaagaataaagataaaacaataggctggaatgaaaaagattggtaaggtaaataaatttatatacaaaatatgggaagta

SEQ ID NO: 19953 - DNA, 155 bp, Homo sapiens
gagaagataagaacccttaacccacccccccccggtttgctatgaagaagccatcattctaccatcaaaatactttatgaagatgaagtgagattggcaaagagaaaactgaatgtccctgaataaaacctctgtagtctggaaaaaaaaaaaaa

SEQ ID NO: 19954 - DNA, 450 bp, Homo sapiens
gttttcaggctacaaactacttagacttcaaaggtttgcttgatgttacatgcaagactgttgccaatatgattaaggggaaaactcctgaggagattcgcaagaccttcaatatcaaaaatgactttactgaagaggaggaagcccaggtacgcaaagagaaccaatggtgtgaagagaagtgaaatgttgtgcctgacactgtaacacagtaaggattgttccaaatactatttgcactgctctgtttataattgttaatattagacaaacagtagacaaatgcagcagcaagtcaattgtattagcagaatattgtcctcattgcatgtggagtttgagcacagatcccaaaccttacggccaagtttcttctagtatgatggaaagtttcttttttctttgctctgaataaaactgaactgtgggttctctataaaaaaaaaaaaa

SEQ ID NO: 19955 - DNA, 1332 bp, Homo sapiens
  misc_feature (1)...(1332): n = A,T,C or G
caccagcgaattcatagtcggcagcatactctcacatgagaatattatactatccacctacctaccatccctatacccctttccgctgtgctttacgttgatttttgattgttcttatatattacggctatcattatattaccaggacgctaccgctccacgcacccgccccagttcctcgctccctccccctcctcctcccgccactctgggcctgcggtctcgcctccgttcactcttcctcagccgcagtgcaaactcatnccccgtcctcgggtcggccnnctgaagacccacttcgacatctagcggactctgtacgtcactcggtcncatctgttcccttcgagtccccctggctctgtccccgaccgccctcccgtccgccacgacgagcacgatcgcaatacgtacctcacggcccaacacgtcgcgtgcgcgtcttatttntcataatgcccacgtatgctcgttgttatgttcgttcaagattggttaagagtgagtntagaggaagttatgggtggataagtactattgaaggctagcacgagctgttatcatatctcttantgtctaatttcatctcgtgacgcatgtatctatatctgtcggtggccagagcagttggccgacaagtccaacagaatctatcatngatagcggagtccccagtaggagtaagatatnnatacgactaccacacatctgctccccacctacatttccaccaacatcgtcctatggtgcaaggctctgatagatgtgtatattctctttgtctggtagcgagctagtgcgctggcgcggtgccntngtcagcgcgtgtgtagatntgtagagagtcncatatatatgactatctncnactccncacgccccgcacggcgcttgactacgtgcgtcgatagtagtagcatagattgntctccgattctcctgctcctcatcacacctgctctcttctccctcgatttctctatacgactgcgccttatgtgtgttctatggatatcttatgactnactagtgtgattgtgtggtatcgactatctgtggttctctatcttctatccatgaatgagnagatcattaacatatatagcggatgcnaacgcgtgagtatgccaatcatgctgntcgctgataggtgtttagattggntgttattagagtgtcacatctgtgtantcgttgtagatgtngntgtgagtgttcnatattgaagagtgaangtacgtatgacacttgtgtaggcangacagtagattagttctcaatgacgagcgannctgttnctagactncgatagagaagtggtataagaatgat

SEQ ID NO: 19956 - DNA, 200 bp, Homo sapiens
  misc_feature (1)...(200): n = A,T,C or G
gatgggtggggtgtcgaggtgagtgggggaaaccaagagaggcttatagctaacgcaagtaccttgtgtagaagnatctacatccaatgcccagaaaacacatcctacacaggcacagtgaagcggggagtggaagaattttccagtgagttccatcaaagtaaataaaccaacctagagcatcaggaaaaaaaaaaaaa

SEQ ID NO: 19957 - DNA, 335 bp, Homo sapiens
  misc_feature (1)...(335): n = A,T,C or G
ctgngagttcctgatgattgtcgtttttggtttggagttcatcattcgaatctggtctgcgggttgctgttgtcgatatagaggatggcaaggaagactgaggtttgctcgaaagcccttctgtgttataggagtcaggaattgttgcgtaatcttctcagtttcctcccttactcctgttccctatggtgggggcagagtggatttaaggaagaaagtgtatcaccatccatgggcactgttaagaagaatcctttattccatacttctttcatagtatgcacatctcaaaagtctccacttattaaaccagaatttatggaaaaaaaaaaaaa

SEQ ID NO: 19958 - DNA, 847 bp, Homo sapiens
atattgtatgtcgttgtgctatattagctatactggtcgaccggaatgagatatgctcgtagcgcggagagagagagtgttgtgatgtttgacgtagctagattgtgagaggtgcggtgatgagcgagtcgttaaatgcggtgagctgctagcatgaaagctggttcggtgatgcgtgctccggtgtgtactgtctgattcttgagtggcggcatagagcgtagtgtggtgagtgtggttggagagagtaggggccgtataacaaaacatcgtagcatatctatccccatagcagtgagtgtttgtgtgtatggtggactggtcgtatgtgtgcgaggagtggtcgcgtgctgtccgacgaactgtatcttgtcgttctcgctacgtgtcgggttctatagttttctttttatcttggtcggaatctgtggggcaggggactcttgtttctgggtgtggtctgagaacgtggtttgagaggacatgttgggtgcgtgcctattttcttttgttggcggcctagtctccttaggctgttgcatggttggtgggttgtcgtggggatgtgatgccgatcttctgaatattgtaaaagtagtgcgggtttgttagtaatcagcggatgttttatggaatgtgtcgtagtgcaaagtcgtgacttagggagaacgcaaaccccattaattcctcttcgtcagtgaagtgttatttattggccggcggaaagaggagatataaaaatgtattttataaaatagtaaagccaataaattataacaaaatgaataaaaatcattgaataaacagtgaaaaattataagatataaagccaaaaaaaaaaaaaaaa

SEQ ID NO: 19959 - DNA, 1077 bp, Homo sapiens
  misc_feature (1)...(1077): n = A,T,C or G
aataaaaacacatatactaatctaacaccacgatacaattatttatttcagagacaacaacaatggtacacagtggcctacggtcagagagttcatggaaatttgctggttctgccttgaacactcagacctgaagcacacacttcctttagcatgggcatgcagctaaacacgcgagcatacacagatcccagaggtgtgagaagaccaatctcatccgagtaattcctgccctggctctccctatccaactaggtatattgctatccttcattaccgttataagtcagatcatagacaggttatattcctatcagacacactgaacctaccgtgcgtacgctagtgccgcgacctgtgtccttaacgctacttccacgagacttacgagtctgtgtctcattactgcacatttaagcacattactgtgcatagatctatatggacttataaccaatccgcgctattctatacacccagctccccttctacccttactgtatacagagcaaaatcaagtttctcaaggctatagttatcatatgacaatgctttacantcctcttatgtgcataaagactgtaagcgtagggcgccgaccgctccgcacaagtatgatcgcaaataagtcgcgtacataacgtcccgtgacccactgtattatagtctgctagagtaccatgtntgactagctttttagtcttatctacctgtcccaccatgttgacacctcaagtaaatgactcatgatgatgctacagcgttagtcaattaaaaacacctatacttgtcgttcgcatccaggatcagccactagacgagaaactaaactactgccccatctgcaactattaaagagaggggagtgatttatatagatcgcgacctccctatctatctatacgtgcatccctcatgatatactaaacaacattagctcactcgctcagtactccatttacctacaccgctggagatattgatctattcctaccttataaacctaggataaaaactcgcgaactatagagaaaggcaaagtcgatgcacgacgacggtctgagatacagatataat

SEQ ID NO: 19960 - DNA, 927 bp, Homo sapiens
ctgctcacgagccacagtacaatccgtatcgtcaccttttttccccaccctatttgtaaatttgtgaactagcacaaagccaagttgaagacaatatcttccctaaaacagtagtgcaatgacagccagccagaaaagttctccaccttggcagcaatgagactaagacttttatgcctgaattgctatcttttttttccaggattcgaaatgccttgcctggcccagtctcttggaacagaatatgccttcaataaatatgcatcgatgctgctaaacaaaaatctcaaactaatgcttacataaactaataaatgataaactaacaagatctcttccatgtttctcccactccctctctccccttcccctaccctaccccctatcgtccccctcgcccaccctctccaccttctcgctcccgcccccccacctccccccccccgcccccctaacatctaaacttacttcatgcatttatttacgacacgtgccccctcacccactcccacctccactccctactctttcaccgcaattcacacatcctccacggcccctctacctcccttcccccccccattctccttactttcttttctattttacctcacttacctcggctcgtttgctccctgcggagacctccccccctgcgcccgccccccactgcgctgccgaaccaataacactacccaccagcatcaccccagcctagcccccctccccacacatactgccccactccctacctcccacatcacacactctcatctcgcagccctggcttcgtaccgcccccttgcaccgtccctgtgctcgtgctccccccgaatgtagtagtgtcgctgtaccatgattccagcggaaaccttcatcaccttacactttcctcttctacgctacacgaagtggttgtagctttcg

SEQ ID NO: 19961 - DNA, 760 bp, Homo sapiens
aggagatgataatggccttcctgtctctcatttttgcgtgctgacactgggtgacaagcgacagcactatacagcacgtggctgtcctatccactccagcgtaaacgacattcgtcagacctctggagtgaggagaggaagacccaaggtgctggggtacctgtacgaaacacttatattattgactctgattacacacgtagatggagcgtacctctcgttggcctaatagaagcctccagcatgcctatgccatgtggatagctatgaaaggatgtatatactgactatgtactgtattaaggagtacactgagggttgcactgagaactgggtgccaccggggaacatgatgctactacctcgatgatgtgcctttgctctgtgagccttacgactctcatggctttcacaggtacctctctttttctacctcaagatagagatactttggcagatgtctatttacgcttactcaaaagtaacaccgtactatgtgttagttcaaggactacagctgtggtctttttttttttttgaaaccatagtattgtctctttaagtcttttaaatatcactgatgtgtaaaaaggtcattatatccattctgtttttaaaatttaaaatatattgactttttgcccttcataggacaaaggaatatatgggttggaattttaaaatttgtgttgccattggtaaatctgtcactgacttaagccgaggtataaaagtacgccaggtttatgtccttgcctta

SEQ ID NO: 19962 - DNA, 341 bp, Homo sapiens
actaggtctttttgccattcctccatgacatccaccataaggaaaggagaccctggaccaacattctctaagatgtttatatggaccagtggccggacctcttcatcttatagacatgatgaaaaaaggatagctaccaagggaatctgaatttaaatgggtgtgacagccaaggaggaaaaactttctttcacattttgctctttatatccatatttgtatgtgcatggcctcaaaaataatttgtttatgaattatgggctgacccccaatatcaaacttcaagaaactacataaaaggagctcaaaataaaattttactaggttgaaaaaaaaaaaaa

SEQ ID NO: 19963 - DNA, 922 bp, Homo sapiens
ttttcagagttccgattcacatgcaaacaatatacggaagcaaaggatgcactcaaacaaacgacggctggaacacctttccagtgaagggagccggcgtgcctactcactactagttccacaagagccagggctaatcttttggggcactactgggatctggagcagggagagcacttaggttgttactgactgcagtgaatagagcctgcagtgaaggtttaggagctctccctggactggtcagttctgctgagtgattttggatgatgttcttaactgtgggcctacaggccagacctctggtcctctagagattctgcaagtttgctcaaaatccttttaataaatctttagttcacctaaaagaaaataaaaacaaataacttacaattgaaacttggataagatatttgtaaatagcaaaaaaaattaccaaaaatgtgggagtttctgcagatatggggcttccttggcctatctgcggggtgactttcagcgcaagttctttttttggggggggtggtttctttgagcaccgcttacagagaatttggtgttcggagaggtcgtcgtgcgggagaggggttccacttcctctaaaggcgggatatcggtttttcctacaatggggggttagacctgcaaaaaacttttgagcatcaagggcccataaggcgtcggaacgggtaaagggggcggtcggtgggtgtattcctctgctcccccccccggcgggctgttacaagactccgtcctaatctagagggcgggcaaccccgcacgcagttgatgaaatctccgggctgttcccctggcgatagcacttacggctcttgtttgactcgccgtccctagtccggctgcccccctccttttatttttggaaggtgggtgtctgtcatacctccgcggtgggatt

SEQ ID NO: 19964 - DNA, 1185 bp, Homo sapiens
  misc_feature (1)...(1185): n = A,T,C or G
ccggcgcgccgtgtcactggtcgtctggttgcgantcggagccttccgtcagaggcaccatacgtacttagtaatggtatgggatggggagttatcgagaggaaagtatttggctcattaatttattagatcggaagtttagattcgtcgtaggtgaattactagatcgggagtaatggtaccggacgtgatgctcgaaggccggcgtgtggaatactactcggcgacatgggcagtcgggtagggtgaagagtcgcgcacgggtccgatattcgattttagttggttgaggatttaatactagatggcttgcgcggcggtcggcgggagctattgactgtcgcggcggtggctcgcgatgagggcccgttgatgacatgtatgtagatatgtatgattgcatgtgcgcctgcggtatgtnctttcggcacacgctgctagtgcgggagactactctttcctgagcggactgattcnttcgttcccgtcttagagtcttaatcaatgatacaagacatagcgcacatggataacgatctcctcgcgggctttgcgattattcaagatagaggtgggcaaagattgtacaagcgcgtgaagaatgccggcacgctacgctgcgcttattgatgtcaagggtgatatgggtagcggaaatagactctggatagaaagatgtcaatcgacgacgattctgtagcgggacgaagtatgatgtgtaggcggtgcaagaaagacgttggtaataaagtaatttttattaggaagagagactcgagcggaggctggcccgccccccccccctctgagaccgagattcgcggtatgagtatccatcacactgtgcgcgcaggaatgctggcccggtcccatgaaagcagcacgacggggtagtcgggcgagggtaacgtaagtcgaggaaactaccgtgggatgacgtgcgacacacacacacagacgggtcaggtagatgcagaaggctataataattgtgtatattgtagaacagcacccccacccctccgcacaaagaagagaataaaatagaaatacaaataacagagtaaagaacacaaagataaaatagagtgcggctttctgttgcgccctccacgacgagtggcagttcaggtccgtgcaggacnntcccctctcttctttcggcgctgcctggtagtgtgtgct

SEQ ID NO: 19965 - DNA, 780 bp, Homo sapiens
gtccgtgttttatgtttggccgtcatattccggattacagggtcgggcgatagggtccaataccccaggtaaatgacacgcccgtccgattgtttccctttgtatgacggatgggtagaatatccgccggtgggtggcgccagagagatttactgagactaggaggagactctcgggcaagtacaggtgttatgtgataccacactcgattctaccacaccattaatccaagcccgaatgttatattttccttactgtctctttgccagagacgtcccgggagagcactattagtatctcgtggttcgcggttattacgcccccagttatagggcgggccagatgaacttctagtttggccaaagccagcccttgatcttgaggtggagcttacatgaccccaatgtaaacctgtcaggccatgtttctggtccctctctgggggtcttcttcggcgttttaacaggtgtcttcagtcagggaggacaggttgactgcggtgagttccaggacaccaaggtctactgcactcgggaatctaacccacactgtggctttgatggccaggcatatggcaataaatgtgccttctgtaaggccatagtgaaaagtggtggaaagattagcctaaaacattctggaaaatgctgagttaaagccaatgtttcttggtgtctttgtcagcttttgcagccttcttttctcacttccgcttatacttagactggtggattcctttattcataaagacatactatactatgcatgggtcttgaggag

SEQ ID NO: 19966 - DNA, 801 bp, Homo sapiens
  misc_feature (1)...(801): n = A,T,C or G
ctttaggagataacaaagnccagttggttgtgaaaatgtcctcatcttctctgggacaggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcctattaagaatcgccatgcctttttcatggttagtgttcaatccatatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaatacgttttggttttgatatctaccaaatattgttaaatgaatatataaccctgacaagattgacaaattacatactctgcaaaa

SEQ ID NO: 19967 - DNA, 1349 bp, Homo sapiens
  misc_feature (1)...(1349): n = A,T,C or G
gaatacaaagaataatgtactccccagctccgctcagcaccgagacgcgagcatccctctaacctgatactatcgttcttactatatacgtagtaccgcccgccgccgatggtcgcggccgaaaataagatgagccaattgccttgaatctagaagatcagaggaatccttgttcgataataaggcctgcgcggccggccgtgtcagtttccttaatgtagacgacaccttgccagttgactgaccctgttccttcaacagaagcgagactgatgatctgagattccgttactacttcttaatagtcgagtcatggttttactcaaacccctgctataacactttatactgaaagttcgtaccgccctcgcgatcaacacaatttatatttcataaatagttaatcgatgcggtgacgcgatagtctgccgtcagcgtatcgccgtctcggtgaaggtaaacgaacagacacagaatattaatactcagaacagtttggttatatgactgcgagagacatgcaacgtgtccggttcacgaaccgacgcgatgtataccgctctgtgattgtacagtatgaccttgcgacgcccaatccgctgcgtcgtgtgccactctctcacgcccgtctgccggtgcgtcgtcccgcgtttgagtcaatccggtctatcaggccatcctgaccctctataactcttaatccttcgcggatcggtgggctgtgaaccgagatagatgagtgcatgtattcgatatgtgatacgtatcgacggccagtgcgataggctattccgccagcgtagtcttaccgagcgtggctaagcatagatgcatgacaatacgatcgcgcctgcgcacagttgatcggggatatcgacgngattgtatatactntcacgattcgcaatcatgcactctgtgtatacgatcgtgtacacgaccgctccgccncgcgcacgcncgtggtaatgtatatnaggtgantgtagagtacgcgcatgcacccggcganctgcgtcatctatgcgtgagcccccttgtcgtgttacgcgctctatcacgttcacctgtctactcgacataatcacggttatcngaagctgatactgctgntactgtgtgatgcgctgcgcacgaagcagaagcgaggcgcgattcactgcgtttctcctcctatattctctacatatgattgtaacagcgnagtcggacnaaccgttacgctgtcaggacgtagcaccntgcatcgcagatatgtctctctatctacgcatacgaccgacgcantgacgctccntgcggtcgtgtgtcagnactacgaactagtgctgatgccagcatctacgntg

SEQ ID NO: 19968 - DNA, 1670 bp, Homo sapiens
  misc_feature (1)...(1670): n = A,T,C or G
gggggtaattggagtatgtggttatatatatntctcgttgttatgttagctgtgcacgagacggactgcatgagagctgtctttacgcactgttagtattagattatctattatactttaatgtatttgtgtgtacttgagatggtcgctatatagtgattggtcgtgtgctggctatgctattgagcatatcatcgtgcgctctctcacctaagacatagttagtgtagacagtcgcgccgtatgtcgcatgcgtataaaatnacacgagcgacataatgagcacactatagtcaccatcatcactacacagcgtcacgtcgacacacttatgactgcgagtccagctgagccgtgcgtgctgcgtgtcgcggagacatattcgacacgacgccgacgtagcgtctgtatcggcgtcgtgtgttcgtatataacctcgcacgcgtacactgcgcagcaaaacgggtttcacatcattataatatactgacaatcctcgtgcccgctctagacattcagacagcatatggaatgtgtacattagtcgtctgcgctgcggccgatcggcggaatcgcacgcacgctctactgtgactgttctgctctcggtaatgctcgcgcgctgcgtctatacgagatatccttgctatatcgtgcgtatntatcagagaacgaagaggattcgcgccacgagtggcgaaagcgatctgtattacatatattctcatgctctcttgatgttgtacgaggtgatatcacgtcagttacgtcgatgtacacccgtgacacatagttctcacatcncacctctatatcttagctgcaacaagctgtgtcaccaatgcctgtgcctcccntggtcgtcgcttggtatatgatgtctgcgctttatcagaacatcaacgacacttntgatcttactgtgatcttgtatagtcgtacgttgagcgcacagacgatcgatgttcacatcagtgacgaatatattagaataacgtatccacatatcatatatagtctataatccgcgtccgcgtcgctcnatcgttctctcatcattatctctcaattactatcctatgtntaatggcggtgtgcgagtgttgctgtgtgcgactcacggacacgtgcttgaccacgnactncactatcaacagtgtaatgtagtatatcgaccatgaccgcactgtctactagatacaccctcgttagatcatattacatatgatataacactgtccncgtcgcatanatgtactactatgatatacagccagctcgctcgcgccgtcacagttgagagngtaagtggntcatgggtgagcgtaccgaccgccactgtgccgcnacgctgctttgagtcaccgcgtgcgtgatgcgctatagacgatttgcagcgatagtctatgtagattagtattatagacgaaatgtcgccctatactcgacatatacgcatagacantaatcatacaacgtcagtatcatgatgtattacgtcactattgtagtgtanctcntgtgtacgcgcactagcgtagactcgcttactctgacagctccactccacttctgcttagtatgtgcatgtacacactatatgatcgtacattgattactatcgtcntcgtatcttcattagagcagatgtagcgttagtctgtactcgg

SEQ ID NO: 19969 - DNA, 1274 bp, Homo sapiens
  misc_feature (1)...(1274): n = A,T,C or G
gtacaactatcacaatatatcatacaaagtcgcgctgttagagtgtggggacgtgaaatgagaggcgacgatagggacccgtgtgcgcctctcatgtacgagttcgtatcataatcttcaganattcacggcactctacgtactacccgtactctcaccacatgctgtcgtcgatttcggcgatgacgcgagtgtcacaatcgtcgcaattgcgatatgcgcagggagagtgcggacaggagaccggttgacgtcgtgaagtaacggacggtatggcgcatgatcgaagaatatgaccgcgcaccagcggctcgtgtttcgacgtacatgtgttgatggaggatggttacaacagacaagttgctcttagtcctagtatatcgcacacggcttgtcgtcttcacacgtatgatggtgctgggcatcaagtgtggtgatttagcgcgctaaagcacgccggccgcgagtgtgaacgcantctagtagtacctcttgcggacagttacgtcgcgatgtcacgtatcgtgccggcccgtagtgnacacagtatgtgtaatagttgtttaccatgcgcgggcggtgctgcactgcggtgatagttgctagtattaccgagcgaagtgtgaagcgtaacatactagacacgatagtgtattatatgacgcgcgtgtagtgacacgcggttcggtggcgccgggtacagtgcacccagccgcttagataccgcactgtctgtggttcagacagatcgagcgcattcgcgtacccacgttcgattctcattgtactaactcatagtcgagcactcctactgtcccgctcttggtgatcatgtgtttcgagcctaactatcttacggcaggtaatcgttcggttacgagtgggtgcggttcgtattgtgtatcttaagttagtgtactgttatcgccgtgatgtattacgcgcgttttttgacggtgtgagatataaatattccttaccctacccctgacgcctaattaattaataacacataactcctgtcctctattgccgctactaccgagagttagatatatagtatgtctccgaacgaccacattttatcgaccgtatttcgattatctccactacataaatgcttacactatccgctgtctgttttccttactacctgcagtctattttttctcggttatatatttctttcgttgacgttaagttctggcacttgccttatttattctatgcatacagcgcagatgaccatgagagtactggtaaaattcattctg

SEQ ID NO: 19970 - DNA, 1282 bp, Homo sapiens
  misc_feature (1)...(1282): n = A,T,C or G
gaactgacattaagcccgcgataacacattcaaccacagaccggaagatctgaagattggacaatataaatgggcatggagttccgacgcaagaatcgctacaaaccaccatatatccgattaaggggcgaattacaggcgagaggggagtcttataaagcaagaacacggaaactccggccgaacgatgagagttagcccgggaagatggtcttgtagttaatggcgaggtgagtgcggaaggttcgaccatatttcaggctccacgccagtccacccttaaaggcaattcatgatgccgccgccatagcacatcaacacctgtcccacctttaaccgtgtgcaattctatcaatatcgtctgtatgatagaataccaccacatgttgcgcgctccatctgcaccctgagttaattcagctctcaccgtgctggtgtcgcgtcatgacaccgtctgactgcgccggctgtctatgccacgcgngtgtgtctcgcgagattgtgcgtgcagcgtatcatatatncgcgctaccaatgagagacacagcgcactcgtctagtgattactctccgcgacccgcgttccacgcgcggtcttcgcngtgtcgctaggcgggtgcgtgtntcattgtgagtcagacgaactataagactantaacattatagctatatccgtactctcgctgcncgtacgtctcgctcgcgccactctgcgcgcntatcatcatactgcacatatcgacgcgtaagtggattcgacatatactacactcacgttatgtatactatctatcctgtcacagctagtacatatgcacgacgcacggtaaagacgtacaacgaaatcgcatgcgccgcntcgccgcttgcgcgctcctctagcgtctgaccatatccgcgcgcccacgatgcccgacgactgcacattatnttcacccggtccgcgggcgcatgtgcgtcattaccgatgagtacgacagatacacacgaccgcgccgttgggatatcaccgcgtacgtataccccctctctctgcacctcttcatctctcttcgtagaacactcattctcgcatcgtcgtggtgtcgcgtacatctggatcgcgattgtgtntatgagtatccgcgcgcgaatgtgtcagttgttgtcacacatcccgcactatgctatatcatagtcacacgccaacggagtcgtttgtataccgtatcgcacaatccgctcagcgtgtataagangaatcacgagcaactcgcatacgtctgtatgcgatagctgagc

SEQ ID NO: 19971 - DNA, 1451 bp, Homo sapiens
  misc_feature (1)...(1451): n = A,T,C or G
gatcgattctgctaccagattattactttatcgtctgtcgcgcnctcgcncatagctcgctgtggctcgcgctacgactgtcatctatntcgctcacatgagtttgtggtttcttgtatgaatcactggctgtgtctatagagtgactactgcggtcgctactgtctagtnacctccagattcatcgcgatcgagaganacgaantaggagccaatacgatcgtacttattatgtttatatattattgccgtatctgcagtcgtctgttattcatgtctcccattgtgtcatcgatatcggttcatgatgtatgacatangcaccattntacgacaacgctgacatgagatntataacgtgttactctgcatatagtagtgccatccacgtctacacacatcngctacaactcataacttagtgccgcgcccaccgttcacagtnatatntcagcaggcgtgtaattgtataagctacgacccccgccgcgcatacaccctcatctattgccacattctcctgccgacacttcacttcttaatttgcttactatcttnttattgtttttatcaaagtctgtccatgacgcatccttctcgctccgcattgtcatctcgaaccatcgtctacagctcccgctcgttccacagcactacatctcacatcagccgatatgtctcatcgctcaaccgggtcgtatgtatctagtgtggtgaggccggccgtcatgtgctcataaattctgtctgtatatcatcgatcttatgtatcaccatcgtcgctcgcatacccgttcctcaccacgtcaaccgtgtcgtgctcgctcatcctcgctccggctcgccgctgcaacgttgtctgtatgtgttacagtagactcaagtgtcatgccagccgatagaatcgataccgacaagctaacgcttagacacgcagtacatcgacagcgagatacgacactgatatttcaattaacacacacttgattgatacttagtgcacccgccgacctctcagacccaactctgtactatatatgtagagtaatctccacgatgagagcgtgatcactcttgttatactcntcgatttccacctgccgtatcgtacttagtgttataactgcatcctcctcgcccaatgtatagtgtttgcctatctctggtaccatacgctctctgtgctatgttatatccgcgacatatgtatcatatctagactacgcncgtatcacgatattatagaattagacaataatcacctacacatagtatcacgttcacatcgacagcattcgtagtatctgttagacgcatcttatgtgtatntatgcatgactgtaatatgattaacattacagcttgcccgaacgctcttttatcgtaaccgattccaaccgccgttatacctcagtctgatgatatcatagtacaatatcacacacgagtag

SEQ ID NO: 19972 - DNA, 1186 bp, Homo sapiens
  misc_feature (1)...(1186): n = A,T,C or G
tgaggtggctcagagtaagatcaagagaacgcgctgagtacacggaacacccacacgagcgcgcacatgttgaaggacgtaatataatataanatccatttaaatcagtcagtatgcacatacgtcggccgaactgcagaacattagagatgtgaggtcgcccacgacgaaaaanatcaatcatataagagcaatccgacaccctcacacaatatcaacgcacgaccgcacgagcacatatagtttgctaattaatggccacgctccgttcggccttggtaaccgtagtatgtgtcgacccgactaactacgaatacggtggggtttgaccgcagcagagcacggaagtgagcagcaatcatatgaaggtgttaacgaacgcctacatcgcgatcctcgctacaataagtaataagggagcgcactgggagtatgtgaccgaccctagtgtctaattttgtctcattcgagtgcatggcatgtgcgtatttcgtctactacacacccgtgttaataagcgcataacaaccggacataatactatacgggatatatgatacaaggtccgcggcccatatcataccaactctacgactattcgatcacctgttttttctcacatctatttcacgatctagtgcaagaccgtcgctgtatttcgtacactaatctactcctcgctgtcactttcggaaagtgtccgaggtcacgactcggtggcatgctccaggtttccaccgcgatcgcgcagtcttcacagaatctgtgtggcccagatccactctatagacttaatgccctatttagagattccgtgcgcgcattgctcgcactactatatattgcagtacaacccatccggatggcgcgtatacttcagtagcgcgtcacgtacgcgttttatatatcacccccgcccccttttttctacgtcgagatgtctgccccgccattcaatgtcccgcggttatacgctgagaccaaccgatacaatataaccaatgagacgtaccaatgcttatttgcgctatcagaggaccatctatcctnttttctcgataattattgcataccagataccaactagttcggtatctgtacccacactcctgtagttcactatcacagataccatccacgctagattagtacgattgcgtatctatcgtctatactgcaacgatat

SEQ ID NO: 19973 - DNA, 723 bp, Homo sapiens
taggaactactcgctgtggctgttgaaagcggttgagacacaggactgcaggatgaatgcgctgggagtgggatgagagggcaggcagagaggaacctacaggggctaagcccagctcagtatggccacagctaggagaggaaggctgactctcaatccctaaggataagataccacaaagtgagcagcaatcaaactggagctacaaactgaaggctcagacctgggatgcctcccttggggagagatttttttttccctggcccattctttttctcttctgagtcagcaaagaactccttcttcctcttctacggcatggatttgactctgggaggcggctgcccagccgaggaccacgttacccagagccccttgcatccagatacggccactgagttgttcttgctgatggactgtaagtggaaggcacctgtgtctcttctggcccgaggtgattaagaagcaggtgtgctttctccgtcttctctcttctcctttctgctggcttgaagtcaacatccagggtgatctgggaagtcacatttggaaaaccgcagagcctctattagcctgggtccctgagtgcctgtgcggagcagagatcccccaccccaccctgacacacatgcatacttaccattcagacctgaccaaccttaaagtgtcaatacgtgcaagaaataaacatatactgtggctgagccattaaaaaaaaaaaaa

SEQ ID NO: 19974 - DNA, 1104 bp, Homo sapiens
  misc_feature (1)...(1104): n = A,T,C or G
atatataacgggagttgacattatgcctctgtgtagtgatctatcgctctcgttctaccttctagcgtacgtcgcccttaccccgctatttgacagccagcctcgcgctcgccctcacctnaccgtctgttacatcgcacattagtgaaggtgagggcagcaacagcacaggcaatggaattaggggtgaagaacaaacgggcaatgaacgagggccaagaccacataccgcgggggactgccacatggtgacccgacaccaatgctcatgcgtatggcaaccagcaatacgtatgccgtcacttaactctcacgacgggcaagcgcgggtaacacccagtatgcgatatcgattacgtgtcgcccccttaacacgcatcatcgcgttgggcagattgaaagaatcgggaataaggccgagggataatttcaggtgcatataccgggggggcaaacaacgacggaatagggaatcggggcggtacaatggggtaataaacgagcgcatgggaaaaggcataggtcgaaataatacgtccatcgaaggcgaactcgtcgagcggggggacggtacgagggcgccgcagtcatcggcgaatgcacggagatggtaatgttatataaacgggcgggggtgtggcacggaaaggtggtgggggtggttcgggctactgcggtcggatgcgatacaacgtgatgctattgcacggtttcaccctcattccacaaccaacacgccaactggaaacgcaccaagaatgtgtgtgtgaggctgtggaaagcgcgttacgtacccaatcaaagaagttgagcggcggtaatgagtggaaatgcggctcaacctcaaccgacaaacaacaaaatatctccgagcttgtgtcacttgtgtaccaaccggcttcgtaacagtaccggaccgtgtcaattatcactaatccctctatcaccacgacaatcataggtagtatgtcggtaccatataccatcaccaaacttgtgtcgttccatgcgtttgaaaacggttctcgtcggtttgcccgcctaaaccctgtccctcccgcgtttaacgtgtataccccacccgcactccactctctccccact

SEQ ID NO: 19975 - DNA, 963 bp, Homo sapiens
gtttggtgcgcgacggattgcggagaggtagagcgtgctagatgaatcccaggcagcaatcgtctttgatactgcgagatgaccaaaatggaaaggaagaagtcataaagagaaaaattccttagggggcggggcgggaggtgtatgacaataaacccataataccctacatactcaagcgagattcttactgtgactgagagaataagatcatggatctacatgagatagggcttcccgaccccttagtgcaagatcaaattgtgtttgagggagaacgggagaggggggcggatgtggttgtagtgcaatgggggaatattgaatgtcttgcctgcagtaggaaagagaggagactaagcgtcgcagtcttgggcgagaggcctcagtcggggatggttgcggcatgccggggggatgagcagccggggcggccaggaaaatttacgcgatgcatcatatgtgaattcggtggcggtcgtcgcgcgggaggctgggagttggagcaacgttttggacggcaagagcgcgaggggaccggcgcggtagatttggccgcgaggctggagcgggtgcgaattcgtgtttttggatgaccgagcagcgggcggagtgagtagctcaggtggtatgtagtgtatctacatcgggctggtgctaggttgcggcggtataatgggacgtagtatttcacgggattataggtcagcgtatcggggtggaggcgagctgcgcagagcgaggtggacggctggatgcgagcgctaccatagtgtcgcgcccctaatacaaggtgcctctgagtgagtgttgcggctggacggtccgtgctccgcgcggtttgaggtgtcgagactgtggcctggccaggcgtctcactgttcgcgtatgtagcacccgttacgggcgtgtattgtttgggagtcagagcgcatatggagctaatgcaacaccagttataat

SEQ ID NO: 19976 - DNA, 1328 bp, Homo sapiens
  misc_feature (1)...(1328): n = A,T,C or G
tatcgtatgtactgtgtggtaggttatgagggatggatagcaaagtgggtacgcagcacgcgtgcacatcgagagtttcgaagcacacagcgagnggagaagtagtgataggatgagcgggctggcgaggagtgtcagggtagcagataanggatagagagaggactatatagttaagggtgatgacaacgatgaatncttgtgaaatcgcatgtgatgaaggcgacgnaggatgattgtatctccgtaatatcgcgtgctgatggagncgtagaggtgtgaatgacggatagggcggaggagtgacggcggtgnccgatagagtgtcgtgtgaggtaagacggctgagacgtcaatatatattgatgagctagttcgtggacagagagagtcataatgtagttgatagcgcgatgcgctggagtgaggagncggggtgggagtggagcggcgcggggtgtgtggtgtgttcgtgagtgcgtgntgtgtgtgcgtagagtgtctatgtagtcgtcgtgcggctggggctggtgtnttctcgctgttagtctcacgcacacggagctatttcagcgtcactacactcgttggggcgttatgtgagagtatgctgtgatgagggtctgtagatcgtgacgatctattatcgtacaaataatcgagcatttatattggatacgagcttgaagggtgcgctgggttcnaccatgcacccacacactcgcgcgtgcgttcgtcggtaatcatgattatgtctcgccttacacgatccgctccgcacggtcagtaaagtgactgcgcatccgttggccgatgtagtgctgtgtgggtctgagtgtagagatgttaattctgctggtatgtgtgagcgacgttagatagtgtcaggtcatgggtctctggtgttagaggtatatatttatcgatattcaattaatctgtatgacaacttctcatctgatctaagacatacgtgccaatagtatcgaatctatcgtaacagattcatatgagcattaaactatgaataatggaaaatacgtatcatggagctggatcctggtgntagcacttactntgtcgctgtgcgtgatgagggtgatggagtgtgagggctgcactcgagacgtgggcgtcgcgacgggaggaggcgcgcggcgcaggcgggatcggagtgtgatatagtgagacaattaagctgcggtggtgtggtgcgagggcgcgcggtcggagcgtgtggcagtggtgctgaagcggtngtctgagaagtagggggcgtgaagagaggaggaggaaggcgtcgtttgtgagtgctatcggtgcgcgat

SEQ ID NO: 19977 - DNA, 184 bp, Homo sapiens
gagaatataaaagaggacatgaaggaagtgtaccaaaagatcttcagatttgaaattacctttccaaaactgccctttccgatcactttcaagaagtgaaagtcagatggtttagcatgaggattggacgacgggccaaggttgatttgctgagaaggacttggctagaaaaaaaaaaaaaaaa

SEQ ID NO: 19978 - DNA, 1572 bp, Homo sapiens
  misc_feature (1)...(1572): n = A,T,C or G
acgcacgagctacacctacgtggcacagagacggaggcagtcgtgcgtacataacagctattatcagctgcgttcatctatcgtgactcatantgttngcgcgataactcgctatcntgatgtacgcggtttnggagannacatntngnctctcatcactagatcatnanntgaacatcatattcgtnggcgagccgactccganagctgcngcgcgcgtcatgagatagtgtacgngaacgtnccatcgtnncgtgcgattcgaggcgtgtgtgacgtgcgaggtgntcatgtatgtgtgggagagcgtgatgcgtgcgccaatcggtacgcgctgtggacgagtaagtgcagggtgtctcgatatangnangcatctancacaagtcaactatgtgttganacctgtatagactctctcgtcgngnacgcgctatacgcgttccttcncctactggttangatcaactcgagcatctctcgtctgtctgagctatgnngnncgctcctaatccgacccacgcntctaactcnaccgtcctacattgatgacatcaagcgangnggngtacgccgtcagtgtgttctacactatatacaaggcgagcatatcaacatgcgacnagacanctcgnaacatcgcacctcgctacacantcgngtatactacataacacacgtaagcactcgacaagactggagacgacttantgcgtatccttcatacagncggngancatcagccaaccacatatgtcacatcatcagacatgtngattctctctatgtagatgcaagttatagtttgctagtatctcattgtgagngagatatgacatacactatacagttacatcgtgtcacgtgctgcacaacctgcggccacaacacaccgaccgggngcgacgcgataccgtnangagtgtnnccactctcatcgtatactggacatccacaccgtctgnnggaaccagagtagcttgtacttcttcctctgttctcttcttcgtngaacttgcccatnaacacttcgcgcagggttcttacgtctatgtgttcctcacacagcatgnaagtaatgtnatatcaaatatacatantattctctcctatactatccttctacttcaacctnnnnctcacattactctctattannnnccctacaccacacaacncccaccactcctataaacactcgtgacgccccgtgcanatctctcatcggctcgtggacctgcgcttctcacgccctattcttcgtctttcacacccacgactctaaactctacactccacgtaacacacaganactagcggatctagcatncacctcctcaacccncncnctcccctncctccacaactcctccgtgctcctcgccctctcctctttncctcttcctcttcttcnctcccctcttnnngtgttttctcnccttttctaacctctcnnntccttncttggtttccccattngacaattatntcttttnntcttttcttcanttcttaccaantttcttttctcatnttaacctnnttnnnnnnnnnntcttttttttttttttt

SEQ ID NO: 19979 - DNA, 882 bp, Homo sapiens
  misc_feature (1)...(882): n = A,T,C or G
tttcagttatctgtaacctaacagctatgttctgaatagagacatttggactgattcccagtccaagtgtatacctgcttaggtgtttgctgtgcgtcctgatgctgatcttcttcactaattcttgatacgagctagttacggttcatgaggatgaatagaacaatatatttatgaaccagtgatcgggcctcatagaaaacgaattaggaattaggaaatctgagagtgaagatgatgaccggggatgtgcgtatagagatacagagtatgacattatgatatgtgagagtgggtgactgaccaaaagatacttaatgtgagctcgaaaagtggaggaattaccgaaggtggagatcttgaataatatggtgtgaactataaccaagatagatgggttatgatatatatttgtgttaaatttttgcttgatgggacattattgtaaagatgctatatgtactccaactgaggagcttaaaagtgtctgtttatcgttatgttcggtaaaatgcagccagaacggagggaagaggcgctattagtgtcagcgatggatggattagggaggagaaaggaggaactgaggattgcgacatgatggggaagtatccgcatggggaaagtgtggggatagaaaaaggaaagttcatgataatggtagtgggagaggaacggtttgtagtggaaagctggtagtggagggaacngtttgggggtcggggtggggggtgtaatcgaggacagtatggccgagagcgtatagaagatagaattgacggaagcggcgtgagcgaggtgcgggcggaggttatagagagggcgccaatcgggacgggtgatttcgcgagcattgcggaggaagagcgaggaagtgaggat

SEQ ID NO: 19980 - DNA, 1591 bp, Homo sapiens
  misc_feature (1)...(1591): n = A,T,C or G
caacgggcactcaaagtcaccgctcctcgagacgtgtnccatagatcatcgacgctgatgtactcgttcacagatagccgtcacanagtagcacacattgtgcgaggatncgatcttgttngacgtctacgntacatcgcactgacaacagccatagcgcctcttgcacacgatattagatgtaaagttgatgagtgagtgtgtgatagtatagtgctcgtgatacagttagtgtgcaatacagttgtagntataagtagtctaacgagcgtgacntgctataagtaatcatcagtcgacngntatagacgcagntcgtatacgacatacgtatgatagattgagagatacataataatgagtagagtagtagaatatcagtacangtgcgcattgacatcagtgcgtgatcgtgagagagtatggtagattaccgaggtacaagaatagataggagagagatacacgtagagggacagctgggggatcagttnaatattcatcctatgcgaggtacatgactatagntgctgactactatagaaganctcaactaccctacgcatgtatgccngtatgtcggtgtgtgtgatatatatgatgtaagactaggagcgtgatgagtngaatgtatattgtgagatatgctatagcgaacagtaggagcgcagaagacgtgagacgcgtgtgctgcttagtcttacatcttgatcagtggtgcctcgtcatattgagtcagggaggtgcgattatattgacggaggagaaagaaaagagggtgtgaacgagaaagatcagtggagcgtagtataggactgacganagaagagctgacgcgcgcacacgcccgcagcaggacgcgcgaccacgagagcaatagatagtagcgcaagactgtaatatantgatgagatcatgatgaagacataaggtacttgcgaggtgtaataggaaggtaggtagacatcgacatgatattatgagaatgaagagnccgagatcgagttgtatgcgtgagaaaagaacatgcgagtccgnccgcagacacggtcctgaaccatgacnctgagacangagagatctatagacaatacacgactcacaacgactcactacacacgacaacgacaacgccagtctactatgacactatatcgagatagcgcgacgacanaggtcagtgagtgtatcggnctgtgntgtacacgcatagtgagtgtagtcgagntgnagcgagttgtgatagaaggagctcgagagtggtatgnagagcacgtgtgcacggtgatcatagcgcagatcgagatgtaagattatcactggcggcccgtatcngtggcagtcgcttgcatangaagcagtgttgcactgtagacagcggcgagatagacacatattaacatccatatatcgcgcgctactttcggaggagatgagacgagagagtctcngtgacatgacacgttagagtacgtgtatagtcatagagagagatatatgctactgcattataccgagtgtgtcaggaaacgagtagatagaactacaggtcgatgacgatatgaacacatcacctctcggcgctggtccc

SEQ ID NO: 19981 - DNA, 655 bp, Homo sapiens
ggtggggcgggcgggtgtttcccccccgtggtggccgggtgtcggtccccggcctcggcgtgggggcccgcggggggtcccggcggggggcggggggtgggctcccttttgggcgcgcgcggcgtgcgcccccccgctcgttgtgcgcgcgggcccgtggggggtttccccccccccgggggcgcctcggggtgtttgtcccttttcggccggggggggggctgtgcgcgtttttttttttgtgcctccccggggcgccgcgcggttttcccccgtctttttttcttcgccccccccccccccccggggggggggctgggggtttgttgtcgcgcgccggggggttgttcctgcctttggcgctctgggggccgggggggtctccttggggttttggggggggggggggccccccgggcgcccccccttttgggtcgggggggggggggcccccccggcccccggctctgggggatgtttttgggcgttctcccccggaggcgcggtttttcggttttgggttttttttagcaccaattttttgcccccctttttgggggcccctttggtccttcccccgggcgcgggcatccccccctttttttttttccccccccccggccccaaacgaaagaaaaatatatctaattaaagt

SEQ ID NO: 19982 - DNA, 1425 bp, Homo sapiens
  misc_feature (1)...(1425): n = A,T,C or G
gctctctgcgctacagcgcagagcagcggcggacaggactancctagacgccgatgctcagtgtgagggtgcgcggtgtcaccctaatcgtgaccatngacgtatcattaaccctgatacaatatntangtgttacgtatggatgtgtaattattntgtgagggtgatgtngtacgtagtggaggnacgagcgantgcaagatgcagatcgtgcgttcgtggatgtgagagcggngcggacgtgtgctggggagtgtgagcgtgagagagggttgagctgatgatgtgtgtgtnggcacgatgcgatgtgtcgtgtgtatgatacatgagacgtagatctcatgangnctctctatgcttagttctatatcacgttatntaccgtacgagtgtgntatcgacatgatatgacgtggnagaactgtgtgatgtgcagtgtgatctcntaggcgtgttgtactggcgcactgagtcgctgngggagtgtattganggctntgccgtcgtgatcgcgcgtatattcagtatggcagcagatatggagtactgctatctcttcggtagtnaacctcgtgctaccacgtntaaatatcagagtatnacagcgaaggactctagtcgaagnngactgtattgcgtagggnggcatcgcgcgctgcaacactcacagtngagatatacttacatgagactcgcgtatgctnnttatatctcatgccttagctgctcgtggtgtcacgtatcggctcgctatcgctgtatgggacggggaggcgcgggggagtgagtaggagggagtagcgtcatagggaggtctcgttagcgggcgggtaaggatcgcgcgtggtcacttgagccgtgtgtgaggtctttgtgatgngggtggtgatggtgtgaactgaatgtgtcttgagcatgttagtgttggtgtgttgtttnnnngctacactgatactaangaattaccgcttgcttactactcatttatacctcggnngcgantgtacgtctagctggtnngncgacttcggtgaacgtaattgcagcatgtctntcgacctatgctgtgatggttgtttggtcactctgggatagtggngacactagattaatcattctccgtggttggcctcggagaggagagatgcactatgacctagtcacctcttgtgagaagcttggtggcggcaacagtgcgtggacgngcgtactctcgctcgagngnncgcctcctattnctcgtcttgcgctcttccgtcttttncgcgttcccttcgtcagtctttccccttttgtngctttcctntcntgttctggcgtgnccggcggctctccttcccnatctnncatatcctttcnnnnnccctnnnntntgtctctntcttcnntntaagcntntttctccacntnnnttattcatctata

SEQ ID NO: 19983 - DNA, 1894 bp, Homo sapiens
  misc_feature (1)...(1894): n = A,T,C or G
aagngcgtngagatactgtgagtanagaggggnngcacaatatgngcgctcacgatcagtaatacntacgtgcagcgagacgatacatcgcgcagatagattctancgaagatgtagnactcgtatatgtctgtatatgtgatggatgagagtngaacatctggaggactcgtgtcgtcaggatacatgatcgtatagagagcagttctacgtgtagagtaaaaaggggtgaggncacgcgcagatnatgcatacncgancgacngcgcgagactgacgaacggcncnatagtgcgtttagaatatagctagctgntgtgtctcactcatntngatncgtntatgactcgacgtgtcatcaccttagtagcatcgagancgcggtagatgttgcgncgacanctagagcgtgtagnggagcggtgcggcacgagcaccgtagtgcacgagggcgcncngcgactagtgcacagaggcgacngagacactcagatgtaatatacagttagacgtntatgactatcatanatcataacaagaaaggtataaggaacatggtcgcgtgtgagtagctgatgctacgaacctagacntatgctcgcggtgcgcgatcgtatgcgaagatgtactggaccgactgacgggacagcagaactagagtcctggtcgttccncatatgtcgtcgatngatatgttacctcgatgcaccgtccataacacgatagcncacgacagtacgtcaccaggcgacgttcctagagttatatgatgacgatacaggatcacggtggcatacagtctacttacagtgtgtctcatgtgctgcgtgancctgctactctatggatcttatatactaangtacgatcaatctacgacgacagccaacgagcagtcgagtcacagtacatacgctgagctcgctngcccagacagtatactaactacttgagtgaatagagacacgnacgtntgacgatacgtctttctacctgtgccanccttgcacgcagcagagaatcatgatagagagacagactangtgagngtgtgcggagatgcttcgctcgctgagctgtgtcgtagcngngtgagtgcgcgctgggtgaggatgaacgtgccgtngnancagtcgctcgtgcaaccggacgcgngcgcantgcagtccgctagcgacgtgatgagcgtacgcgcgctgacgaatgcgagtagcagcagagtccagagaaagtatagagcttcgcgcggatgactgcgcgagatatcgatgcgctagtacgcgtctagagactacgtcgacgcatgcagcagctgacctatacgactgtgagtgcagtctctcgtcggnatgatagacacctgtggtcgncatatctgtcgacgtcgaatcgcacatatacagaatatgctgagcgnagagagtacgatatgtggtgtcggtcctgatntcggacaggagagttggacacngangacggacgaganctcgccgngatgactatcgntgcgttgatccgagtncgtgacatcaagactcgtgagcgaccgtacagcatantccgtctagactacgtaccacacgagcatcgactgtctacggactcagcgacgagcgagatgacgagcagnaatgnatcgttangcangacactatgtcgatantgtnagtgactgagatgagtgctagatcgtcggtatgngaagagagcgacgctgatnagncgagagagcgncagacgactcngctnagatacgagcagatgtagcatagacacanaagtgctagagcgcagnagaatngagacaagcaggcngagtgcgagaaacggatgacaagtaaacacaagacacgtctaccactatgattactgagacgtgtacgtagatcattgc

SEQ ID NO: 19984 - DNA, 423 bp, Homo sapiens
agggtattcggctcttgtgactttgtgcatgagaaagtgcagattagactgcttccatgatgcagaccctgcatgttcgactttccattcttgagaaccgagaccctcttgtggcttctattgtatgtacactgctacattcgcattacctttggattctgtaacacattctggactgcgacgtgaacctaatgtgatctgcatctcagtatgcatgtgttcatgatatgtactgattacttattaatgatccttattattgcaaaaatttcctatttggctttctgacttctgtcttaaagcctccttttgctggaccacacattatacgagcggactatattcgctagcagttgaggcgtgacatcccgctagcactcattaccctgggtggagtaattctactcacctatagggttaaag

SEQ ID NO: 19985 - DNA, 993 bp, Homo sapiens
gcgtaagctgagacccaactaataaaagaagaagaaaaagaaccctcgtttaacacaaaaaaagaaagccttaaaggggagaaaccagaaacggcggcgctgacattgacaatgagcagcctgtagtgccgcgaatatacgtgaattagggagagtaggacgacgtaagagtagtaggcatcgagatcaggacagaacgccacctcaggctatgtggggccctcccaagacacgcgactataaattcgcatgtagcacaactaataagcatgaccatgccagcatgcatgcccgagccgttttttttagaggcattcgcgttagatgtcctgctcgtcaggtgcaagaggatgtacgagatattttttgacatgttgatcttttgtcccccctcaggtgacgtgcggagaatgggtgaacggacgcacgtgacatacacctgaggattcacactcttcttggcaggagactgatatcgtcgtcgtctggttctttgtgaatgacgtaggagcgactagccacatctgatctggcgccgattcgggcaacgatgacagtttgtggaggggtctacgaaaccctaacaaatgcttatgggcgctctaaatgcaacttacaatatacttaccagatccgcagagtgtattcagattgttgaatctactcatgtctagtcggtcgcgattagatttactgtgtctagcgacaagaggcattatagcgacctgcgcacgcgcagctgaccgcccctcgatcggtacggaagtattctccggtcaattgttgggtaatatatcgctctaactattagctccatgtgcatctctacttgtggaggtgtcgtattcagacctgccacgcacctacgaacgctcagtacactcataccagcgcccacacctaactgatgctcactgacccgcaacgaatgctacatatgatagagcgtatacctctgtacagcaactactcgacagaatgcaagagtataac

SEQ ID NO: 19986 - DNA, 648 bp, Homo sapiens
  misc_feature (1)...(648): n = A,T,C or G
acagagtcttcttttgtcacctaggctggagtacagtagcgtgatctcagctcactaggctcaagctatccttccacctcagcctcccaagtagctgggactacaggcctgtgccaccacgcccagctaaggtttgtatgacgtggtttcatcatgttggccaggttggtctcaaactcctggcctcaaatgatcctcccgccttggtgtcgcaaagtgctggaccatgcctggcgaaacatggtatcactttggtgttgctatccactgattcacttctgcaaacttccctgacagaagaaaggaggacttctggctcttcagagcggtttctttacactatgcatggaccacagatcatctgctgccatcctactcagggagagcttgctaaagatgcatggtcttgaccgtgaatccatgtcagaaatcgnttaatttatgtacttacttgattatctgttttggtcactgctatatctttggctcctagaaaagtactaggaacgtactgaataaatgaacaaaaaaaaataccaacaaaagagagggaaggaaaagggattgccttcatgtttctccacctcctcaagttgttttttcttttttttttgagacggactgcggggcgaatctcgctcactgcag

SEQ ID NO: 19987 - DNA, 170 bp, Homo sapiens
attcttgagccaacttatatcctgctgtaggaaggctggaattacccaaatctccagaccgcagttgactgaagataactgaaactgtgaaaagagataaggaaggagtaacagacaaatacagtaaaaatggtaaacaataaagacttgttccattaaaaaaaaaaaaa

SEQ ID NO: 19988 - DNA, 259 bp, Homo sapiens
  misc_feature (1)...(259): n = A,T,C or G
tataattttaccgtccaagagggcgagcctcttcgatactccctttgntttcgttcgtcaaaaaggcctttcgaaaaaacaagagaggaacaacagctaccaccaccgagcattctacaaagccccgtcctcgcgtccagccctcacaggcttcgcagtgaaataaaaagtgccccgcccaaaaaaaaaacacccccaaacacacacacaaaaaaacccaaaaaaaaaacaaaaaaaaaacggcctctttggcctcaca

SEQ ID NO: 19989 - DNA, 723 bp, Homo sapiens
tcactctgccctctttccacttatggagaatattttatatcgtatacataggagatagctcgccagggaaacacagtacaagaagaagtattctggtaataatcaacaggcatgccagaacaacaatagctaattttgagtgttaacaggtgtcacagtgcaatcacaactctatcccatttccctctatcttatacagagctttgaagagggaagatatttagagaacattttgtgcaggtcaatactatagagaaaaggtagattagttattacacgatattattagttcagctcaagaaattcagggccaagaatggccaggaaatatgtcagatttctcaaggtatcagagattttcttgcatgcacaagtacaaccagaattgctataatatttggaatgcaggttatagtgatatttcttcaggttttaaacaaatacctttagaaatatctagaattctcattctaaatgagaattacttatgtcaaacccagttttgcaataattctagatgttgcttacatctgtgctacatctgtaatacctgtaacagagatattcctttataacttgtgttttctaagccatataatcttgttggtagagataagaaaataacaaaaactcctaccagatttttttttgtttcatatccactaaatttgctggaagttcagtctcaataaatccttcccatataaaaaaaaaaaaaaaaaa

SEQ ID NO: 19990 - DNA, 122 bp, Homo sapiens
cttaggtaacccttcccgaaagagtaaagcagagcctgaagaggaagaagatgatataaagccctaaaatgtgcactcattggggtcgggagtttgttttaaaacaattaaaaaaaaaaaaa

SEQ ID NO: 19991 - DNA, 1743 bp, Homo sapiens
  misc_feature (1)...(1743): n = A,T,C or G
atctgcacgacagnggagaagagccgcagagatagcagacgtactctcagggcgcgacaagagcggccgcagacgagaggcgtgggtacggatcgagcactacatgtatngcgactacagttgtgggctagacactcatgnaactatactaaagacactcactgatggcttttacagaagtggactagcggggagcgaaaagtcgtcgcagcagagccaaccgacgagggncgctggtgtgcttgggacctacatactactctgtcagcgtgtcgcggtgacgaagaggagagnacgatttggaaggtatgtcacgtnncattcaatagacatgttccgcgctacagcggaaatccaggtcgtacactacatattncacatgtactgatatcacttatnacgnacaatcgtcagatacacatcacttataataaccataataacgtancgatcgtattagacnnaaatacaaaccatgccatngtctcgaagagagacgacnatggnagaataggtataagagatgaactcgcgtcatagcgacgcgtgttcgcagcgtcgcgtacacatatgntgaggtgtgtatatatgactcatcatgtttcattctctctggtgatcgtgtctncgtatgctgtcgtcgtacgggacgtgncctctgtctgtgnctgtgctcggtaggtgntganctctgcggctcgatngagtctantagtacggcgacgcganaacagtctgcgcangtgtactatttatgagagaccagtctgcgctnactctagttacaaatatgctgtctgcactgtcgtgtgttgagcgagtgcgcgtcgatgggcgcgtacagcncggtatggtgngtatctacggcgcacgtgnggncgtcnctgaatgngcagttgcgatcgagcntcacgattcatctcacagtncgcgcgtcgtcnacgcgagcgtcncganacgcactctcntagacggcgcctctgttgactcatcntagcactctactgtatatatnacaactgtctgctattangcacagctgatcacacananacgactcatctataacacagactgatcgcggngcgagcacaccacagcagcatatccgngctgcggaccgtgacgtgtcgagtgtcatcactcatacatcatcatgntagcgtatatattangnaatacagcacacaatatctacntanacactctactatgatcgtgtactgaagacctgtacatggggtgcacggtctctgctcgtcgtctcatgcgcatcgtattgngacctatctcatantgactacatcgcgttgctcgcttggttacgcgtcaagtagcgacaagtctcaatcgangagaggagcatgtgcatagtagcgtgaatgtncagaggagtactcatcgcagtnaggcggtcttgtgggaccgcagcgtgccagctctcgctgtgcgtcatctcgtcggcagctctatgntngtnttagtgttggctcagnagcatcatcatgtgcacagatggcatacgtactactngnatagcgtctcgcagtagctgctcatctgctgctaaacgatanaatacactacanagcgtcagtcctgngggtgtgtgtgtaatatcagtatctgttgctgcgtgcagcgcgtagccggtgcngngcgcttcgctgagcgcacgacggtncacaactgacagccgnngtgcagctccacangngaacacatctgatagctaatagcaga

SEQ ID NO: 19992 - DNA, 1211 bp, Homo sapiens
  misc_feature (1)...(1211): n = A,T,C or G
cggacaatgtttactcatgaccgggcctgacatgctagtcagctgaacagctcgtacgcgcagctctcgccatcctttacccggaagagctcaaagcacatatgtttacgggacggtgctccagctcgtctcctcaacactcatcccacctagcacttttattatgggggccgcacagtatttgctcaactgctgcatcagcgcgcgctagagagacactcgcaacagcgcccgacctcggcggcattggacccattgagatctcctctctcttgcaccctgagcactaatgtcggttaaccagtctctacactgcccagccatccactcctctggttctnagtccgtctcctctccgctcgctcgccccactagaatacaactgatacatcggcacncccgccgaggcgctccactcaccgtcgcgccacgcgcctctcgcccaccttccctctgctccgacgggcggcgcagtcatgccacgtcgagtctctccgagatcgctctcggctcccggctcgcggctgtcgttcacattatctcgctcctcgacagtgcgtccctgccttgtcactccgccgcctccttcgcgctgttcgtcattctgccatcttcgtcttctcttattgcgcttatccgttcccacgtcgccgcctctcccacgntccgtctccttcgtcgcccacgttcataggcgtactctgtctcttcttctaatagcagctcccgcncgctgtgtcacctcgtattgtgtcgccccgctttttagtctgctcttgtcttcgcgcgtcctcagtcgccgtccgctttctgcgctccgtactagtccactcctagcccgcgcagccgtattctcacctcgctcactctctcgactcgccttctcacgctcacgagtcggnctcgcccgcgtcctagttcacgtcttctcctcctgcgtctcgctcctacgcctcgtcggcgccgtccncgtctgccgctgctcctctctacgtcgtcctcncnccgtacgctcctcatcctgcctacatcgttgtcatactcctccgaccacactgacctcgtgtgctcgctcccttgcctggcatcgtcctctgcgtcttctcacgcacactccgctagcccggcgcatccgtctcctctcgcgacgtctcctgcgtaggcggcgtcctcgcgcgcgttgtattccgcctacgatgcacactaactcg

SEQ ID NO: 19993 - DNA, 1138 bp, Homo sapiens
  misc_feature (1)...(1138): n = A,T,C or G
tttttaaagaaaaggaaaaganaaaaaaannaagagagganannagangngntgcgggagagcnanntaaaagaaggaaggagcctaaagagaaaagaacaaaaaagaaaaaagaccttaaaagagagggnnaccacgcgccgnacgccgnaggaagagagaggagaggcagagagagagtcttnccgcgagcggngggggagggggaggagagagggaaggggaggncaaccgnncnggagggcggcgaaccgancgccgaacgagcaaccgaggcaagcggccgcggcacgcgccgcccacgcccgcccccgcgcacaccgccaaccgccccagacggcggcggcgcgcgacgaagaggcagagcggaaggccaccccggcccgccgagccaaacgagagcagcgacgcagacccaccgaagnaagagcccccgagngcccaaaggccgacgcggaggcgccgggcgaggggncgggggcgcggggagagcggagagagagagggaggcgcgaggcgcgggggcgcggcgccgcggggccacgcgccgggcgcgaggcgccgacgcatccacggggggggccagcgacaggcagcaacaaaccccaagacaacaccaccagcgacaacgcaacccggagacgacaagcgaagcagacagaggggacggccgggcgacaaggagcgcgaccgagggccacagaaacaaaaccaaacgccggcgcccagatacacagcacccaaccacggagaacagaagcccaacgaaccgaacgacacaggcgcacgaaagggtagcaagagcagcggccctcgcagcccaagcaagcagagggaacagccaccaacaccagcccacgcgccaangaagaagcccaccgcctcaagccccgaccacgcgcggcaccgggcgcgacggaccgcgaccgacgacgcccccaaagagaccgcaacccgcccccagacagcccacggcccccaccgggcgccagaagaaaccgggcccccgggaggacgagaaagcgaagaccgagagggccggaaggacgcgccgacagggcgggagcagagaaggacaggaagggtgcgaggcagcgcccgccaccaaccccacccgaacacaacgcggccgcaggca

SEQ ID NO: 19994 - DNA, 175 bp, Homo sapiens
tttgacttaaattataatatttcatatcaaatagcaagtcttaacgagacaatgactacatgtactttgaagatggatcacctctctcattcagatgaaattctttggagagaattttatttccaaagtaaggattctcatcaaaataaaaatctattcagcaaaaaaaaaaaaa

SEQ ID NO: 19995 - DNA, 1367 bp, Homo sapiens
  misc_feature (1)...(1367): n = A,T,C or G
atatcgttgatgncgtggagtagtgtgtatatgatgtagagatgagagtcgtgngatatagatngtgnactagacgatacgacangacggagcaagagtggttgtgngagtaatagtgtatgaacgagtatngtgtatgagagtgatgatgtgctgagtagtgtatataatggatatgctaagtngtgtgtantngacgttatatatgtactaaatgatatgagtctgtagagtaggaggagtgtagtgantgtcgtggtgtgatagtgatgtgaagataagagagtagagtgaatgagagtgtgagatgagcagtatcactgnttagagagagtatatgagtntggtgagagacantcgagatgctagagtgtagtngcaatcagatataagagagtagtgacgagatctagagggcatgantnaagtgagtaggtagagagngacttgaatatagtatgtangntacanggcgagatgatagagtctatntatgatagcatgcgngagcggaggtgtgtggtgcagatgnctagatatggtgagtaggtgatgtgtgggacacgtggtagagaagtgtggagatcatgatagaagattgtgtgtacatatgatgtaagtagtaggatgagactaatagaaagaagtaatattttagtngggtgcggaggagtagttgggtgagtatgatgctgtgatgagtggaggagagggtagaggagtatgtatatagtgtatgaaggagttgaagtgtttagctagcaaagagagtggggggggtggtgaagaatggagatggttgtgaataggggggttgtgtttagttttgatgaggaggttgggtagacgagaagagaggagaggaaagggtggtggcattaagtaaataaaaagaagagagtatgaagtgaaggaagagaaaaagtagggggggcgggggatgaggtgtagagaaagagggtaagaaaggagagtaatgattagtggatagagatggaagaatgagtaaagaggaggagttggttagggaaggtaggaatagggattggttgtggagtatggaataggttaagtagaatgtgtggttgggatgatagtgatgatgaaagagtaaaaggggagggggagaggtgagggatgaggtatggagtacgggaagaagattgaatgtgatgaagaagaatanggaaagagaaggaaaagaagaagtagacataagtaaatatgttgtttggattgttggtgtagtgagatggtgggtggggtggggggaggtggtggagtagatatattagtatatagttgtgagtgtggaagagtgaggaggggaaaagttgagagaagatatatatagaggggagggaaag

SEQ ID NO: 19996 - DNA, 2213 bp, Homo sapiens
  misc_feature (1)...(2213): n = A,T,C or G
gtgtacgtcgtgcagnatcgcgtgatgaggtgacntnacactgataacagacagtgatncgtacaganactcgcgtcgtctgtgctgatactcatcngtgtatggantatagtatagtgacagctctgatatatagtatagtctctcgcganagctngagcgtgatagctatgatatctatgagacattcangcgtgttaagtactgtatcacgactacatcgtatgacgatgtctngtagncancagtagagtagatgaagatncgatngaatananttgtcagatactcancgtcttatgagnagcantgnacgtacganctactacagtaccgacgcactactatntancagcagtctggtcacacntnctgatgtggcantcagtagtnctacactagtgagtatangaagtgatgtgattcgctacgatatgntggtatgtantncgtantntcgctgatacgatcatcnatcnaggtactgctcagatcgcatgtgatctgtntacagcagctanttacatcagagcgatatgactactntagtgcagngtagancgcagtgnagnatcgacaantgaatgcantgctgcatcagctcagcattgnacgtnctnatcancggcanatncntaagagntagtgacgtcgatcgtcnacgtcatccatgantgactgctgtagtgtgtgctgatgatgantagatgntngtatattantngnnatgcgcgcggcatcgtacattcgtgtcgcgtttanggtacgatgcnctgagcatagcaggtagagatgnagtagtatcatgtgatnagtagatagtgatgtgcanantctgatggtagtgcagtgcangtagtcgtcatactcanagtgtatgntgtantantanganttanatttgtgttgtaatctgangcntncgctngcnacgtagtngtcgtngtcngancgtcngcgcgtatctactacgatgtnggtcngatgacggtatggncgagctangacgcgtgnnagtagnagtctgtcgttgcgtagagatantgngtantngtanagcgtcacgtgatancatgtaganantntgctcggcagcggatagagtccgtantgatntagctgctacgcactgnagcgtatgagngtggacgcagtatgatgactcgcgcgctgacgtagcgncgcagtgctgctggtgcangtgcgctagtgagatgtcatggatantgtaggtgtgtatactgtgcggtttgantnagtatagcctgctgagcgtaantgacatgagtgtaagtgcacggattgagacgatgtatggatagtacgtaatacactggagtatcatgatcacgtgtcggcagaataacatgcgatatactgtattcngntgtgtagtgtacacctgaggtatctaganttcgtctagngtatagtatgtgcgaaatcataatcgcangacaatagtctgatgcactattatcttacagttgacgagagacagcactgatacgnagagnacgcactagtacgacacgctgtgacgctgatgtaagtagctaccactcganaacgtatatagcaagcgttgacacagtgcagtgtctgcgcgtgtgacatgcgcgaggcgngacgtcgacgntgctgcgtcaatatagcatgngatggccggtaggttgnagctgtgtgaccgtgttangttatcgctcgatctgtgtctgtactttcgctgtgtcgtgcgtnccangacagtcactcactatattgttanncgnngtcgtgagatgtgtgtatatgctagcggctcatggtgtcgagacnagnttcgagntgatacagtgacacagtgacgtgatgacgtacgtacgtcgtatgcgtaggtataatcactnagatgagacagacgatctacagtatatggtggagatgtctgatatgatgaacatataataactatatatatatnatagtgtatttangatattatnttgatttacggtgtgtagtatagtacatatagtgtgtatagctgatagagagactgggtatnatcnantatntgatntacnttcagtngntatatcatcagactgcgntcagatcgtaggttcgctnagttgactacngcatntatgacatatatactgtgacactcagcgtggtgtagtgattactcattcagtcatacngcatgacagcacaacagcgggatatca

SEQ ID NO: 19997 - DNA, 698 bp, Homo sapiens
cttgatctgcacccgcatgtagctttatctgtaccgatcacaagcccacggcatcgccctgaggacgcggctccacgatctacagggtctaacgggcggtcctccgcgacgattctgactacgacgctctctggccaggctgtaagatctgaatggacatctactgggactttactcgactacatcatgaacatgacctctgactggcttgagagttctgggagagttttctttgtcgaaagtgaacatgagtgcttttctcactttcggagaagatgtttaaatagtgctgttgtaacttttaatagtcctgtgtatcattcaactatttttcttgcagtaccgaggcacattcgaaaagatggaattgaagtcgctttgcttaacgctgagtgaatataaagagtagtttgcagctgtgtggtagtggattaattagcagccttagctctgaggtgtctgggtctagagttacttatttttaccaagcattttcagcctccattctggatgctgtctacacttaacaggtcttagctgtttactttttagagaataatattgttcattgcattgctgaggattatgaacctatttttgcagaaggacctgcacataagtgcatctgtgaatccggcttaaaaaaatggattcttttttgagtaaaccttattatctgcttagtaaaaaaaaaaaaa

SEQ ID NO: 19998 - DNA, 460 bp, Homo sapiens
ttttgttgtttgctgtgtggttcgcttaagctcggttcaagtatcgaggtttaagctttccagccggccgcccgtacattaattccgtcggaggcggttgcccggcggcgctgtacgtggacgtgtttgtattaattgggaggttgctcgtggcgaacgggcgaggacccgaacgtcgcccatctcctgaaatcgcagatacagtcgatctactcgttgttctggggtgatgaggagcgcaggcgtgagcgggccgtcggccgggacagtctccgggtctcggtcttacgcccgtattgccgccccgtgtggtttttgcggttgcggtcgggtcccctgcccacgcgctcgggcgggcgctcgccgggcgagcggaatccaggttcgatcgtggtcatggtgcggcgccaggggcccttcccggtgggcgcgaccgcccagcccctgcccggtcgcgtcg

SEQ ID NO: 19999 - DNA, 1736 bp, Homo sapiens
  misc_feature (1)...(1736): n = A,T,C or G
catcaaacacatagcattctactagaactaacgtgtgcacgactagacctcgcaattagtgtaacctagtctgctgctgctctgagtctactactcctcggtatcaccgcgcatctctctcacctctgtactcctctcactcacctctctgtttgnaacattcgctgcgtcgtctacatngtgctgcagtctctgtagtaccttcgtctcttcngctcgtagattcagtnactgtnganagtgtgcgatctctctagtcgcgtcgcgtgctgtgcacgttctatcctcgctggctctctccggctatcgctctagttagactacgacatcatctctcgactgctctcactctcaagtatactactatactttatcctcatgctagcgactccgcgtctcgaggatgtgtagtccnagcatggtgtgtcgngactcctcccgcagtcactcncngcatactctcgcggtgactcncgtcatacatcgactgtagctctgatgttatattagtgctatcactatctcactcctccactctccttcactgtactgcatggctgcgctgcacagtcctcgtcacgttcgcctngcttcggatnatatcgttgatgtgcgtgctgcgactacttcgcacaatactgctgcacgaatgcggacacgagctaacgagcgtatagcaagcactcataaactctaggacgccatcatatctctatatcanctcactactatcanagnagctgtacgcgtatctgtctcatgtcactactgctcagctcgccgtcactctctcttcatctcgctngctcgcgctgatacgactgtgccangtcaagactatacctgagcgcctttgttgactctctgtctatctctctagcactngttgaacnacgctcgagcgtttcgcgttcactctcttancactcatcactnctcactctattattcgtgcctacactctgcgctagtanactcagtctcacgcttgctcctctgcggtcgctatgcccgactagcgcacacangcgccgaacanccaacgaagatctactatcntnnccctnctttatcnctccaatancncatcgncttcgagactatgtcagntgtcgtcgctgttgtgtctacatccatctgccgatcnatctagacgggcagcacgtcctnctcaaggtgatctngagatgctgtctnagtacgctcctgcactcgcacagtnacacgnatctggcctcgtcgtacgatatactacantngcatcacaatgcataccgtcgtacatcgtatgcgcgcnacccactcactacattctgctctctccaccgcagagncgcgagcccagctatctgtcactgtcgccggccancaccgtcactatactcatagtcatctgaacttgtcngnacatctctcacgtagcgtaccacacaccagatatacttctatcacagtgctaagtcgctntgctatgtcatagcgcagatctctnctcaatatatatacatatatatatatacacacattggtgaaccctactggtntggngtacgatgaccatgtctgatgtagagntagttcnctctcnatctgctcgctgcagacgctctcgttcgcatcctctctattcttcntcatgcgctacgtctcttgactnttgtcantgtgtatttgatgactgttgttnatattttcatcnatacatagatataaaaaataanttaataataataata

SEQ ID NO: 20000 - DNA, 337 bp, Homo sapiens
ctagttgtctcccaggtggatggtaagaggacattttgctttgcaagggtctctcttcaaaaggttcaaatttcgtgcagcttctggaaattctccatcttgatcatcgtaccgtggagctgtgccaccatctccgtgatctctgccaaagcggctgtgaaggaaagacatacacagtctgcagcgggaaaggcaggcaggggtcttcccctagcagctgtcagctcaacgctgcagggaaatcactccagtccctgcacagtattcaaaggtgtcttttgagcaaaaacagtgctatttctctataataaaaattgatggtgtaaaaaaaaaaaaa

SEQ ID NO: 20001 - DNA, 364 bp, Homo sapiens
ctttgagtctcacttgtggttgctcaggtctggaatccagtggcatgatctcggctcagtgcaacctccgcctcctgggttcaagcagttctcctagatcagcatcagcgtcccgagtagctgggattacaggcacccgccaccatgcctggctaatgttggtcaggctggctcgaactcctgacctcaagagatccacctgctttggccccccaaagtgctcggattacaggcatgagctgccacacccagcctccaaatacttttttttaaatcaaaataatgatttcaatgactgagatctgttatgtatttcaacataatcatgtttcataaagatttagtcttctgaaaaaaaaaaaaa

SEQ ID NO: 20002 - DNA, 1601 bp, Homo sapiens
  misc_feature (1)...(1601): n = A,T,C or G
cattctcacagcgtaggatagatgaatactcacacgtcacgtcctaancgtctctctagtacatntcnttacatnctataangcgagtgtcgcgttctcgangncgtagatacntgatgtctgtcatcgctactcncgatagagtncgctgcaatgctgacgcgcttcaacnctaancacanangancattaatgagagtgcantacgntgagtgtgtattcanagagtatgtgtgagatgatgattgnttcactgttattacggtagctatcatgtctgtcttacggacggnttggcggttgtgcgcatctantaatatacacgtggcgnggtnacatgcgcgagtcgcggcgcgcgcgtagngcgatagtcgtatngatgtgagtgcgcgccgctgcggcacagtcggcgccgtcgtcgcagntggaacgctccgagtcgnaccgctgcacangntatctatgttgcgcgcancagcgagctgtgtgccgacttngnagagtgactgacgatgaagacgacgacacagangatgcgcgatgnganaggatgagtatcgagtgtgactatgcnaacgttctactgtcgtctcgcncgcatcgtctgcgnagacgactagtcgtgtcgtcagtagctacatgatgactacagcgtgactantagnagcgnacgtggagnantcagatgatcgcgatanactcatcacntacacccgagtanacagactccgactgtggcgtcagacgtctatgcgtatgctacagcgtcacgatatatanacatcgcacgagtcgcgctgtcgntgagagcgatcgcgattcagntgagtgcgtcgtcgtacgcgagtgcagcagacgccgtgagagtgccgatatcgatgcgccgccgagcgagaggagcacgagagtatagtcgtatggtcacattgnttcggaatacgcatatcggtcatgactactgatataccacatgaactaccgaccgcgtacgcagactactattgcgcgtccgtgcgagagnactantacgcgagtagtaagagtagcgctcagcgtacgtgtggtaatcgtagcgttgtgtgtacgatatcgtatatagagataataatattaatangagtgacgtggggatgtattatgcggactatgtctcgacgcgtgtcgtagtcgctgtatgtgtcgtgtgctgttgcctcgagttacaatagtatgatctaattatgttacatcgtatctcgtntctacatangtgtcgtattcgcaggcgcccagcaacantgcctatgtatgagtgcgcgtcgagaggcgtaggaggcagttcgtaacgacgtcatagagtatattcttgacatctctgctnancnctcgtatgtacatcctcctgttttcgatcgtatacgcactcattanaaataggntaccatattccttgatgtaacctcgtggccacgctgtggctcagcccactgtgtgcggtggacacgtggcatctcgttggtattatacatatgatccggggttaatcgtnctcttatcttattatatgtggcgaatagcgcatattatctgctgtggcctgatttggtaatgttactatgatt

SEQ ID NO: 20003 - DNA, 1813 bp, Homo sapiens
  misc_feature (1)...(1813): n = A,T,C or G
cgagattgctgcctggtcagatggcggaggacgatggacaggagttactggcgagcgaataatgactctcgatgtantgcgcgtgacacgcgatacacatatanagtaggtcgaggagagaggtgacggtcgtgcacgtagggagagtatgcggccgtgatngacaagtcttcgcacgagtgcgcgacgtgacgtgcagtcgtagttgacggctgtgtacgagcgtcgtgtactacggaagagacaggccgcatgagcaccaacacactcgaccgagatagcaagaacacagatgtatagagcacacgtaggtntgcacggagcgaacacgcgagcaggggtatgacgcggagaggttggtcagatactgacgatagtagcagcacgctcgtatcatctgtcacgtcgtcgctgtgagtctgaacagtcctggcgtgcgcttcatntgtctnttgtacatgcactacaccgtgctcgctcggacatatacactagtagtgcgngtggtncgtacgagntgtcgatcatatatgatgtatgtatgtacgatgntgtgtnacacgagtgtcttggcggagagagatagaggtcgtcgngcggcgtagacgagcgcgagctatgtgcatcctctgcgcaccccggctgccgancacattcgcgtgtgtgcgcgcgaagtacactatgtgacgggacggcgctgtatctgaacagcagagtggtcgcgtgcntgctcgtatacttatcaccatgactggtgttgcgcgtgtgtgtgcttcacgtgaccgattacacacatcaccgacgtgcacacgataagatctgattaaagactcgatacagatgctgtatggaagtgtgttngagtatantgggtcatctgactaggtcgttcgccggcgtcatcagagcacgcgcgtagccgccgagcgcgtgcacngatctactagtctagcgactcctcacatccgcatctcatcacgtgcgtggtttgtggtagggtggctctcgtgatacttgtcgaaattgtgctgcgcatagaatnctcgagtcgaactacactatacgcantactgtgtgtgtgggtagtgtgctatntgantgtcgagagcatgtattagcgcgcgcttagtcntgtgttngtatgtacatgctacgccgtactataccantacaatnattactcatcagcttcatgctgactccagcgcgctatcagagttnagtagcgtgcgtgtctgatgcagtcggntcgtacgagntgctgctagatagttcgctacgcacgcaccagtgcactagctgcatatgngntagcgacntgtattagacgcacgancanacgacgtgagnacgcaggatagtgaggnatacgagtcgtatagcggacgccgtagcgngtgcgctgangtactcgctcntgcattagtagatgatcgntnatcgtatggactatgcgtgtctgatantangtgatgaatggcgctcantntcgcatgtgagtctcgtctcaatagatctccgngtcgatgcacacgactagcagccgcatgtacaactgctacatcngctgantnattagtatagcctttgacaactagctagattcatccagtagaatcagcacgcccgtgcgagtcggatctactgaactcgtgtcacagagcagtggggaacagtgagtgaatcgtgnctgcgactcttacgttggtgtgtatcgtctagtggctgngtcgatagcatataagaagactatcgatcgaccgtcggtgcgcgtgacagtagntagagagactccgctgctctagcggtcggt

SEQ ID NO: 20004 - DNA, 1250 bp, Homo sapiens
  misc_feature (1)...(1250): n = A,T,C or G
cttgtcgtccttcgtcttcgncggctgctgtctgttatcctggtgtgtgtgctgttctgtgtctcgtctcttccgtcgtccgcgntcttctgctcgntgtctgcgtctctcggtacaccctctatttgtcgtcgtgcgcgtggtcgtttcgtgtgtacgctgctgggcagtcaggtgcgtctngagtgttgtctctcccgtcgctntgttggttcgtgtgcgtgtcgagttgtatgtccgttttctgtgtgcggcacgcgtgcctcgcttgtgtgttgtgggtagatgttgggtctttgtgcgtgtggttggtgcggagctgttgtgtgnagatgtagtgtcttattngtggctgtctcgggtctgggtgtggctgcgtcccgttgtttcgttcttctcgttctgtctggcgcgggcggctttgtttggtctcctgtccgtgcgttgtcctcgtgttcttggcctgttgcctcttgggttgcttgcgcgtcggtcgctgcgctgtggtgtcggggttgtgtgtgtccggtgttcgcttgtgtgctgttgtctcgcttgtctgttgcgtgcgggttgtgtgtgttcgtcgcgtctgcgccggtctatttcgtgtgctgttggctagtgccgtgcctctggtgtggctgctgcgccttcgttggcgtggttgttgctagttccggcctcgtgttagcgctgttcttggtctgttgccgtgtttgggtgcgtgtacggcgctcctcttgtgttgcgcgttgtgctgcttttgctgtgggcgcgtgttctttttctcctgcgtggtcgcgcgctgttgtgtgtgcgccggtgttcctgcgtggcgtgcgggccctttgccgttgttgctttgttgtcggcgtctgtgctggggccgccgactctttgggtgtgtttgcttgctgtctctttgtgtgcttcccgtcgtctgccttcttcttgctcgttggcttttctttgcctgctttgcgcgtgtgcttttctgttcgtcgtcntccggcgtttgtcgctcgtttgttggtgtgggtgttttctctttgggtttttcctgtcgctcgcgctttctttgcccgttgggtgtggagtctcctttccgctctgttcgtttttgcntttggtatgggcttcgtctgcgcctaaaagctggtggttgtcggttttctctttaagctttttttctcttgtctgtcttcntgttccgctggtggtgctggtgttggtgcctggcggtcgcg

SEQ ID NO: 20005 - DNA, 301 bp, Homo sapiens
atgaaagaagttggaagaggaaacattaggaatttcctttcaaactccaatcaaaacagcccatttgaatatttttttaaaaggattccaaaaattcttcctgtgaggatgcattggctaaagccaggtcaaagttgctgaagaggactaagcgagcctcttggggaagatgatatcatctgatccgctcacatgtcacattccacacatttctgcatggcttgctgctgagctcccatctgggcagatctcaccagagagacctccgactagcacatgcgcctaccctgcccatccctgc

SEQ ID NO: 20006 - DNA, 717 bp, Homo sapiens
  misc_feature (1)...(717): n = A,T,C or G
ttttaattgacatgcagccaaattatcccattaactttaagtgccctcccctgaggaaagctgattaagaaggatattgctgtgttactattcctactctaccatagaanttttcttacgggaaatgaaggttttttttaatgtcatagaatatcagaggtagaggtaatcttaaagatcatagtcggctgtggagctcagcccatccaatcattttatttcacaaatacttggcatttgtgaaataaaattcacatcagaatatgttaataggccgggcgtgatggctcacgcctgaatcccagcacttcagaagaccaacacgggcggatcacttgaggtcaggagttcaagaccagcctggccaacatggtgaaacctcgcctctactaaaaatacaaaaattagctgagcatggtgtcacgtgcctgtaatcccagctactcgggaggctgaggtaagagaattgcttgaacctgggaggtggaggttgcagtgagccaaggtcctgccactgctctccagcctgggcaatagagtgggactccatctgaaaaaaataaatgtgaataaaatgaaataaaattcacatcagaatatgtgaattacttaaggatttttccttagctgaaacataaaatacatgtactatactacatccgtaatttgatttatgaaatgaaataaagcaaccaatacaaaaaaaaaaaaaaaaaa

SEQ ID NO: 20007 - DNA, 223 bp, Homo sapiens
  misc_feature (1)...(223): n = A,T,C or G
ttgctaagtgactcccccggacacctgngaggatccacaaagacatagntaaaaaaaaaaagaagactgacacttctgggtgacattcacaaggaataacagcatccagcaaccaaaaaaaccttaccaacaacagctgagggctaagaccagccgactccaaagtgtgacacatatcctcagtggagctttctccatgcaaacacttccaaaaaaaaaaaaa

SEQ ID NO: 20008 - DNA, 1890 bp, Homo sapiens
  misc_feature (1)...(1890): n = A,T,C or G
ctctgcacacggcgcgctcgnactcacgcacacgctggttagactgttgaggacgtgaatggtgataatagaatgtatgacagtantgtgtacgtctgtacgacgtgatctgcttacacagtcacgtgcgcgcgcgtgctcgacgagctcgatctcncntcgagcgcgcgccgagntgtgcgcgnagagacgagtagagcatgtagttagcaggtnacgctgacggtgagtngtatgantntgacgtctnataagctanccgtatgaggtgtgagcacgcagtcagatgcgctacgagagtagtagtcgtncgangagtnctagcgttatgcgcgctgcagctcagcgacgcncgtcgacgcgagtncagtgcgtctantangancnancncagtatgtctgntgntgantgcgangatgaagngnggtgntttggtagtggtgngngnngctgcgtattgtangtanntangantacggcgaaaggtatcangacgtnatgatatgctnatgtagtaccactgatgntagaactatattatncgatgtnngtgtgctacatagtgtctcgagtcgtcntgctcagctantanacanacgtgagcgacgcacggacgcgatganactaagtatgtaaatcacacatgtgtgcgagtatactcgattaacagtcgctgagattgtcacagagacgangactgtgagcagtacggcgcaggaacggtantgcggcagtcantcatanttatganacttcatcatcatcgtagaccgcaggtcgagtanaggatgacatgtctacgagtggcgccctacgtcaccatgtgtctcgatgctgactcatgtatacacaacgatctcactcacacatggtacactcttctaatatcgtaatcatatcatataganancgtgtagtgtgtatatcgcggccgtgcggagtgtttgattagatgtggtgattcgagtgaagtcgatcantctagagtcacaacatacactcgtcgtgtagcgctgacatactagagagacgcaacgtgcaccacantntcnatcnccgccgagattncactactagtgtctgtgacaactganangcnagtcctatntncactcangacgagatccgttgtgctctctctcagtgtacactatagtagtggacactgcatgntccgacgcggttagcgatcttgtattgtgcantgcatcgccacgtaaggacgctacaaattctacactctattataatatntatgagacggtnggcgggtacatatatatcgcggagacacactgactacgtgagcgcgcgtgacgcgcgcgtatgactgcacatacatgtcatcatgaacaactatacgtgtgtcatctangctgtcgtactgtctcacgactcaatggactgngcgctatatgttgtgtctatcgactggtcgcgtgtcnacttgcgcgtattcgatgtctggtgatacgttaatggcactcatattatcgaacatggacggcggtgccgatccngcgcgctgcgctgcgcgcgcatctaggtacgtcgttatgtgatctgtctgtatgctgcgcgtggcttgggtgntgaatactgtcgtcggagtggatgtcgtcgtgtgtcgagacgctaatgtgatactgtaatgaagtcgactcgattagtgagcgatatgtgcgcgaagacgcgagccacgtctcgtacgtatcgtcgcggctcatatctcataaggtgactccacacanacataccatctgggcgcgaggctagttggctgtgagagtatatcacacatacccgtgngtgcacaagtcatgctactcttagaatctgacgccggcgcgacgttctgtgtcgtgtgagcggtgttctggacttctcga

SEQ ID NO: 20009 - DNA, 793 bp, Homo sapiens
  misc_feature (1)...(793): n = A,T,C or G
cagctggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaaatcacatcagtgaggaggcactgaaccacctgngggagattggcaccaagaacacactgaggtactcagtgcagctgctgaccccggccaactcgcttgctaaaatcaacggggaggacagcattgagaaagagcatgtcaaagagatcagtg

SEQ ID NO: 20010 - DNA, 799 bp, Homo sapiens
  misc_feature (1)...(799): n = A,T,C or G
ctacacagcacggaccatgtacggctggagacgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctccaccgcttaaccaagctgttgtggtttttcagcatagtgttgtatgttccattactagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagctatttgctttcataatccatttagcaatccaggcctctgttgaaaagaatatatgagggagaggggaacacatttccttccgaacttacttccctaagtcgctttccttatgtatcatctaatacaatgatggttgagtgaaaatacagaangggggtgttgagtattaagatttcataaaaccctttctgggaatataactgcattaacttggaaagaaccctgttgggccanaagacag

SEQ ID NO: 20011 - DNA, 1323 bp, Homo sapiens
  misc_feature (1)...(1323): n = A,T,C or G
acaccgcacaacaaacataaaacacagatcactcaganataaaataaataaccctcctcttcatggtatcctcgcctgcgcgcgcntcacatagatgtgngatgtcgacgaaactacgttctattcttttatttgtttatgttatgtctcgtcaactccgttgttcctccttgcctgatttaggtgccantacgtgacctgagctcctctcccntcattgtatgcatgtgtagnagcgacaaaaatatgaatgtangaaaccaatagtcctcctccgattgatgcgcgcaaggacccacaacgcacaatcaccgtggtggcatccctcatgtgtagccgtttggccggttgtgttgtgcgcgcttctgtggaagagtaacatggcntgttctccgtgggcggaagcaacgggaaaaaatgatgtgagtggacatatgaccaagaagcggggcggggcggtgtggtataatagatggatatangatgcgacagcaggggncgccgtgcgcggttacccccttatcatacgcaccaagcgaataggcagattcgccagcactacgctgctcgttgtgccaccacgtatcgcatgccgcatgcacgcatgtcgcgtcggaaatatgaggacgatgaacaaaagcgaatcatcaatattcagagcgccaacgctagaacagcgatcgtatccataagcgactcgaatgcatcgcgccatgcgccaccgtgtatgcaccnacgcagagatcaggaggtgtgtgttttttgtacatatatagccgcacgtggtgtaagctcgttgagaatgcaacattgcataacgaacaacgaccaacaacacatcacataaatcgatatatgcgaccactcctccgacgcgtataatgacgtggccangcgatgtgatgcgcgcatacatgattccgaatcgagtcatcatgacgtcgcaaaagataatgtgcgtgcgtgctcggggcaatgatcgctcgcagacttatgctcctatattctttcgcggctgatcgaacggttcgaatccggagcatgttaggggctgccaccagtattgttacgagcattgtgcgaacgaccagaagataagacggcgtatcatcgtatgcatccaaacaaacattcggtcggcgggagtggtggtgggaatattcatatggatgagtgggtgtatgagtaacgagttgttcatgtgtgatgcggcgcgggcgctgcaaattaataagagcatatataccgatacgacgccgaaatagaggcggcagcaaccgaataagggatacgtgccagcacgaagcacacgtcgggctccca

SEQ ID NO: 20012 - DNA, 168 bp, Homo sapiens
cctagagtacaacccgctgagcctctctggtaaactggagcggattttttgttgtttgtttttatgtttttgttcaattggctattcctgagatgaatgacaaatttccttgattccattgtatatcaatttatactataatatcaataatagaatgttgaccatgat

SEQ ID NO: 20013 - DNA, 972 bp, Homo sapiens
tttcaggaatctgagagcctggatcagaaacacactgctgcggagagagatcgggaagctgacagaggagctgaagcacctgacagaggcactgaaggagcacgagaagatgcgcccgctgctgctctgccctatgaactgtagcgccagcgcctcccccggccggacccatgtggcatggctgcttagcctcgatgaagacggcggacactctctctgaccagcctaggagacttttggctattttccataccctggcgaggaactgttcctcacttcacaacccgcatacaaggcgggcacctcgccggcccgatactccctcttgggcagccccaatgaaccgcccactctccgatcctttcgactattggcgcccctccctacatacaccaataatcgcacatccacacagaggcccctcagatctcagaccacatccacagcctcctctccaccatcctatccccccacacacaccctccctcctacctctgtctccgtcgttctcttatttcgcatccccttctcacatggtccaccactattcacatcccatcacacctctccttcatcaacaataacatcacccggccaccaaagcttcacctccgccccccactcacctcgcgccctgccataactccccctgaaaccctatctccgtttagtactctcgcaccgatatgttacatatgactctgctcccgatcatcatatacccagagtcaccgcagaacatcctctatcgcgcagcgctgtgctatctctgcccccagcccacatccacgcgacacgcagccccacacggagcgaacaatcgcacactgagctccgtaattctgcgaaaccagcctcgccaacgactccgatctcactcctcgatcgctcgctaccccgactctattcgacctcctccatctatcgactgtttccaccgctcagacacccctctagctccggcgaattgag

SEQ ID NO: 20014 - DNA, 1857 bp, Homo sapiens
  misc_feature (1)...(1857): n = A,T,C or G
ctagagcagatgcagatctgtgacgcacactgctcanactagtacgcgctagagacgtcgcagacactagaccatcgacaancaggagtcacgcntcagagcgtcagcagtactcgngtgtcgtctnaacgagatagtgtatgcgcgngcagtatcgtgcgatggtactcatgtctcctagatatnagacgatagtatatcgaatagctnagctcgcacgatcgacgcgcgatgcgcaacttaagtagcntcatgactagactancntntcgccttgaccgtagtgatcgcgcgctgcacgagtgcgctcgacgttgcngagcgtagtctatgcgagtactgacgtnctngctagttatgctgttgaacagctgtagacagatgtagcatatctagcggtgctgtcagtgtgganacgaatgatcgagactgtgtagagngagacattagtcgagaatatgatgtantgtggtnagtagacagacataatagctgagcgtgtacgctgcatggcacaccancgctctgtgcatgcttgtatgtatntgtangatgtatgggcagacgtggtactcatataataactccactactcatttcagtactatgantntattgatatatgtaacgcatgcgcacggagtatataanttctatcagtgctgcactacaccaancngtcaatcatatctacctataccgtaggcaataagatgtgngagnagagcgcgacacacacagcttcacacactacatgtcagagaatacgcatctcactctctcctcttctcgtctaacatactcgcgcatcagcatcgtgctctgcggtctgcctagattntgatgctgtatgtagcgtgaccgcgtctactcacatntatatagatagtatctcgcgtccgcacgtcagtagactatactacntactacacacggcgctatgcactctagtcatntgtcgncactcntgttcctcattgtgctacttctacagtgcagntgtgacatcgtctcgagtgngagagcgcgtatngtctcgtatcgagagtgaccgcantacgatacatnggcgctctagtcgaacagacgctcgcgagcgtcatctcgctagctacatgaccgtacatcacgcactacgctatcatcacgacaccgcngcntgtgattgctcgtacgtngcgtatcgacntntctctgctgtcgaggtgcgtgagagagagagagatacacgagctgatctaggcgtagtgancnantntacgagctcgcggtgcgacgtgcgncgtcactgtcgtcaagtctctacgctcncagatanggctctgctacattgtcgtatgtagctctgctatnttcactcacgtcctgcgtcgnccnctctcctcttcngctcgtctgcgtcatactcatcgctcttcgcgtatcgtgctngagtatgcgcccatacatgctacgactatacatctgctcagcgcgacaagcccgctagtagacgcgcgagtacgcgaacgttgtacgtcgtagcatgacttctcaatatacttattacctatcaagtacttttgtagctctgctctctgacgtcatttcctaccatgcacgggtatctactagagatagatgcactgatagtattactaacttgactccacacaaatcaacgacgtccttgcgcgctcgtgtctcacctcgcacggtatagtctctatccaagtctcgtcagactctggcgggcanatttattatgtcgtgcatcgtgcgcactactcggtgcgtcctcttacgctgtnactctgatcatattaatgcacagacaggtgcgccgtaagcagatgagtccttatctcgattgtgtct

SEQ ID NO: 20015 - DNA, 744 bp, Homo sapiens
cagcgtgtttgtctggtggctttttcccgttacaacgggtattttcttcctgtcgggggcagaaaggcgcattcgcgaatagggggtggcgggaagtgcggtgcgggtcagttatgtataatatggtatctggtgtcgggacaacgcctttttggccagcgcccgccggggcgttggttggaggggtgggccgttgttaggggggccaggggttagcaacttgtttatcaactagccccattcttctgtaatgagttcggcgggcttccagtggagtgtaggctcttgactgtgacgtgtaagtagcccgttatgagggtccggcttttgtccggccctatgatctgtgtgccggggcctcaccggccgggcccagtgtccgggtgattgcacggatgaagccgggtacactcctttgcccggcaaggagcactgggcgttttcagacctgggaggaaggcttttccatcccaattgtatccagggggcacttgtggccaggcctcctcgtgggagatccaggaccagccagctgtgttccctgcagtttggaaaaagcccgacatccaacaggcgccatactctcagagcccttgtgcagatccagcatggaggccaccctcaggagtgacttctcatccaccctggcagctagtaggttctgctgttatgcagagccatttcctctagaatttggataataaagatgcttattgtctctcccttcaaaaaaaaaaaaaaaaa

SEQ ID NO: 20016 - DNA, 887 bp, Homo sapiens
tgcctgatatgattgctgctttgccaagggggcacttccaatagacacctcatcctctttccttctacaaactggcataacaagaggaacagctaccacaggctgctggaaagagacaaaatgaaaacctttttagtttttagtttttcactatttcttaagcagcaaaggttaaacatggcaatactgaggacagtccttcacaagtcggagctgagacttcattatttgaaatcaatcaatctctccctccctcatatgtcctcacagccccgcttttttttttctctctctctcacacacacacagacacagacacacatgcactcacccagcatagtttacccactttaaattttaaattaaaaattcagagttgaaaaccataaaagcctgcatccaccctataaagttgtatactttatccagaaagtcttaaaacaatatctaaaggagcaagataacactaaaatatcgttctagaaaattacggtacgcagaaaccggataaaatgccttaaaaacacatacatataaccaggctacctttaatcacaacccttatgcgcttagaacagacctttaccaactgatatggtcctgacataaagatattaaacctcttacagacgatagaacaataaaacttaggctctaaaactaattcatacgtataaccagacacacacatactcctctatatattgcttctcatcctattacctcttaccaacccaacgagcataagacataagtcgagcgtcacatagcactcgatatcactatcctattcgtataggagagcatatccctcactccaccgtcaatctttatctccacctaattagcactgacatgtaaccccactcatatatcacataaacctc

SEQ ID NO: 20017 - DNA, 761 bp, Homo sapiens
attttgacaagagcggacgacgacaggccggagccaagtattacggcgaccgaggaaagacagatgggggaagaggggtaagcggcatgggggggtaaacatgtcaagaggaggacgaggcaaagcagcgtgttacaaaactcaacatacagaaaaatcaaacaatctctcccaccgtaatctgtcagctcagcacggctataatattatactctctagtcacgcacacacaggcgcagacacacatgctcacacagagcaatgcttacccacttaaattttaaattaaaattctgagtgaaaaccaaagagcctgtaagtacccagaaaatgtaagttttagtaagaagtattaaaataatatggaaagagcaagttaaaattaaaattcactttgaaaattatgttttcaaaaaatggaaaagtatccttataaagttatccttataaaatggatccttataaaaaaaatccttatgtttttagaaacatacttttacaaactgattatgtacatgttaatatggatagaacaacttttttgaagaatactgaaaatctctacgttttgtctgacaaaagatatccatagcatattcagaaagcacagaaaaataactagttagagaaggctggaaaatattatgatcctctattgaatgcatgagggctgagctggacaataaagcagctgtttcatctttattcactgaaataaagcctggcctcgttggctacagcggtggagcttctcggccagg

SEQ ID NO: 20018 - DNA, 978 bp, Homo sapiens
  misc_feature (1)...(978): n = A,T,C or G
catgtgccataggccgctaaccgtgcatattccctctcaccacccacgcgtttgggtaccgcccttcctcgccaatgacacgccctacatagctattatggcccacgatcttcaggggaacctcgtcagcccttgggaagacaaaggcagaagaggaagacaagagctccttcaatttgcgggctccatgcccactcactcccatgccatcccagactcggcatcccctagcacccccccccccaaccccccaacctgcatactttaaaaatatgcatcgacccattacacctcccctcgaacatcctatcatcctcttggcacccctcgccgctcagccgccctatccttccccaccctcttccactctgactacgcgaaccgcctacagatagcttgccacctcgtctctcgtccttctgcgacggtgaccatatccctgtcctctaacccacccacccaacctccccgccctctatctctcggtttcgtaccaccgcccccttctacccgccaatctcctcccctccccacttactcagttacatcccccgtccgccccctcgcccccttctcttctgcctactcagcgctacccctccccatcccatatactatcccccgcgccgcccgcccattgtcaccgcgtggccccaacccgtcacccgtgactgctcctcctcgtctgcccacatcctcccgcccctcatccttatccaagcagctcgatatttgctccgcagtcctccttgctcatccctgttttgcttcgagtgccaccccgctatactccccccatgccgcgactttcttccattatttgattatgcttgttcacggctcctcctctgtggctcctgtcattctccgcaattccgattcggtacctagcgacggggcgcctcttctgtgtctctgaatttccccctctcatttcctcatctcttatagnacatctctgcaagatcgcctcccgca

SEQ ID NO: 20019 - DNA, 1229 bp, Homo sapiens
  misc_feature (1)...(1229): n = A,T,C or G
tggggnnnnnnnnnnnnnnnnnttttnnnnnttgtggncntnnnntnnntggnatnctcnnntatatctctataatattatacttgtnacacacaatacttcagtnaccacctcaccaaccatagtttattgttaattaaggtaatttctactgcctatcacaatnttagaacgtaaacttcacaacatagtgatcatcaccatgtcgcatagcgaaagcgcttccgcgctgttcgttacgcacagctgtagtcgcgctcgcggttggtccgagcctttcgagataagcccagatctgaataagaaccgcgacttcacaacgactctctatataaatattatacaacncttccatcaacccaacacaacataacaccaattacancacgatatataaaattacaatatncataaggtaatattatagctgctgtgtgactggggtnttcggtgcggctttacggtgngcatatgcggatgttctgtgtggagtttggtcaagtggagngaatcagagaaaaagacanacaaatactctttgattcaccccccccctactgcgcgtatcctgctcctcgtcctcccaccacgttcctgccgggtaccgcgcgtcctcgtagagagggcggggccgcggcgcgttccggcaacgaagattaaaatcggctgaaccaccactccgagtactatgcatataaaggatctctaatatatatactagtaagacaattgtcagtaaatacttcttatattcacttgaacgaatatatnnnaatataagtatatgtnaaattagaagcatgatcaactgttaganactacgtttcggaatagataaanagatgataaagtggagaatcgtgatgcaaggtgagcaacgcgatcgatctaacgttagaggtgcggttatttgtcacatgtccgtctcgcaggcgcagacagtagcgagcgctggtatgcctagcacaatgcatagtagatgggatgcgtcggacgcnccccacgtgtatccccagatatatagagttagggccaaggcgngagggtgatgcaagtgagtaagttacgaaggggcgaggggcgcgagcgagcgaagggcacagctagaggctggcagaccgcgattcacaagagagttacgtagtctgcgcgttcctgggagntgtagaactagcatgtcgtacggcgggttgtaggaggaagataagctggatacaaggtgatcgatg

SEQ ID NO: 20020 - DNA, 1620 bp, Homo sapiens
  misc_feature (1)...(1620): n = A,T,C or G
agataatanatagataagatataggtgtgtcgtatgctccgtccgactcggtantagctcgattatcgtgcagtcngacggtcggcgtcacantgagntcgcgttactctangnatgagtatcgtcaagatcacgtttccagtatatacgatacatcgcgcactctgtnagctagctctgtgcagatatctatatagatacgcgcgngntnaatgtatntcgtgatgatatgcgatctcgatatagtctatcgactgtcgtncagacncgagtggcagcgatcaatcgtcgcgngcgctgtgactagttaacacagcgcggcgatcggatcgtggctagtggcgnacgacgncgatgtcgctctgagatagtngagaggatcgtgtcgatatangagggagagttagagatagtagtcactctctacgcggagtacgngcgtcgttgtacactggcacgatatctaatatcgtcgctcgcgtgcgctcctataagtacgtcttctttctatgcgtcatgttctcgtcgcgtgacttgcatgtgttgtcgtatagatattcgctgtgtatgcttgacgttgtatatattgctgcntncctcgtgtattgatgcatagtacacgatgctgcaagtaacactggagtcaaggagattagtnagtcgngatatatgaagcgatactgttcattcatacgcgcacacgattagtgcgtatagatgcatatgtatactgagtacgtgtntntatctcggtattaatacgtgtatacagatagactcattctgttgtatctctcgtcttatgctatccatacctgtagagtaccttcgcgcgagagtgtgtgtatatnnacatccgccgcatgctgctgttcgtctgcggctcggtagatagcgcggtcggtgctgtgaggatccttattactcgttcgacgtttcacactaatctactanagaccggttctcattcagtctacaatcgatgcgctatcgattccatccattttnacttctccgtctctcttagctacttcagcttcttatacgtacaacactacatactatacacatatacatacacacacatcacatcatataatatatctactacactatatcagtaacatagaattatccacttatatctatgttgttcgcttagttctcagttcatatcgcgcattatcgtcctactatctatcgacaccgatcctgccatatattaaactgtttcggcgcgccggatctaatggagctgtatgtgagtgagatctcctcggaggcggcgactcacggagagaacagacgactgtgaattaagagaccttattgctacaaatcacagtgattcacagaacataggtgngngtacgaaggtgtgtgagcagagtagaagttatgctattggtanaggtgtggttgttaggattgttgtgagggtttggtagtacgcaggtgaatcgacgtcgtcgtacattcatcatttttacatacanatatataatgtcatgtatcacgcttttatggaggagcgagccgggtcgtgatccaagagagaaggagggagagtagacgcagatggtnncgtggtgngantatnnnnggtagtgttttggtggg

SEQ ID NO: 20021 - DNA, 972 bp, Homo sapiens
  misc_feature (1)...(972): n = A,T,C or G
cgctctctcatacaacccccncccccccgtcagggtcactgtgatcctgagtttcaagaactgactcagtggcagaagaaacttcatcgaggccaagcacattcaccagcaagtcaaaattttctgggccaagcaagaacaaaaagtgaaatgcaaaatggaggaccatgtagtacctcgagtcaacatgaaaattccatcatgttagccatagctacgacgtctatttcgcccttcctacgccaacttacctgcgccccgggttcttggtacagctgaacctctctgtccagctatacctcaacaaacaccccgcacctccgccataaggccacccccttatactccagccccgccaccgccgagcccgtccacccgccggagaatcaaaatccaaccgcaattacctacataatcgtcccccacccgcaatctctctactcctcactcaatactactccccacctacaaccccctataacatacccacaattaccccccttaacgcgcgactcccccacgacgacgacgtaccccgcccgccatattatataatcaccaccaccaaccacactccaccttaacctccacgcctcgccaattgcttgctcgtccgtccctttcattttttctccccctttgcctagttgctccccaagctcaacctcctccccaccgcctcattactatatcaccctcctctcctccacatatcgatatacacaactccgactaccccttccaccgaacccatatacctcctgtcgcattccgttgacagaaactaccgctcacccacccccctcaccgcatgaaccccatataactccccgccatttccaccccactataacacctccccnccccgctcccacccttctcacnacactcatactccggacgaaacgcccactcacccgatctcctacccactcacacttcccgtcccacttgtcgatcatcgccatcttt

SEQ ID NO: 20022 - DNA, 1323 bp, Homo sapiens
  misc_feature (1)...(1323): n = A,T,C or G
aaacatgatntncatgtagactaatatcgatgagatctaagngactctccttgagtngacttactatantgtgnngacaacgtcgatctgttntcatcatgcgcatcttctcatgggtcgctccgtcgtgngactcatgtggcgtaagtctttgtgttgtgtantcatgttgannngcactctatatgtcacgttctgtatacgcagcccgttgtgtatangacgcattcacggancgtctctaatcactgcatctgaacattcatcatggaaccgtatactggcagtctcaagacatgtggcagctgccactggtgacacgctgatactagatcgtagtcgtgaatatctggagcactcgtgtnnntgctctttatcaggtgngtactcttactgtnnacacataatctgacacctatgagatctgagtnnacaccactacgaatctcaagcgcgctgctactatgtagactcggcacagcgtggtgagatgaatacgcaacgacgaggangacaaatagacatgaccatgtcgtgagtcacgtttcatattctgtaacataaatgaggatcggagagtgagagtantatctatagaatgatcgangagcttatggnccaatgaatatcttatcgcgtggttctttangcgtctcgtctgttgtctntcatttgctgcgtggttatactctatttctnaggctgtaccatagtgtggacgtgcttcggtgacaccacggcgaccctgtcctcggngctgtgncgctcgcgcctgagtctctgncacactanacttattgatcacatctcctttatgttttttncacttntctctgctatctgtctaccgtctcaactacattaaaattacgaatatnnactcctctntactctctntctctcncccttcactccctttctcactccactcatnncccttaccaacttaatactatctatnanatctgtatctctcnntcttcttgcngctcttactatnaacctatcccttacgncctacattgatntccctnacctccgcctttcctgccccgccatagttgatctccttgttctttntgccctncacctcctcccctcccttctctcttcctctctctctttatccttccaccttctctcccactcnncctcccactcgctcccttcccttnnncactnnncactctcncctttctnnnccctttncccatcttnatannttctnnnncctttnnctnttcttataactatttnnnacataaaatannnnnaatatatantttnnacataatnnacttatatttaatatatatatactta

SEQ ID NO: 20023 - DNA, 158 bp, Homo sapiens
  misc_feature (1)...(158): n = A,T,C or G
accacccacccagaaaaaacccgcnnggggctcacagacacaccataccaattccttcactgatggacgttgatgaatgcccgacgcttaatacgtcatattctctttcgccgcgccacgggaacgggtgcagaccgactttcctacggatggtgccg

SEQ ID NO: 20024 - DNA, 1350 bp, Homo sapiens
  misc_feature (1)...(1350): n = A,T,C or G
tatagatgncaatataacaatatgtagcatnactatgtaacgcatcnagtntctaccatactcgtgnnngcagctaacacatatgtgnaacatgtgtncactatacgacgtgccactgactaacgacattcctgtcaacttgtgatctggtggcttatctatgtggnngtcgttcttgcatcttcatgtgctacatagcacgtgatcagagactgccacagaagactctctatncactgatagacacacatcgtctagncgtctgagcgttgtgatgcggacgtctgatgtgcttcgcacggagcgcccgagcttgaagactttcgatggcatattagaccagtcntnaccacacaccgggagaacattgcatctacgaactattgatatatctgactcctggnggacatgtgctcaacatagatgnacgtttgatattagagtgagagactcatacgnggttagagtngtaagacatgtggatggaactagtgcctcctcgtgagacagcactcaaccagaatcatgantctagacgtggaagtggnggcgtcgacagagaacgataggtcaatcggtgctgttcgnacctctacaacgtctatctgattgaggtattgggataatcgtatactattggtctataagactgaaattaactagctatagagtggtgtcgacgtgtgatgtgngcacctactagcctattatatggtngatgattngactggaagacataaggactgatagaggaccgccaacgtgagaaacatgtgattcgttgtaacttctactaccaagtatgtatcaggatntatcacatatnttcttcctactaatncgctatgaattatangctcctcacactctaactagcattttagactatcattcnantatcatctactctcnctntctctctttcataattgttnntcgctttaatatatgatactacaattttcacatattcccacataacgcattgtctanacctcttnatacacatacaagaaactatctgcacctattcataatcatgtcattctcgtcattcatgcacataatcatantacatatactacactatgtttcattacgttcnnnattcttcntactacccattgcttgcactctacacaatgaccatcctctctctattctctacgttgatctaaatcaatagcgngnctgtgaccttncggttggngccatacnactctgtgtggtagttnnacttctngctccttgattatangtananaatntttttttatataaacttcatnatataaattannaaacatttatataatntaatataaactaatatatatataaatattatct

SEQ ID NO: 20025 - DNA, 1080 bp, Homo sapiens
  misc_feature (1)...(1080): n = A,T,C or G
ataagcatcataatgaaaaaaaaaaacctcaggggtacgagtcacggacattgaacatgtgttactatctgtgtatctgcccttctgcttgggatactaggaataaagaaagtgatcagttgtctactgttgaaagcactctgccgtggagcacacggtatccgatgtacggaaagaggctagtttcatcatcacagatcacgtccattgaccacccggcccgggtcttgaaagaaaagcatgcccaagacaagactacctctgcgcaacatagattcgaaacatcggggcgtgccctagttaccacatcccgaacggccacgacaagacccgtactcgcacgtgcgcgaggcgacataatcccccgaccatagcaaataatgcgaaggctggccccgcgccctaaccctacgacgggaaagcgagtaaatatacgcttgaaacgagtcaccgccgcctaaggacaaggtttcgcatccatgataaacgaccccgccagcattctgaactgcgcagcccacgcgcgatcgcacctcagcggaccagggccggcgacgcgcaactgagacagggcgaccgccgccaccgcgggccacacagcgtacgcagcctgaccacacaaagacgatagcacgaacgagtcgctcgcacaataccccgcacacagctaacgcaccacaccagagccacatattgcataggcggctacgacgctcccaccgtctacagccgccgacactcccgacttcccacgaacaaacccccgcaggcctaggctggcgtagcagactcatagagaagtggcacctaggacgcacgcgcntcacaccgaaaacatcgagctaaagctgtagtcactatagaagtgtatcagatgtagataagcacacgaggtgacttgatgggatgagcggacgagctgacacaacggcacacgcggcgcgcaccgggccacaaacgacgcgtaaatataatagacgccaccccacgcagcacccccagtcgtaatgagtactgcgagcggcgttcgctctatgtagagcacgactgaaactatacatatgtagaaaccgcagaacg

SEQ ID NO: 20026 - DNA, 1329 bp, Homo sapiens
  misc_feature (1)...(1329): n = A,T,C or G
aggcagtaccgtctccgcaacaacgaacggactgaccctacgcttatacaatatcacattatcacancgatcgacacaccacgcatagactcgcagcttcgttcganaatacgtgtgccagcantgctgcggnaatcaagntgcgtacgcgacgcgcacggccgcggagtacgtcacagcggatagtagtctactacaacatgaagagantntaaggtgagagcgggacagtaaacagacgggacactatggtatatacagtattacgcatggcggcgtgccgcagtgaggagtcgtntgcgagcgcgcagcagcgcacgggctggcagnagctggcgacagcgcgcgcgccgcacagcgggcgcggaagtgcgggcgttgttntgtattgcagcctgctcacccgtcgcctctgcgcgcgctacttacataaattccgcncctgcactctagattccacgctcctccctcccgcggagggatgcgtaccacggcgtcgaagcacgcacgcgccctgcgggtgcgctgttagctgcgcgcgctccccgatctgcgaggtgatgctgtggatgaagtgagatctcctcagcacaacctgctagacacactagtccatctgctctctgcgggacagncgtccagccggcggcggccgtctgtctacgtgggcgcgagccgcgaagtgcaataacagtagcccgctacaacgcagtacagctacactccagctgcgccgcctctcgtacacaagtcacttcacagacgtgcggncgcagcgcgcatagatacgctcggaggcgagcgtacgagacgacgagagcagagcggcgccggtcggcgataaatttcgtgagagtcacggttgtgggaggtaactagttagaacaggggagtggtgaagagaaagaaagaggtggggatgacaaagacgctcagtggtgcgggccgagctgttggagtgtggtgagtaggaagcgaggctctaccctttatctccatgcattcgaccgcaatacccagtatgagagaataccgcttgacatactattacaaaaccactcttcatattaattatactacacaggcagcgctacgatctgaatacgaggtaagcgacgagacactgcggttatgttatttgatcgtgtgggcgagtggtaggacgatgcgagacgcaccactactcggcaccgcgcgcctaacgtgcgttcccgactacaacaccattcaagcgcagccgcgcggcgataagggtatctcgtgcgtgtgtggtgtttggggagtagcccacactgataaagacgcagtagtacgagagtttggcgcacg

SEQ ID NO: 20027 - DNA, 1159 bp, Homo sapiens
  misc_feature (1)...(1159): n = A,T,C or G
cacggcctctgatgttcgtatctcgctcttctctgatgtctctgtttttatggttctcctcatcagctccgcctccgctttcgcctcctgcncgtctcccctttttgtcagtcatcgttggcgagatctatctgaaccgttgagtcgtcgacttgccctgttcatatgcctgtgtcctccttcgccctgctcaatacctctcnctttcccgatgcgccgctgccggttactgcgtcgtctctgccgggcgctcgtgctcgaacctgagccgagcgtgtgcttacccgtcttgtctccgccttattttctgtatttcttcgcatagagtcatcatggtggtgcggtttttgggcgtctctacctaatcatcatcatcggatctgttcgttctgttagctatgtgcaaggggcgtctcgtgtggtcttggcgtgattgtcctcggctgcgctggccgcttcctctggctgcgcatctatatactttcgccgcttttcanttgatctctcccgagacctcacgcctgccactcattatcccacacatctgtgatcttccttactgagcgacctatatcgtacggtgcctttgctctgtgcttcgtacgctgaggctgccgtctaatccactctgttcgacatcacgttcgtttggcgttcgttctgaccgctcgtgctcctgtcgtctgtcgtcgtctccgcggtctccgtggatcccggcgtgctcccgcgtcggtcagcgaggtacatcgtccgtggtgtctcggggcagcgtacggtttctataaaacgaaatcatcggtcttgcgtgcggttgcggttcgtcgtgtcctgttgttcgtggccgtgtgtctgctgcgtcggggcgtgttgcgccggtcgccttcgtcctgtgttctccgtcctcgttgctgtggttcgtcgttgctctttcttttgcgctgtccgtgccgctcccgtgcctcgtnttcgtgcggtcctgttcgccgtcgcgctgtctgcgcccgcggggtggtgtgttggtgtgcgctccgtcgtccttntccctttgttttgctttggtctttctcccctcttacgngtggtggtttgtattngactcatgaggcttcttcttctgttctctcttcagctgccgcgacactgtctggccgcgtctacg

SEQ ID NO: 20028 - DNA, 954 bp, Homo sapiens
acatcgcaacccatacgaggaggtaaattagagaaacctccaggtggtacgtgtctacggcaccatgatcatgctgtccctatctggggatctgcccttctccttgggatactaggaataaaaagggtgggggttgtctacgaagaaagcatctcgccgcgtagaaacgttatccatgtccgggaaagattctgtgtttatctctcagattgcttcattggggaaagaggacgggtcctcaaagaaaagtatcccaaatcgggtctcccttcgggcgaattgtgacacaagggggggggggcttatttaaaactctgcagcaaacagtaccgtggactcaaacccggggggagaaacaccctccatcgtccctcgggacaggcgcgcgacacgaccttccaattatggacggtaaagaattaaatatcgaccggacgcgaaaaaaacaaacaatgagctcctccgccccagcgggtgaggtctcacgtctgctccctttagttggggtgatttgcagattccacagtcttgactcagtcggctccggacgtgaggacgtgttagcgccgcccgctctcgccatgggcgaaccgcgcgattccgccactccggagaggcctccgacgtgaaggtgggaatcagcgtgggcccgcgtagaaacctaaagggcctaatggcggcatagcaccacgccgtacccgactggaggagacagcgagcaggcgccgaagtggtaaagaggacgggcgggaagaggaacagccatcgtatccatttaatacacctgcgacgacgcgatctctcatcatgcttgcagagacggtcagccccgccttaccgggtagcgtctgtgccgaccaccgcccaggcggggtagtcgcctcggaagcactaactctatgcagagcacttcgatgtcggggagccaaatacgtatgatccaccgcacgcgag

SEQ ID NO: 20029 - DNA, 1540 bp, Homo sapiens
  misc_feature (1)...(1540): n = A,T,C or G
actcgtagttcattagagcgcgcggatccatcgactgtctatacgcattgaagccgtctaacatactatgcgtcacgatgcgcggcggtaacgtagtatacatgcggtgcaattcagtgggctcggtactgtcttgctgacttgtgtcgtcngtgagatgacgctcattaactgcgatagtctagcggtcgatcatagatgtctctatccaatagattatctgtgtgctcacttacacgcggagacagtctcagtgtgtcgacgatagcgctcgtgactcgcgcgcgacatggagagcgcagcaatgagctagtggaccagtcgcgcctgtcacntatcacgtgccgacatctcgcggtaggcactagtcgagacgctagagatggngtgtatcatagccagcgatccgcgagagtgcgacacatcacagcagcagatatatgtgtctcttacgacagtatacatgtatgtattagaatcgtcacgagagtgtctagatgatagatcggagatgatgtggagtantaacggcacgnactagacggatcatgaaaattcgtggnggatagtcgcacactgctatnctaccgcatctccttccgcactgtgtatagaggtgagaaatcagagtcacactggtctccgagatgatcgtgntgactctgtagtctcanagtcatgtctatgccatcacgccgagctcgcgttcaggtgaggagacgttgtccggacctggcggtttgcatagtgatatgacatactgagaaatgttatacgtagtgacaatcggacgataggtggtgaagattcggtatagagtgacgcgcacgcgtcgagcagggtcatttattcgaacacactatatagcgtcgggcgtgatgatcgttgcctgtgtacatagtgtgtctattcttagttagtactggtntgtgtgtcgtatgactntgaggtgtgaacaagcatatttgntatgtgatatntgaattagagtcacgcagaatgagcggtgcgtggcacatacagcgaataagtggtgaacancatcatcagatacgtggtgtagttcagagcagtctgtactaatacgggcgccactgcatgttcgggcacaacacgaaacgcgcatccaacatgctaatacatcgcgagtactgtagccatacattcaggattaatacagccatatagtaatgcgattgtagcgangcagtgtctcgtatatactgagcatcagtcgtaacaacaaattaacatagtatataatagtcagcgaggaggagttctgtgtgggtgggctagggtagaagcgttggtgtggagagcgtaagcgatgtgcattgaagtgctgcggtgtgagtcgtagagtgtgtgctcagnagtgtgcagtcctctcgttactacgcacacataatctccctctacgctcggcgtaaatatttttctataaccatagcgtacgtattgctactgccagcccggtgacgtacccttaaaaagcgacactcgagcactactagcagatctacctagatcacacacc

SEQ ID NO: 20030 - DNA, 717 bp, Homo sapiens
tcgtggtttatgttactggcccacttcccctgtgtcgattacctttcgctccttttggtcactatgagttgtatcgacttctgggcatagtgttatgggcggtttgttataaactatttgatggtattcatatagtattccccggtgtacaacccgggacgtcccgttattaattggggggagcagggcggcaggttgttggtgtgattgccccgcttcaatttccaacgttttaagataggatggtgggttccgcgtgcttagccctgttgttccgggatcagcaatgcgctggcggtagtaacacgcgccgtctaggatgccaggtgtcttgcaccgggccaggaacatgtggtccaatatccgtatccgcccttctccttggtattctgggacaaagctatgtgactttgtttaggttcaaagcctccgccgtgtaggagcgttatccatgtccggaaagattttgtttcatctcgccagcttacgttcattgttcagtggccgggttttaaacaaaagtttccaaaaaagggtgttccttgggcgaattgttttgcgaatggcacccggcttctttagattttagcagttatcagtagtatgtactcaaattggggggaaaagaaccctacatgtttcttgtaaaggcgtctgtcagtcctgagaattattgatggtaaggaataaaaaatgttctgatgaaaaaaaaaaaaa

SEQ ID NO: 20031 - DNA, 1152 bp, Homo sapiens
  misc_feature (1)...(1152): n = A,T,C or G
ctggaacgctcgtgtgnggatggagagatagtgacgactaggngtcacatatcatgcaaatgttagagcgngcgtactagagcgctggtgggtctggtgaggtaacacgaagaccagacgcatcacgnaactacgtactgannaactacataacaatacttcacattatatgttgtagcacgttgcctgtactatggacacaattagcgccgatacatattgngaaccgggagcaacgctgagtaactctcgtcatataatggatggacggcgaggacggagggctggggtactattcttatctctcgatagtgcactgatccgtctggctgcgagngagagtgtggagggcggtgcgcgatgcggatctcgttgtttttataacagtacgatcattctaataggaagacaacactcgcagtgtgagggcgaaagatgagggatggnaaaccataggaagctagagaaagtagggaactaagagaggagacgacaggggactcacgcggngggaagaaggtaatangcttggaatatagaactcaaggcacctgacggagccgcgccccgggccctcccgcctctccaatgaagatacccaaanaccactctcacttcttngggctgcggggagagatgagtgggctcctggcggcgggnnccgcgcgaaatgttgagactgccggtgctctgtctgctctttcgtaggcacttggtncctatctattcttagatataaatatgaacctgtngactatgttctacaaaacacggaacgaatcaatgacatcgnctccttatntactaaactcattctaatnnaaaacaactattacctaaattttatataatatcatactnaaactacacagaccattnnacctcatcgtcngccctatcctacttcatattaattcatattggnctacgtcctttcatncatccctatatattcttacccctctacttttcttcttnctacttntctactnacttcatttanntnacttcctacaaaacttntnaatatcttttcacttcccancaataaacaatnaaacatnattnccttnnnnctttnnctaaaannnnnnntntnnccccaccccctnctnccncacctcttnnnncnnnnnncnnnnnccctctctt

SEQ ID NO: 20032 - DNA, 147 bp, Homo sapiens
ttgctgagtaaccgtctccaatcctttttgagtataacactcagagaacagacaaacaccaacagcatcaacaacagagaaactcagtccaggaggatatgaaaccctttgtgataaagaaagcaacatccatgaaaaaaaaaaaaa

SEQ ID NO: 20033 - DNA, 974 bp, Homo sapiens
  misc_feature (1)...(974): n = A,T,C or G
aacataaaatttacatagaaaaataaaataactcgataacaacatcttaccaaatctcttttatcataaactatttccttgcactcatatgcttcttactcccaacctaaacaactgatgacgggagcaaaaaaaaaaattncatctctcataaattataaccccacttatacttctacttcaaccataatcatttatttaaacaaaaacttctacatttaaattctcacaactctatatgtctcataaacatctcatatttaatccaacctcaggcggggctttcctttattactctcataaaaaaaaataaaactctctcctctcccacaatcatcctccctaacacaactctcacacaattctatttcacaaacctcactaactaacacctacattatcaaccataaaactaacaattctaccacaccaactacaacaataataactctcaaaactgctaccacacaaacaaactcaaaaaattaaaaaccacaccccatccacctacataaaaaaacataaataaacacttcctacacatcacacaaacaaaacaccccaaccatactaaactactatactacaaacgtacaacacctatataatattaacaaaaaacaaatattaataaccacacaactaccaaccaactcatatacacccaaatactaaaataaaacagcgcccaccatcatcccaaaaatcaaaataccacctcaaccatcataacaactacacccaaacaataactcaaacacacagacccaacttaaataacaaactccaatcaaataccacattaccacaccatactctaattactacccacaaacacatccacacctataaattaccactatccacactacaccaacactgaaattccatacaccaaatagagcacagatatccaccgatcgtacgaccattaacaacaaccaccaatacagcacccaatacatacacaacag

SEQ ID NO: 20034 - DNA, 1952 bp, Homo sapiens
  misc_feature (1)...(1952): n = A,T,C or G
gtagtagtagtactgagagttgaggagtagatagacgcgcgacgatgcgacagtagtgatacgacgagcagtgacaatgctcgnantanctncacgacgcatcgacatctatcacagctngaagntnnctgcatgtagcacagcaagacagctactactcgttgctcgcgagcgtgctatgcgatgtcatacgtantcganatnatatcantacgntcgatgcagcacacgacagnaatgtatactantatcaaagtagangatcatcgagtacccacacgcacacttaatcacagaaganatacngagccgtcacagatagatgcatcatatgaccgtgangggtgcanggctagtgcgtgtgatgctgtcgtatgactgcactcacctatgtgcagccgctcgcgtagtgacgtacacgtcagacgaagacgacgcggtctgtgagatatatatgatcgcgacagctactatcgcgactagatagaacatactgaatgatactagatctatggagaccagcacatggctaancacaagcatnccacgaccaattnacangcgcgtggcactagctctcgggattcattagaccagacgacacgcagcntggtacacacagatcgacacacacgatatgtagtanccgcagctctctcagtatcgncatgtntgnacgccgggagcgtcaacgcgcgcagtagtagcatagacgtgcagtgantactcgctgacgccgctcgcgatgcgtccagcagcagcgcgagcgtcgctggcgcgcgcgcntctctctnacgcactccgatcagatatagattgtaccgtctacgcggctacgtancgacacagcatgcaggcagtacacactgancatagctagcgcgccgtgcacgatgctgaattgncgtgtacgagtgtcgcgctcgcacacagactgctgatactccacactccgcagatctacnctctcacatcncatcagccgcgcacacnacgttcgtatactcctctcactccactcancacgatgactacncatactcactactgtgctcggtatcgcgaacgtantatacgcgcaggttctctcgcgttctacncngctctcgagtcagtcctccgttggcttgcgcagccatgcgacctgncgttctcgatgcggtgcgtatggtgtgtaagtacgttgtcgagtatagagtgtgttatagagtactagaataagattagacagtagaatcagagcgcgacgagtcgcgctatatctcgncactcgtttcgtacntgatactcatgtcacatntgcatcagcgtagcgagtcggtcgcatantcagtatcaactacgtgatacatagagtanacgtagtacagcacgtatactacaagagntcntatacgcacgactcagtgactagtcactgtaccacgacacgctatcaccagaccntcagcacatacggcgacacacaagatacaatatccggatatgcttctgtgncacacgagactggnatngcgcacgcgtcgagtgactatcatagcaacgctgatcgcgtgtagtcacgatcanatcgagaacctcaacgaaggacgtatcacgcactctatatacatgnatctctgctagtntcaatcgaacttagcacgccctgccgcgtatctccgccatgcnacgctacgcancacgatggcgcgcagcacagntcanacgacactcgcttataagagctgagaagagtagagactgctctactgacaatagagtgagacgcagacatcagagaacacacacgaccgctatgcgtggcggcgtgttganacatgtganagcgtggatatgngttangctactcactgcatacgatctatgaatcacggcgccgaatataaaactancacatccgtatacgganagaatgagactatcagagagaatcacaacaccatagtacg

SEQ ID NO: 20035 - DNA, 1179 bp, Homo sapiens
  misc_feature (1)...(1179): n = A,T,C or G
ctctggtgctgtctctcttcggttccccgtcgcgtctccggctcccgctcccgtgtgtctggcgccctcgctcgctcgcttcggggtcttgcgatgtggcccgccggtctcctncggcttgtggcctctcccctttgtccctctcttgggcttgcgttatttctgtttcttcgtcgcccgcgcgcgcgctccccccctttgtctgttctgtcgcgtgcgtgcgcgcgcggnggcgtggggggtgtggtcttcccccctccctccctcgcgctgctctggcgngccgtgtcgttttgttgcggcgtgctctnttcttcttcgccgcgccgtgccacgctctgccgcgcctcgcggtctttcagtcctttctccgctgctctcccttcgctcctcgcgtccgtcctcgctctgtggtctctcgcgtcgcttccggtttggcgttccctctcgttcttctccttttcgccgtcgcttcgctttccttcctcgcgcgtctttctcgttctcttttcgcccgtctctctcttcctcttcttcgtctcccggctcgccgtttctgctgtgcggcctcgcgcttgccctgcttgctgtcgtgctcagcgcgtccgctgcttcttcctcctgccctctgccggcgtcgtctccctcctcgcgcgtgtcctgcgctgctgcgtctctcttcgctcctgcgctgaccgctctttcttgcgcgtgctgcgctctgctnctccgcgctgcgcgtgacgcgcccgtctgtcgcgcttcttcgtcttcctcgcgntgcgacagagacgccttgtgtcgtctctgtctcgccgtgtgctgctcggcgtcgtgttctctctgtgtcgctccgggtgcggtccgctgctgtgtctgcgtcctcttctcctttgtggcctgtcctcggtcctctcgctcgtccttctctctcgtcctgcttgttctggtctgtgtcgtctcgctctgcgcggtttctcctgccgctgtctggtggcgtctcgtcctctcggtgctccgcacgttcttcttccctgcgcctcgctgtctntntgtttngttnnttgggcttttcgtccgcncctaacggcgtgtgcgtcgctnggttctgctctcgcagcgttttcttctttcctcctcttccgttgttggggtgccggcttgtcgtgtccctctttt

SEQ ID NO: 20036 - DNA, 371 bp, Homo sapiens
tggacctgtttccacaatagagactctaggggattgtgagaactaaatgacatgatgcaatgacacacataagttctgaagaaagtctcttgctagaaggtaagaaatccttagaacacggggttctgagtgaagaattactaaaggagattctagaaatccttggtagaatctgaactgtcaaaggactaaattgaacaattactgctctcccactattgcaaagccatttcctatagttgctgcacaagctagaacttcatcctgggcatgattcaacccctaatttgtaaatttaataacagctcttggctactaagcatggttttcttctatagaccatacttcaataaaatactgttacaaataaa

SEQ ID NO: 20037 - DNA, 204 bp, Homo sapiens
gcttagatgatcttcccgatgcttttctagacgtggacttggacgaggatgaagagggtgcatcttttctggtatgacgaataagatgtgctcgcaaagaggcactgtactgaaactgttttttacacaactaaaagaaaaataaaattctctctaaatgtatttccattacaaaatgttaactgaaactcaaaaaaaaaaaaa

SEQ ID NO: 20038 - DNA, 221 bp, Homo sapiens
  misc_feature (1)...(221): n = A,T,C or G
gctcccatgcaaaagaaaaaaaaaaaaaagctaatgagaaaatgtagccttttgngtgaaagaactttacctttctacaatgaagagtggaatttctatgtttaaggaataagaaggcactatatcaatgttgggggggtatttaagttacatatattttaacaacctttaatttgctgttgcaataaataccgtatccttttattataaaaaaaaaaaaa

SEQ ID NO: 20039 - DNA, 1293 bp, Homo sapiens
  misc_feature (1)...(1293): n = A,T,C or G
cctctcttcttatggcttgactcggcgtgctccttctccgtcgcatcttcttcctgtattgaagaggttactgtgcatgcgctggtattgcgagtgggcatacatacatatccaacatggacgtcgctagttgtaatacttcgtagttctcgcgcgcgatgtgatataggcgtgcgaggcgactggtagtgatggtgcaactctatgatgtgggctgttgagtccacactacgcaacaattccatattccctgctcatcaatatatgatctcgtataccagttaaacgtatccgacctcttatgtaggtgcgtaatcgcgcataatatggagaccgatcgtgtgtcgcggacagatagcaagcatatgagtggcaattgcactcgcacttcnactcgcgccggcattatcagtacaagaggcggagtcagtgtgaatgtgcagagtgactgagatgtctgagactcccgcacacaatccacagcgaggcgnggccccgggcgtgattattcgctccgtcggctcggttgtgagcgcggggcgcgcagtatatgcactcagctgncttgcgcatatgttattctgtacgntgcagcagatctggagagcgagtnatatangttgngtgcgactgtgtgagttcgtatgtcatgacttatatagtantgtccgtggcatgttgtgatgcgatatacatacaaaccgattatgctgacaaacacgaatcagtacgcaatgcagcgaggtncgcgttcggtgtcctctctctctcgctctctgttacgctacgacgattctaatacgatacagacntactanggactatctggcttattatcgtattgtagaataactgatgcatacatacactcacactcgttatccatatttacatattcacttatatatattatctatatatcttatcttttactactatttatantttaactcactttcatcaattgtcattcatatttattattctaccgtcatacttaatancacataatatactttctatttattatatattaagtatctatcgacactacgaaacatacactctaactcctcacaccaacacactacaacattttctcttctcttatcttctcttcacttcatcatcatttattcctatcattttaaaacaaataaaatctcctactactctctttttatattagtatctagtctttaaatctnaaatntctacgtnctttatcagggnctttttttctctnctctnctttctttctcacttnntnntctnnnnntntttttcctcttt

SEQ ID NO: 20040 - DNA, 917 bp, Homo sapiens
  misc_feature (1)...(917): n = A,T,C or G
ccccaagccgcctcaaaagcaaaaaanaaaaacctcgttgggttacgcgcaccggacttttgacggtgtacctatctgngtatctgcccttctccttgggatactatggaataaaaaaagtgatcattgtctacgttgaaagcctcctgccgtgttcaaacgttatccatgcccggaaagattctcgtccatccctcagactacttcattagtcacaggccggatctgaaggactcctataccacatagacgcacattgagcgattttttttgcaaatgggaactgactcattaagaatattgcagacaccgacggatcgcctctcattgcaggtaacaaaccctcctagttatttgaaaggcccctcgccgtacagcaattatcacacgctaggaccaaaaggtcccccacacgtcctggcaatcagatgcttcactcacacacccccactgccgaccacgcacctcacccctcccatcaccaataacacccgcaccctcacgcacaccccttgtcccccgacctgaactatccacgcacatatatacatccgcgccgcccaactcgacactccgcgctccgaaacccaaccttaagccaagaccgattttgcgtcccagcgactagcactgcacctcccatacaacatcctcatcactgaccaatccgctacgcggcgcccccaaccatggatgactcactccccggtctcacctcgctactccgcccccccccatattacacatacccgcacaccgtcctgacgcaccccccgctcccgccgctccgtcaccccacccacccaccaccgctcccattagactcatactctcattatccccgcctcatatccttcccactgacatctccctcgcccacacgccatctcctgctattttatacctcggtgccgatg

SEQ ID NO: 20041 - DNA, 2040 bp, Homo sapiens
  misc_feature (1)...(2040): n = A,T,C or G
caaagcgtganggagcgagcagataagtcgactcactatagacgatccgactatgagnnngacggactatatcgagccacgctgtatggtgcggaacgctgcggtgacgcacactctctatcgcganggnacccaacgtacgtatgacacaactgtacacatctcnanatcacgtgatggtagaggagagtagatgtngcgatggcgactagtgtgagtgcgcatggagtgaaganatacaacgaggactcggcgctgtcagcacatagcgcgctgatnagataatantactctcatatanatcgatgtatgntcgactnagcgtcctctaggaggcacacgcgatatcggacgacgatgccggagtcacagcacagggaacgatgtatgtagtcgngacagatcccttagctanncatacagtagctcancaatacatatacgcgacacacacgacagacgagagacggcatccntgcgcgncgcgacgcgcgctcagcagtctgccgcagannangaccacncgatgatcgcagtcagtcgtcgtntgaacgagtcactctgcgctcgctgttcactgctctactagtactcctnncactcatgctattaacagacctacgtgatgtattcctatgtagtgtagtgcgctcatntcatcangattgagagagatagngagagnatgcgagtgaggcatggcgatacagngtgatcgatataatcggtngangtcagcctcataccacgcgcgatcagatgctntagacacacgcanccgncctgcgnactagcctcacgacgtagctgcgacgacagtcgncgcgtcgactgcgtcgactgtgtgagatcacatacgcaataacggacgcgatactgtacgtcatcactatagnnagtcatctatcatgctgnctgaaaggcatgagtgagcagcgcggagcttgagagatgacgataganntcgaacgtatactatgatctngcngnacaacgnctatgagacaacgacacggacgncacatgtagtacatgngcgancactgctatgtcttgtactgcattntgtgtgagccactactgactagcncatatancgtacntaacgtataatgatagatcgttactgtatagtanactcgataactctanagcngacgcntaccgtnatanctnnnncacttacagtcntgctngcgtgcgacgagacagngcngacacaaatcatcgagngctctatatatagtagngtgagtncgaccgatgtggtcgcgtatctagatancgatctatagcgantgagactctctccgcctgatgtcgcatgtgtgancgctcctatgttgagagacatcatcgtctgtcgtggtntgctactacagtatancanacgacgtactcnttgaagacgcagccactgacnaagatactctatatcagaggaccgagcgtgcatacagngacatatcacatcagatgcacgacacgcacgtgtancacgtcacgaccatgacngactgtcatgcgttangccgcatacacgtatcttganacgtactgaatangacagctnatcagtatcngcngntacacagacgcatactgctctcgctgtggantcgcagacgcgacggtcgagacacgtgcagtcngcgacgcgcgcagctacgtcngcgatactacgnngcngagtcagatcgctgctggnacacgagctaccacctagacgngnacactcgcgactgctngtacgcatanatatatagccaacacgtgtnanataacacatcgtngagtcgantagagtatctctactcaccagtcacacagtctgntataacatacgtannangtagtgagcgtgagtctgcagagatgaatatatacgatatatacacaatacagacagctgaccataatcangactagtcgcaggatcgagatcgcagagacgagagagcacaggtagntaaagcgtcgagagagangagacagtcagcacgacacgagtanacaacatnatatgatncacgacgctat

SEQ ID NO: 20042 - DNA, 1588 bp, Homo sapiens
  misc_feature (1)...(1588): n = A,T,C or G
gtcncgtgtgcttcattgtcgnctcgcgtcgcgcgtcgtgcgcgctctngccgcgtcgcgctgtcnggctcccgcctctctccgtcgtcttcgtgtcgcgctggtgcgccgctcgggcgtctttcgcngcgtgcctgtcggngcgtctgcgcttctcgtgcgcgcgcgacgtcgctctatcgtgcctgctcgcttctctgttcatttgtgcgtcgtctctcttgtcgtgttgcacctattctgcgtgcgngtgcgcgctggcgttatatagttgcgcgcctcgctcgcgctgtcgttatcggntgtctcgtctcgccgtggtgctcgtctctngtgtcctcggtccgtccgcgcgcggctgtcggcgcgcgtngtgttgtcngtctcgagtggtctctgtctgtctcgcggtccntctccttcgtctactcgctctctcctcgtntgcgtctnccactcgctctnctctcacttcactgctcgtccgtcgctatacgctcttctcgcggtctcggnctggccgtcgccgctctctgcgtactctncancngtctgtcttctactctcttgatgcgctcgccgcgcggtcctctgcgtcgccttgttgcgccgcgncntctcnctctgcgtctctgctgctgttcgtccgccgtcgttgtcnctcgcgcctttcgtcgcgcgtcgttggtcttcctgctccgccgtcgtcgcctcgcctntctgcgncttccgctcctgtgtgcgcngctcctctcctcgttcctgtcgcgcgttcttcggctgctctgctgtntctgtctcggtctgtcgtctcgtcgctcttctgtgtgtgcgtgtngcgcttgtcgcggctgggcggcgtgcgtgctgcgcgntcggtgtgtcgcgctgcggccggcgtttgtcgncggtgccgcgcgtgcgtgtgtctcgttcttgtctcccgtctttctcgtctcgccttcgcttctcgctccgtcgcgtgcgtttctgtctctccggtccgtccncgcgtcctggtttctctgtcgtcgtcgcgtgcgtctctcgtcgctgctcctcgcgcgctctcgtctcgcgtggcgtcctgtgtgtcgtccntctttgtgtcgcgtngctcagaagcaacgcgcggtccctcttctgtctccgcgtcgtgtgtctgcgtgcgnctctggtctcgtcgtcgtctccgtctctcgtcgctctctctgcctgtcgtcgtcnggcctcgtgtgggtcgcgntgcgtgcctccctgcgtcgtcgctcctccgctccgctgcgtgttcctcgccctcccgttcgcctcgccgtctcctgcttgcgtctcttgcctgcctgcgggtcgcgtgcgttctcgtcgtcgtctttcctttcgctctccgtgctctcttgcgttctccccccgcttcccctcctggtccgccgcctcccgccccttcttccctcntttgtgtgtgtggtttctggccccctcntcagcnttttngnttcgtttgtttcttctcttccaggcgtcttttgtgcgtgtttttgtcgttcttgcttcgcgctgtggtgtctctcggtgtcttctgccgcgtctc

SEQ ID NO: 20043 - DNA, 1028 bp, Homo sapiens
tctcttcaccagcacaccaaccgccacttagggaaaacattaatatcctgttacaaaagtctaccttacagggtataactttacattagcagatatactattgcactatggacttcatcgctttatattcgacctgacagttcaagaaaaggagatatatcttaacgcgactcgctggttttgccacattcagcattatccatgcatcatgtcacatcttgtctagtgttgtctctcatccacgaacaaactatatagtaagttccaatacaagctgtccatgccatacagaacgtcctatttaaaatgttctaaaatggataatcggctctcccacccgcggactcatgcgaatccatatacagtcccatctttattcgttggccttacaatgaaccatccacagcctccaccttgggtctcgatcggtctatcttttttattacctcccaactgatgcacagcttactccacaaacacccaatttagcttttcacacgcgcttcctcaccccacttataaatgaacatttggcaccggagcacactaccgcgcgctacgcgctcacacagtagacaatctgtctatcaaaataacaagcgtataaggactacgcccgagccccccacccacacacatttagctagcccacatccagtctaacagaacgccctgcccaacatgacatatcaatcttcgtcctctacgtcgtccgtattcctctcatcatgtacatgtcttatacatcatcctcatgagaagtccacgacgcaccgaataatgactagtcacactccatcgcaatcacacagtctactagcctgttctgtgatagactatgtcgtgtaaacagccccattagtgacccctccgcaacgcctccccacctattacaacacaaactcgctccccgacgccagccctaccctcaataatcatgctgtaccctctgtctcacctaatcacctctctattgctatttacagacttgttaactaatctgttactatctggcccttccttgagat

SEQ ID NO: 20044 - DNA, 124 bp, Homo sapiens
ttttggcgaacatttctgacatgactggggaaaagccgaagaagtcagtctttggggtgtgttttcatctaggaggtggcttgagatggattcatggcaaatcacaataaattatttatcagaa

SEQ ID NO: 20045 - DNA, 225 bp, Homo sapiens
  misc_feature (1)...(225): n = A,T,C or G
gagatcacgcataacgcacccccctcataacccgcccgacaacancctattagtggaccncccaccatgcctggangaggagnaacgnctcaaactcctaggctcaagagatcttcccattctggcctcccaaagagtcaggattacaggcatgagccactgcacctggcccccaacttctcgaataaaatgaaactatgattcttggcctcaaaaaaaaaaaaa

SEQ ID NO: 20046 - DNA, 941 bp, Homo sapiens
  misc_feature (1)...(941): n = A,T,C or G
ggcaacataacaatcacaattcatcataatctaccacaatcccagttagcgaggacaaccacttttgtttatgagaacaccgattcagagttgatttgcacataccgaagcaaattaagtgagatccaagcctccagactctacaacagatgcttccaatatctatgtctaccgaagcacactactctgaaaatcaaaacgggcccttttcaaacccaaccccccccttccctctacctgtaaacaaaacaaaaaatggcctcattgcccccatttggtggacctcttgcggacgctacccccttaactgaggcagaatccacccacccccccatccactcactggcctttatcacgccccgcgccccccaccgcgccccacacgacacccccccctccactccccgctactccgggttaagccccacaaaacactccccatgcaccggcatgccagatccgcccccgccccgcccggcccccgttcctccccctcccttattgtcacccacagctcccctccccaccatcccaccccctactcaattccacccacgtgcgagagttatgtcaccccccggacgcttccctcgccctcaccgtcacagtcngcaccccagcaccgcaccccccccgccctcccgccaccattcccactccctctgccctcccccctccatcgacggacacgctacccaccaaaccccaaacaggcagggctatgatatcggccaaagcaagccatccgcaagtattgtggnccctgagacgtgcccagatacattaccccacaccctcccgccacgcgccaagtatgcgcttcatcagttcctctcattcgtccgcacacccccgccantcccctctccacaagctttcataccacgaacaattgcgatcccgtctacaaagagtccagccgccccatcgcccatcgatgg

SEQ ID NO: 20047 - DNA, 986 bp, Homo sapiens
tatcctctcgcgcacacaaccaacctaccctttaggtgaacccgtaacggaccattacatgtgttcctatctgtgtatctgcccttctacttgggatactatttaataaagaaagtcatcattgtctacgttgaaagcatctgccgtgtagaaacgttatccatgtccggaaagattctcgttcatctctcaaattacttcattgtctaatggacggttctgaaagaaaagcatcccaaatcggcgtaccttgcgcgaaccgtttgacaaccggcaccctgcttctttccacctctccagataacacttactctgaaccccaactcggcgcaaaatcaaaccactcttgtttctctgcacggcgatctgccagtccctgctcttcattgttacgtacgctgattcacatgtctaccacacaagtgtcagtccgaacctagccctttccttcttatccctccaccacgctctaataccccgcccaccccatccacaactttaggatgaccacaccctccaaaactcatctccacgcccaatcttcccccccccctccctccattcctccaccatccagcccgctaacacgtcgcccgctctacatccctctccacggcgttatccccctctcacccaactcagacaaaactgccatgcacgctcctgggtacgtccccatcatccctcaccatcccctcacccatacccaacacctacatctccatcaaacaacccactttcttcacatcactcaccacgccccactcttcactcgtcacgtctcacaccttatcctcctcatacatcaatcaccgccatctccaccacgcaacgatgatctcaatgcccccgctaatatactcttcgcccctccaccagactcctacccgatatattatctccacatataacccagctatctttccgcctaccacatgttccaggtcatctacacctaacacaccacccgtaaaagacttccattg

SEQ ID NO: 20048 - DNA, 1655 bp, Homo sapiens
  misc_feature (1)...(1655): n = A,T,C or G
ctgtgctccggtcgcccgcgcagcgtgcgcactgctgttagtgtgtcgaaagagaggtagatgataagcagagcatagtcatgcgtggantgcatcttcatatacgtgactacgtaatgacgacgagtatgatatcattctgaacaccctagcctcgagtgcgacgacgngcgattgtgtgtagagnttgcgttcgtcagacctacgtctgcgatcacactcangtgacgtcactatgtctgtgaatgagtctatgcgtatttacggcgcgccactgacagtagtgtgtggatgcgtggtggaggcgacgcgtntacacgactgcgagactcacgatagtatagttcgcactacatatagagtcggcggatcgagatcgtatcgtgcgactctcgcgacntgctctacgtnctgttctgtgccgctccacacacacgacgcatatncntcgctctggcgtgttgtcatanngtatattgtgcagatatgtggccgtgtcactacctctcgcttctcgttgtacgtctatctctagcgcgatgtgatcgattagtatatgtgctatcttttcgtctctcattatatcctctgtgttaatctagtcacagtgggatgtgttaggtgcatgattagtaacgctctgtctancctgtccgggtagcnctctatcctcttcgtcaccgtatctcgacgcatacatgacgatcagtattacatacccctctgagctcgcntctgtatcgtttatcattctctcaaaattacatntcttcgcatcattaatactgcagtgtagaggtcgtattgctccaatctccatcgcgcaataagcgccacatactacttgatctactgttgtatgctgttgtgtggtgttgctctatctcgattcacgatgcngcgtctattcgtgatacattatctacttgacttacacngacatcgntagaatgagagctatgagagaacgcnggcgacagttatgtngagtagatacattgtagcacgacatantgttgtcgtagagtgtcgcgagtantagaacgatgataacgttggtacgtagcgacacgcgtngtngcntcatctgtcgcactcttgtgntagtctgncactcgcctattactctacgtactgtagatcgtattngactcagataagtantgagtagagtgactgtgagtcgacntgattagcgtgtgatatgttgatggtaggttcatgtgagtctttactcgcgactagtgatctgtcctacttcgctngcgccgcctcctgctctcggccaccnagtacccaccgtctgcgcgatcgtgctaatctctatagattgtctcancgtctgatagtcatctacacacctatcggtggcgtactcntgtgctcgacgcgcgtccagcctgcgcgaccctactgtcacgctatgattaatatactccggtngccactctcagtctcttatgcgatgtgtaacgatttgctgcacagcgcactcctacatattatctataatatacactaaaccctcagcctggcgaggcgntatgatagtgagcaacggacgtgtaggagtcgtgcggcgtcgcaggtgttgcgagtagcgactgtaggctgacggaacatggcgtagtgctccgacagtgcgttgcagtcgt

SEQ ID NO: 20049 - DNA, 741 bp, Homo sapiens
gctgagatcaaccaatcctatatatccggagacctctccaaatcaggtaaactgtgctgcgcaaagttatcatattccattattactggcagaaatacataataagatacgctttaataaacctcgatacaacaacatcacactcatactccacactataaaacccataccaaatgttcggtataccaccacatcatcccggctccacaaaacataccatcattgcaacaacaacaacatcgaccccccttcatgagagtcccaccagtaagcttgtgcctacttacctcctaaaaccactcctttaatgttttgattctccctccaaggccaaaaaacccgtgttcttcttggccctctttaatacaaaaataacccccatatcttcctactccacggataaggcaggcaacccacttaaggcccagaggattctagatctatccagaataatagtatatttttctctattacatccgggcatgtaaccatcagcaaagtcagcaccaagtagctagcataatctcgcacccttccccttatgaaaattagtcccttctcgagccaaagcttaagtaatacaacgttttctaaaatcagccgttaatgcggcctcatatatcatcttgaccgcatgtccacgatctagctcatccatgcacagttgttaacaccctctgctacacattaatctctcattaaaaaaaaaattcccccttctccataaaaaaaaaaaaaaaa

SEQ ID NO: 20050 - DNA, 1094 bp, Homo sapiens
  misc_feature (1)...(1094): n = A,T,C or G
cgagggaggtgggtgtagactggcgggcgtggggaagacgcgttgggatgtgaacgcgaccgcgtaggagcggggatcgagaggggggcgggggcgcgattgaagaacctgggcccggggtggaatggggggtggagggaggggagatagggaggaggtagtggggtggggggggacgggggtgcaacctagcagtgggtgcgaacgggaagagaaatttggcgggcgggaggacgagaactatgggctgcgctangggtctggtcgaggggcgacttatgtgagtgcaagaatcggcgttgtcgtgtatgtaagaacagggaggaggaaggcggcgtgcggagaagcgactggtaggaatgctaggaaatcgtaaatctacataaggaaagggcgtctgtgggtgatagcgctgggtagacagagtagcggagcgggtggggtctgcggaacggtcnnagcgcatcgagacccatgtanggcgcggggacgcgcgagggtgtactcgtagnggctggtcgaagcctgtctgnngagtaacatctaaaaaaatctgatgggcacacaccacgacncacgtcacgctcgnaacgacaactcctctaccattacaacagtcttctcttacgcttagccttgtgttctttccctctgtgttgctnntattggtaaattgatttacgaaacaagataataatgcgttnaacttcttacctaaaatattatatttntttaaatattatttcttctcactatatataattatttatctatcatctttttaacaacttnatctctcactaanaccattacacactacacctatcttcaaacctcnaccccaacaccatcanntaagattgtacactaataaaatactnaactcatctaccattaaactttttcccctttcaccctatcacaaaacctccataccaaaacccctccacacaacccctcaccataatgntacttcaccctctaaaacttcccttntcctcggtncttctnnctaacntnatttnnctacttcttcatcattcttcctntcctctctcnnncttnnncctntnnnctnnnnncctttttctttt

SEQ ID NO: 20051 - DNA, 941 bp, Homo sapiens
ctataatatacgatcaccacacaaccttagggataccaagacatcgccttaagaaaactgcggacagccagtgtaccagctgcactctgctattggacaagaccaaagacagctattgcttgtacaaaataactattcctgctctagccagccagattcctgcaatccaccctttcacaccgtaaacgctgagcgccttcgcggatcaagcaaagacgtatgcagacgaatacaccctggcgacactgcgaatcctcactgatggaggcgacggcacctcgggtcctgctgctggtgttacaactgcttcccgagcatccgctggcactacagcacctggatcccgtgggtgcactccatatgatgctgacggagacactcggaccacacgtatcgaccctaggccacgttatcgagttaacccctatctagctaaactcgacgtcgcggagacaaaacgttcaattgaagaaggcgccccatactccaccaccgatataatcaaccgtgagtataacgagaccggaacttcagtcgaacgagcggttcgagggtcacatagatgatttcatgaatgaggccggcgccagaacctagttgacatcccaatgctatctcttgatcgtcacacaataaatcagcgtgacttgaggctcgtacgtgtaatagcgcaatgagcccagatattcggtcaaaacataatcgcgagacgaggcgcagtacagcgcgaaaataagaagaacaattttaggcataaacgggcaagccccgcactcaaaacgggggcagaacgtcgaagattacgccgaatctcgagtaggagccgcatgctgcatagccggatggtcatgtcgagcggccggctgagcacgcgcggcaaccttagattgcagcacgcagaattcaattatcgatgactagattttgtgtcgcaccgccag

SEQ ID NO: 20052 - DNA, 190 bp, Homo sapiens
ctttaggggaacatagagcatccagtggagacgtccaacgccggtggcaaatggagacccatcatgtaggcaaaccctggctccagacgaccatgcagagtgccctctactcccaaccaatgacttgtgttgaactgtgacataaaagagaaatacatctttattgtgttaagccacaaaaaaaaaaaaa

SEQ ID NO: 20053 - DNA, 160 bp, Homo sapiens
ctgaagagctgctctgcaggcacattgtgatacgcgttctaaagaagaaaaatacaattaccatcattctttcccaatctcaaagtattagcagcaccaatggagtactttatatctaaaaaaatccgaataaagaactcgaatgttaaaaaaaaaaaaa

SEQ ID NO: 20054 - DNA, 147 bp, Homo sapiens
tcatggcgctcctggatggtagcctcacaggatggaccgactctgtgtccttgaatcattgcatggaagataattggaagttgccaggaacaccagccttggacagttatgcgaacaagaaataaacttctggcctcgttggcctca

SEQ ID NO: 20055 - DNA, 879 bp, Homo sapiens
acgtgtcccttctctgttcaccacgtatcacgaacccaacaacaaagttaagctgtcacgcttcttgagcttttccgggcagagaccagagtcggtttgagttgcatgactgacatcttctggctacagtggatattacaggaagactgaaactccgcaaaagtgtgtttgaaaaaaagaaaagcaccctggaatttggatcattaagtatctgccatttagaatgtgcccacaactgccaaatcaataatagaataaagcaaggggaatccctgagtcttcatggagtaagagccacaccttcttaaggggatcaaggggcaaagtgacttgaagacaatattatcatgataaataaagaaataagggaaagtgtggaaggttttcatctcaatggacatgaaaaagtgtgcattattagagtcgagtgcatttaataagccaggattatctcctagagttgcacagcacgacacagcaagtagagtcggcatttggagacccttttggaaagaagagacaagctctctctaagctatatcactagtcccaactttcctgggctccagccatccctcgcacctcggccttaccaatcattcggattacaggcgtgaagcctttgctccacgctaatatttctattcgccgcgtttggggggactttgaatattacaaataaacccttgggtctctttggccccaggggaggaacttttgcggccgctttccttttatggagggttaatgtataatcctcccttcctgaactccttgcctcggccttactgctgccacaacggtttaatccacttaaacgccggtccctcgtttttccaagaattggggatatcccccaacacacggcttctaaagcct

SEQ ID NO: 20056 - DNA, 125 bp, Homo sapiens
atcactacagactacacttagatcggcagctctgggctctctattctatctatctaacattaacattataaatgcgtcaaattgaccgaacatttgtataggtatacactataaaaaaaaaaaaa

SEQ ID NO: 20057 - DNA, 1608 bp, Homo sapiens
  misc_feature (1)...(1608): n = A,T,C or G
aaaaaannnnnnnnnnnnnaaaccgccgatnccncnanaaccnnaaccccgcanannaanntnccaanccnnnnntcccantactnnctcncnncnncaccncacnnanaaannncnnnacnataccacgctnacccacancacacctcctaaactcaaacananantctgaannnatccagtantcataangagtnccncataacactccagccaattatatcaacattntncgcatcctagtacacactancctancgantcnctgacacccncttggctttgccacccgactccgcctgtagtcacgacgtgcgctgcgatcgtcgtgtagacgcagtagtcggatgagcagcgagtgataaggacgagcgcgactgngagagaggaagtgcaacagtaccgcgcgtgtcagcacacgtccagctgcgcngcngtnactaacaaactaacgataatcacancactcactctccaacacgctccnccaacccacacaccatacanacatacctacnctatcataagtaatacattcgacnacncatccacctccctggtgccactgtgtgcccgcagctcacacggcaaacggaggtagagacgcacacgtcccacgcgtccttctattcagctcactctcacttactcactctcacgacgcgactactcanacaccgtcctacatgtagcatacgacgaaccgntgnagatcaagcgctttagtgtcagaaacctaccgctacacgctgcgccgccgcggccacgctcgcgcaacacaccaccacgcgcactccaatacccacgtctcccgtactcctgccgtagcatcctcgcggcgcggacgtcgtggctgtgatgcgtcgctcgcncagcccgccgnaccttcccaacatctgtcgtgccaccaacacactgttagatcgttatgatatttataaattcataatgtcatgtctatatacctacatatatccacgtacaatttcaccatgattatacatacanatcgngactagtcgtctccatatacntaataacacatgattatctacgtcactatagatcaacgagcattcgttcggtngcgtacatgcctccgactgcaatgacttcgtagcgctggcgatagagtcgtatagagcncncacanattaagaggctggactcgtcgcgcgcgtcgtcgctcagtgntcgagatcggtagctggcgcgcgttcgatgcgacgntcgnangncagatagctattgtgcgcgcagggcacgcgacgcacaacgatcagactcgcggcgctgatacagtatagcagagtcgctgaccgtctcagagcgctgacgtncgcaancgacgcctatnttaacgcgcactacagaacgangagcgngtcgaagtacgtntcagcgtgagntcntgtaacgaatcagatatatccacgacacgcgcgacgcgactcncanagtcgccgtactataggtcgtcgcgtacntcatcgctgcagngntcggtngaacatagactgantgcgactgncgacanatcgtatgtcgcagaagcacatgccaaacactatacacagagtatatatcncancacctantcactntcgg

SEQ ID NO: 20058 - DNA, 967 bp, Homo sapiens
ataccaggtcctcacacgctcggaacgagaagcccctcatctgggacatccccaagaagattatgaaggcaacaaacaggagaagatgctggattaaaagatgtcacctgtggaacataggaaggacatcaccaaacaggatcaggtaactattcgatttatacgtaccgcacgctttgtattcaaaaattatctatacctcagtacacaatcacgcgaaaccaaaaagaaaagaacattattgtagctcacgctaattaactgaatactatactctccctggggggctcataacaaaatcgactgcgcctcaataccactaacacatttaaagatcaccaaaacaactcacctatcccgacgcgtaagtcgcataaccgcttaccgcaccactccaatcgttccgcgacagcaccagccgacgctcccccctatatcacaaatattgtatttcgccactcccccgtcccgtcaccgccgcaccaacaacaaacctaaaaaacacgctctacacacaacaagaatccatcaaaaaagatatggaggaatggaaaacgtacttgtaaccaacactagccgcacatccctccaccaatccgacacctacacccgcccatatgcatcacccaatactcagcattgtcctcactcctcacataaatcgaaacaccacccctacagtccccgcgccgccatcacgcgatcatcactcatcacccctaacctgttacccatactacacaaaagcataatcgagtaatagtaccagtccgaggtacacaatgcacaacaccattgttatacacctactaattatgatagccattcgagagcgacccaactatcccccaactccctatacataccaccgccctccaccccccccccgctacatatcataaccaccacatcctacccccataatgacactcagccctagatagatacataccataaacccatatat

SEQ ID NO: 20059 - DNA, 201 bp, Homo sapiens
gcaccgtgaagcactggagatactggacatagcagatttgtcaagctcatttttcccaccaccagtgcctgagcacgacctcatttgccttggtcaatgaagcccaaggaagcattgcactttggcttacgctttaagttttgtatgtagatatgtatcccatgtcttctaacaataaagtgctggcctcgatggcctcaa

SEQ ID NO: 20060 - DNA, 940 bp, Homo sapiens
tgctcggaacgcaggagtacctttgggatggaaacaagagagctgggtgccatctaaccacgttggcttgttcaaactgctggaaagggtcaattggatccaaacagtttactaatagtatttaagtgacctcgagaagaggtaccaaagaagattttcccaggactgaacaagttccagaaaagactgaagaatagtcacaattctaatggaacaatatatacttaattcttttgtacctagaggggggggtttactcctttagagatagaggagaaataacatgttgccaggatgtcatattgtaaattgaaaattacattatatggagcatcacaatacggcatgtgatatatatctatatgagaaactattcattatgaccttaacgagaggagaactacttaaagggagtgggttctcatggtagggaggagaaatacgatgcgacactttgttgatgagagaaattgcgcttcatgcagacctaggtgccattctacgtgacggctctaggcggaagtattgcgggcaatagcttcggccaagaaaccacctggccttcggtgggctcagccgcggaaagtgtggcgggcgcttgcccttaggagcggggtgcctcatgatgacttggtggtggactccgtggcgtcggggcgggtggcggagggggtgcgaaggcgtctcttggcgggggggttgcggggtaaagcgagtggcgggagacagccgaactaacatgtagacatggggtcgacgccggtgtcgtcgagtcgagggggcgcgctgcgggccgtacgatatcgcgcatggtacagccgaggtaatggagcccatctccgcgcctgcggcgcggcccgtatgcaggtgcggagcgcgccgcgcgccgcgcgcgtagtggcggtgtgcgtgggtccgcgggcttccggtgcgcgctcgt

SEQ ID NO: 20061 - DNA, 998 bp, Homo sapiens
agctccgcccagaacgcgaatgggcggcgcctaagtagtggctatctttaaacgctctaggtacgatgacagtgttccccgataccatgctgtaaggatccggaaagaatagccggagagcggagatgaaaagtatattgataaccttgaaaacaaacagtggatcacgcacgtggaaccaaaatgaaagctactcatagtgggggcctataaacatgagcttcacacggcccaaacgtggtttttccacctcacagagtcgggctgaagttcaagagggcgggtcgctccctgagggactggaccccagaggggagtgcaccccagcgcgagacctacaggctgacgcttgagctatgactgacaggcgcgtgctctcggctcctgcggcgagcgcgtgggaacattcagagcggtagccaattggccctgcgcctggagcgagcgccatagcggccgccattcggatgcgcttacgccgttcacctcgcgcaacgcacattattgtagggaagaacgctccgcgaccatatacacgcgtgcgcgcacgcgtacacacggatagcgcgttcatcggcccctccgcgtgacgagaccagccgccctatcagcggcactccgacagtgaatgacagagatgcagcatcggtgcgcaggggtagtaggatggtactcggtcggagaggatatgatctcatgccagtagtgagagcagggtggcggacccggcgtgctgggtgtagcggttgcgatcgcgttgaccgcgccgcgcccgcgcgactgtgtgtctcgtcgcggccggcgcccgcgtcggcgcgttggggcgtcaggcgcggcgaggggggggtggcggcaatccttagcgtagagaacgagtggatgttgacgtgttgcctaccacgaagccccaggcgacctcgcagaggtaggcgcggatccgcactgcgatgtcgaacgaacgctggcacagctcgcatcgacaggttgattgcgagcgt

SEQ ID NO: 20062 - DNA, 1766 bp, Homo sapiens
  misc_feature (1)...(1766): n = A,T,C or G
attntgtgatngttacattcatcgcgacgcacgtgcacacgnagcgacacctcagtngactcacactaagactatnagaagtcaacgcaatagatgaganagcgggctcggtgangatcgagatgcatgacagaagtacatgcgatgagtactcccacgatgacggtcaggatngatgcgacatcatngtgatcacgncgcatataggcgcgacngcnactgacgcggatgtagtgntcgacgtgaatatganacatgatatacgccatgaggcacacatgcagtatcgctctcactctagtcatcacgctccgatgctaacagngatcgatacangactacgaacgnggacttcnagcgctaatanagcacactatacctnancgtcatatacatgtgagctctcatatgntantctgatnagtgtatctcgctagtgnnttccactaagtgctcgctgctcatgtagcgagcgtgctgatgtgagctgctctgtatatgtctctctattatcntctgcgatgatcgngttactcacgtctgcagtangtncgactanctacngcantgcgtaggttgtgtnacctcagtgacacgcagaggtngtgtacgacttatcgagagagangcggtncacgcgactngacgcncgactggcagtgtactgtatcgctngagtcgncgncgcgntangnacatctgtgagctcgcgctgcgacatctacgcatgtgnntcngactagccactgcgagcgcatgctagctgtcgagagancgtgatcgtctctagctacggcgcaccgntacgtaatactacacgancnatacgcgatgatcatcagacagctgtangactcagttatatactgacatcaccatgaacatagcgcagtatgtgcacggcagatgtganggcatactgtagagtcatgnangcttgcgcagtagagngtgtgacagatagngcattcantantacgncgagatcatcgagatatnctagcgcnacgatgatagctcactgtgctnacgctcagtgcgaactacatatgcggtacagatcgacgctatgatgactcgcagcagnatctcgtctcgcagcgcgcggtatgcgngagtcgcgaagaggctgagcgcatcgcatcgacagtgntctcagagcaggcgagtcgcgcgtggcgtagcacggcgtgcagctgtgggctcaatcagcttatcgcagtgagacacgatgactcatgtctgtgccgtatggtgggggcataagatagantgtgangtatatagtatagggcgattacgacgggcagctcgcgtgagcagcatagtggatgatctncctattaagtacgtcatgtantntacattganagggaatnnagagaaggnacactacatagagcgagctgtgagtgaccgtagatgaggagccgtgttanagtgngtngtggagctagatgcagtcatattacgagcggacaggaggaaatatcgtagactgacagtataatacgatcatttcacataatactagatgacgatgagncagntatacnagtttattattatatggangncgtgngnagagancaccacaccgcagtcatacataccctcactcacatnatcctgctagaccagtatatactgnagnagaatgttgangacgtcgtggtgtatgtgtctgaccaacgatactctatcgacaagatcatctgagagttatagtganactctatcagacacgatatcaaacggatcagaca

SEQ ID NO: 20063 - DNA, 744 bp, Homo sapiens
aaaattcctttggggttaatttaacaagaactttacattgtgttttattgtaaaaatggcagggggtggaattattactttatcattcaacagagactgaatagatatgaaagctgattttttttaattaccatgcttcacaatgttaagttatatggggagcaacagcaaacaggtgccaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgaaaaaaaaaaaaaa

SEQ ID NO: 20064 - DNA, 891 bp, Homo sapiens
  misc_feature (1)...(891): n = A,T,C or G
ccgtctcggggggagggcgggtggtcgctgcgtataggtgggtgacgtctatgcgtggtagggcttggagacatggagaagaaggagggcggggaaggggcggggtgaggaggaggaaggggggggggtggcagggaggagggcgggggcgcggggcggacgccttacagtcggccggcgtgacgggtcgtcgacggggcaacacgcctgcgggggaggctatcggggctcgtgacggccgtaaggtgggcggcgacgagtcgaggaggcgcgggaggggtaagaggggggcctgtctcggggcgcgcggggagtgcccaggggaggactaatatcgtccggcgccgtggggggcgcgcggtgctcggggaggcgcgggggtgcgcggatggcagcgggcgatgggggcgcggggcgggggggggtccttggaggtggcggcggtccatggggcggggggcgggtgccaggagagtgcacgtgggggcggtggtgaggggggttgttcgcgggtgtcgggttcggccgattaggctcaggcggcagaggcaggtggtggtattggggtgtgagggtttattttaaaaaaattatgaataatataaaaacgaaaaaaaaatataaaactctgttattcatatctatttcaggcatcaccttatcacagcgccatctctcggaccgactgaggctcctccgcctttaatctccgctctcaatattctcttcatctttcctctctcaataaaaattccgaatccttccagcacggtatcggggcacggtgtcatccttcaaagagcgtttatagtgtnccacccaaggaattcttttttttttattattcttttctctctctcctctntntttctnnnnnntcctttttctttt

SEQ ID NO: 20065 - DNA, 997 bp, Homo sapiens
  misc_feature (1)...(997): n = A,T,C or G
tgtcgcaggagagagaaaaacattcaggttcactcacagtgttttagaacacttggaagagggtcggctttatcctcctttgaataccattagagatgtgggtctgaaaattgcacaaaacattgtgaaggatgcataccaagaaaagacagacacggataatggctgaaccggacaacaaagaagcgtttgtcctattcccacatgtagttgactgagtatgagcagaggctccctgagtggcatacaccgcctagtcaggggggggaaaatacatactgaacgttgacacggaggagtgttgcctgcatggatggagggcttattgagatttatttcatctcgcgtagggtggtgagggcgggcagcatgagattatggattacgcgaagctgatcattacagacattactgggacaggctctatactgactctgtatattattattcgtcattacgcgcgtagacaatttatttattctctgctttcgcgcggggcgacattatcgtacggaaccgcgatttccgccgtcgtgttgaagcttctcctcgggctcctcgttgtgagcacccgcaccgtatggctaaggtaggttgtgtattccatacgcactaggccttttttctgtcatctgtatcgatgtcctgtctgactcatcggcgtgggatgttcgtattgagtataattatacttgacgtatcatccagcctcggtctcaccactgaccgtctcttagtctattagtcgtacggacgcgacccactcggtgtgtgtctccccgttcggtcacgagcggaaacgagatagcgagtgtccgagcgtactcccccttctcctcgacntcttgcacaccgaaatttgggagtggcgggtgtcggcgttgcgcagggtcatgggtgtatatcgcgatcctctcacgcataagcgatgatgtggatccacatggtttggggtaggcgtccaactcccgacgcgtcgcggggtttgtggcggcgg

SEQ ID NO: 20066 - DNA, 1733 bp, Homo sapiens
  misc_feature (1)...(1733): n = A,T,C or G
ctgcganagtggcgagcgtctcgcgatatagatcatttcgtcgtcncgaacgtgtcatactactactacgntcgtcntgtgtcggtcacgctgcgtatatgacgcaacgcgtcgagtntgcaggattcagcactggatgnctggtgtgngtgtntctagtcttcgacagctcattgngagtgcttatgatgtcgacgacgatatatatgatcatatctaactaccacctcacaacgtcantngtnntatacagtngtacnntagtcgtgctgtgtgngtntnngatgcatatcatacgtcacgtngtcgctactgtacnggngctcgatgncgtctccacgacgtaggtcgntaatttagtgtagatgactactgacacgatntcatnatcatatcngtcgacnagncacacgtaagtcncgacgatantagtgcatgtcagcagcgtcgtcagntatgcactatgatagagatgcatcnaantaccaacatacgatgacanaacgcgctatactagtantgatgagtaaagtgcgncaatctactagttcgtgttgcnanggcgggcgtaggangtcagtattgnatggtncgttccctaatcatctactgctctcatacacacatcatctactgctctccatgaaattcatgcatgttngtctctatntttatantagtcatatcacagccatacntnnagntngtatgctaatcgtatgtcgttcagtttgtcgtcanttnatanggtgcacacgctactactatacttgtagtatgattactatgtgtntcatntgcatgtgcagacgtatatgtgtatcgtcatctagtatattaatagtacgtaagngtttatgctgtagtantgcaacactcatacactctatactctcttgtgttgtgatcgtgtcgtgtatatagtttagatgtggtgtgttgctatgtcatatacatgttttanactaatgacgtgcgcngtctcccatgtatcgtctacgattcangtgtcactcttacacatcgagangacatatatcacatactcntcgctcntatgtctcataccgctatcctntcttctccactcctctactctccaccaccagtntgctgtatatggagattacatntcattgttagttctcttatgtaactctcatcatcttatgtgatagatttggtccactgacatatacgacctntcacacgactgcgacatcacaactttctcacgctcacttaccgtacttgaacatcatacagagaactacactctgtagaanacgactataaacgttctcacatcagtcacatctaaccaacacattaaatcgagggtccccagactcaacgaccgatgtcgacccgatggtatcgcgtgataggttatagtgggtattgtgagagaagatggnatattggatctagaggaagcggcaacagacacagcacacaagtacgcgcctcacacgcaccatctcactacttatgtataacacttcatggaaagtcaagatcaacttcgtgcaagctgtgtgtacaaatgactgaagaaatgctgatgtgttcgttgcacgacttgcaagatatccattgcaatcatgttagcagtgtccactcgacgcttatctggagaggatagtagagtgcattatatcgaaacatccataagtactttcantctcatcanactacttcaaagtcttctggnnccacttaccaacggacta

SEQ ID NO: 20067 - DNA, 895 bp, Homo sapiens
  misc_feature (1)...(895): n = A,T,C or G
gtgtttggtcctcgtgtcttcgctgtgggtggggggggcgtgcgaccgtccggcgtcgcttggtgttgtcccgcttcttttgctcgccgtgttttctgtctccctgttgtttccgtggcctcgctgggcgcgggtgcgggtcgttatcttccctttggtggtggcggtggtgggtgtgtttttctcctctttccgcccgcagtggttgggcgggggtcgcgctgccgcgggggacggcccccggctcgtttttctgtgtggccgggcgcgccccgggtgggcgtgttgcgcgcggcccgcggttgggggcggccgggttgtgccgcggttttctcccggtgtgtggtgtctgtggcctttgggtggggcggcgcgttttctgtccgccggttgcccccgtgtggtttttgccgcggcgtttttgccgtgcttcttgttggggggtgttggcccgggtccgttttttttcgggggggggcgtgttttgggtggggtgtcttgggccggttcggttggggtttttcttttccggtttctgactttgttgggcgggttcctttttcgttggggtgcccttcccgtggggccttttgggtgccctttgccttctggttgtttttggtataagtttgnttttttttgcccccgttttcttttttcgctgttggcggtgcgccggggggcctcttctttttttttccgggcccttttggggggcccccggtttctttttttttgccgtggccccccttggggctttgggggggggggggtgtttgttcaaccgggggggaagggnnnnnnnnnnaattatgtctngccggccaaggcggtggngtgttgtctccaagntttttctcgttgggcgtcggttcgcggggcggtgggcgggccc

SEQ ID NO: 20068 - DNA, 956 bp, Homo sapiens
  misc_feature (1)...(956): n = A,T,C or G
taaantatccactaatctatatatagacttaagaggaacgcttgctctgtcgtccaggacgatcctggctcactgcaacctacaccttccaggttcaagcgattctctcacctcagcctcctgagtagctgggactacaggagcctaccaccacgcttggctaattttcattttttttgctgttgtttttattctgcagagatggggtttcaccatgttgaccaggctggcctaaaacccctgaactcaagcaatctgtctgcctcggtctccaaagagctggtattacaggcgtaagccactagagccaagaccatatgatgctattatttaaatctacttactttggaaatgattacactttttcctagtttgattttcaccgcgtgcattagaaacttcatgctgattattaactggatgcttatttatttttacgctttcgcctaattgtactagtccttacctaacctatttataattacaattttaatttttgtcgcattattttgtaccctattttttataatcaatcaatgtacgctcatgctgcgagagactatctatagtcataccctatctcagcgtctccatgtaaaatatggctacagcctttttactgctccaatcctctccccattcattatttcgattaacccatgattattgctatgctatattcgctttacgctttgctcccttacttgtgccgtctgctctccttcggactcactaacatgtacatctagtcttcgtcctcgccatcctgtgctgtatcttagttatcccttgcgtactgccgaagcccataaacctaaatgcgtccaagtctccctacgatttatcatcttcttcgtctttgttccctcatactaccccgtttcttctgagtcctttgctatctcgtattctatacgtcagccttctggcggtcgctaataccctcactacattgt

SEQ ID NO: 20069 - DNA, 923 bp, Homo sapiens
  misc_feature (1)...(923): n = A,T,C or G
ctcgtgcccgccggcgccggcctctccgcgcggatgcttcccgcggcttccctgcttctgcgccgctcgtcccgcctcggccccgctttcgccctcttttctggcctgctttcttcgcctctcgctcgctgtgtcggtcgggttgctttgtggcgttgctctcctcttcgcctttccgtctcttctttgtccgtcgtggtcttccggctcgtgggccgtggtggtgtcggccggtctgggctgcctcttcggctccctgcgccctctgcgttgtgcgtgccgcctctcggtgcgttctggctcgctgcggcttgcgcgtccgccttttcctgccgcgtgcttgggcgccggggcgtgcttctttcctggtggcggcgtccttctcgccgcctcgcggttctccgttgcgtgtcggccggctctcggctgtgcgtgctgcccggccccccggccgcgctgtgtgcccgtcgggggtgcgtcgggcgcgccctgtcgtctcgtcgcgctgcccgcggcgctctggctgccgggccgcgccttatcgtcccctcccccgcgctctctcgccctcctcgctctccccgccccccgccccctcctcctctctcttctcgtcttctgctctcctccccctttccccgcccgcctcgcgccccccccctaaaatctttttcctttctcttcttccttcctccccccctctcttctcgctccttcctcgttgtctccctcctctctcttctcttgtctccctctttgtcccccgcccttcttctctccccccccccgctcttcccgcgccctccccccccccccgtatccccgcctccccaaaactcttcttcctgtttcttccttcttcccgtcgccgttctcccctaaggccccgctccntgtttcctccaggcttttctttctcttct

SEQ ID NO: 20070 - DNA, 1018 bp, Homo sapiens
  misc_feature (1)...(1018): n = A,T,C or G
ccacagtctaaaaatgatgtaggtcgagcgtccaggggcaccctgttgctcctgttagagatcgttcaggaacacccgacagcattgcttcctcctcctcagcagctcacccaccagtgcgttcagccacagcagccaccatatacaggagctcagactcaagcaggtcagattgacggtcagatgtccccatcatttccacgcccaggcacgggtatggtgcacagcttctcgcctgctccaccctcacatgcctcagaagtataggttttcactcattcaccctgctctcaacccgcacaccgagaccggcgaaacactacagaggtaatcgggcgctccggccagcacctcatttttacaagatactgacatccttgcctttcctggtatagtttcatcaatttggctccgcaagtcccttcgccgacatgcccgcaacgtctatctcgtttactcatatctccctccttacaaatcatcctttatagtatatattagttattgacggtacttagcatgccatctcagtaaacgaactcaccagccgcgaatcgcaacgaaaccacttagtagtcatcatctcgaatggctccaancggttgtccgcactttttcccttctcatcccggcacgctacgtatttgatgcatcagctggtctgtccttcacgccgcagtattacatacccctcacctntgccgtgtgtcatctctccattctggtcaactcgatctcgcggcacgctaacttcaccctctcagcgatcactgtaaagaccaaactcccccaccgatcactaacgtcccaccccatctatctccttcactcccttgctactcccgattccaggccaaactaaaccttagcgccccgatgtctctctttcccaccgctcctgtcgcttatggtcgcccaccttcttattctcactactccggctcgccatccgggcgccacctgtacttcattttttatcccccgctgtaactactgcccgggcacgctcgcgcaagtg

SEQ ID NO: 20071 - DNA, 1680 bp, Homo sapiens
  misc_feature (1)...(1680): n = A,T,C or G
cctcgcagtcancngcgtggatatctactatatcaatgatttgtcatctgntcgatctcntctacacanctcatactctctctctatngactagtgattgtgtantagtagtcgtgctagcangcgagcgcgacacgagcatcgncntggncactatcntcgcntgccgcgtgtaacgcatgactgctgntgactgatgacatcgacgacacgcagtnagtataatcacgctanacagcacacgtcantgtacntacgangtgatatcgtgtaggagggaagtgtgtanggatgcnagacgangaactcgttgtcgttgcgacgctgctgcgaactagnggtatngtcgntcgtgcagacgaacgagnggatnatngagagcgggctagcnatcgantgcatcgacagtgtangagtacgacgcganatgtaagacaggacatcatgggcagctaccagaacgctgacgtancggacctatagcagacgtgagactacgacgagnctnggcngnatcactacgaccagcgatccagagtgatgagatantcacgagcatactcagtntanctcagcgcagcgatcganactgcgcttcaacctgtgcactnctcnatatgatactcgntgtnangatncganacatcgatgtgtgctagacgcgcacacgactactgatgtatagaactntntcacacgcacaaacgatananacaagnagtacactantgcagacacgtcacantcacgtgcgatcgcgcgacacacgtgactgagacgncactacgtctcgtcgtagcgagntattacgtcgtncgactgcgatngaaacgagtatcaatgactggagatacgatacgatgcacgctaacgactacgtgtcgtcgtacaactcaacgtcgcgacacgtacaccantaatctgcgagaatggcacaacacacgcattacatcttagagtcacctactatgcgctcgtagctangtagaggttgtggtatgatacagtgtgtgtatattgtaactgttgttgtatcgcgccgtcgcttacaacgtctctgtatctactacgtatcggatcgtgctcgtagtcacatgatgcgatccttggagagagcgggaagcaggccgaggttgttaggatggcgcgttgagctgacatgaaggttggagaattcatcagagtcgtgcgagcactgagtacggatattaagagtatgatgagtatacgtggtgtgtgtaggtagtgtatgaggagtgtatcttgtctgtcgttgatnattagtagagtcagtagcgaatatcttaaacaccccgtcactatcgttctacatagactcacgcctctanactctaaccacgctatcactacgggcgcttgaccacccgcccgccctgtcctctcgctaggcgatatggtaaccttaattatnaatgtcatacaagcatgaacgcgcgccgggcgttcctggttcccatattacatcttcacgtagcagtgagtacgccacactacctcttaatccttacctgaatttcccacccaccacaattaatcgatcactcnttctaatagtcaaaacgacacatcgtctctcaccctcaatgtgtccacctcctctcgctgatcagaaattcatcaacactcatatacatgatacgaccggtatatgtatataat

SEQ ID NO: 20072 - DNA, 1166 bp, Homo sapiens
  misc_feature (1)...(1166): n = A,T,C or G
ctgagttggtgttggctgtcgtctgttccgctgtgcgtgcgtggttcttccgccgtctctctctcgtggtctcgttgtgttcggtctgttggttcgactctctcctcgtgtcgtgccggtctcctccctcgtgtcgcctcgtcgtcctggctgcttccgctgttcgtgtgtggtgttcgtttctcgttcgtgggttggtcgctctctctctccttcacggctcctgttgttttgtgcgggtccctgctgtctttcttctgtttctcccctgtcgtgcgtccccgtcgggcttggccgccggcggccgcgctcgttgcgtcgtttggtcgtgtcgctcctcttctgaggtccgccgtcctttgcgtgtgcgatcgctcctgcgccgtcttgtgcgtttgtgtcttgcgcggctggtcctcactggtgctctctgtcgtcgttggtgtgccgtactcgcggtgcgccctccttgtactcgtccccggcgccttgtcgctgccttgtctctcgtgtcctgtcgcggttggtctggtcgtgtgcgtgcggcttgctctccttctttgcgctgtngccgctgcgctgtctcttgtcggtctcgtgttcggatgcggttggcgtgtgctgccgtgncgtatggtcgtggctttgtgcgctggtgcgagcgtctcctgttatccctcttctttgcgtggcggtgcctctgttcgctgtcctcgtgcgttctgttcctccngtggtcgcccgggtgtctcgtctccggtgtcccgtcgtgggcgctctccctggtctgcgtngggcggtggttttcgtcgtgtgggttgtgggctcaagagagcattcttttttgcgtgtgccctctttgttctcggtcgtgcttgttctctctcngttgtttccggcggtgcttgcgtcttcgcgcgcgttcgtggtccgtttgcgctctctttttctctgtggcccccgttgcttctctctgttggttgccctgttgtcgcttttctggcgcttttggttgtctgccctctgtcccgcctgcctgctgggtttctcccggtggttggctccggggcggngnngtgcnntggtttcgctcgcctaggcggggtgtggtccctcccaacttttctcttgtgttccggtgttgctccccttggctctgcccgccc

SEQ ID NO: 20073 - DNA, 884 bp, Homo sapiens
  misc_feature (1)...(884): n = A,T,C or G
ctttgcggggcgcgggcgtcgggcggcgggggtaccggcgtcggcggggtggtcggtgggcggcgcgtgggacggggggcgtggcggcgggcttagtcgcttggcgtcatcgcggggagggcggcggggagggtaggtggtgcggcgtcggggggggggcgtggcggcggggcggcgggggcggggggggaggggggggggggcgtgcggctgggtgttttactgggggtgtgtgggcgtgaggcttcgccggccgcaggcgtcgggagcggtaggttgcgtgtgtcggccgggcgggcgggggcgcgcgtcggcgcgttgcgccggttcccccaggaggcggttggggcgcggacagggcgggggccccccggggggcgcgcggctgggctcggtgcatgtggggtggggggggtggggggggtgtggtggggtgggcgggtggggtgcgagcggggggcgcggcgtcgagcggcgccgtgcgcgcccgcggggcgtggtgtctgcctctttcgcgcggaggcgcggcgatatgaatgggcgttgggggggccgcgcggcctctcggcgtgtgtgtgtccacgatatcagaatatcttttgatatactttctttttattattcacncaatcacactgtctctcttacacctctgcccatactttctccactctcccccgtccctcctctccatctctacctccttcatcctcacctcctgtacatgtgtgtctcctgtgtctaaacgcctggttggttaacttctgagtagtagtaagcaattctgtcgggtgttgcttcaacgtncaacgcaggagcntgtgtgccctagtttttttttttattttttcctctctcctcttnnctncnnnnctccccctatt

SEQ ID NO: 20074 - DNA, 978 bp, Homo sapiens
  misc_feature (1)...(978): n = A,T,C or G
ccaccttcttgagaaggtgttngggggggtgctgagagtctaactcctgnagaatgttaagcccctctccagcctcactccactgattgctgcagctgaggaggcaacaaagaacaataactacaaccacactaaccccagcctccttgtgccaagccttctgtgagacaactgcccactccagaaaggacacctgctgaagccctatctacctgtgctagcttattctgctttgctgcagcagtcctcctgaggattttgattttttttataacaagcaaccgcaaaacaaacacacctcgccatcccaagatctaacacatgtcgaatctcataacccccccgcattcaacaattcccttctcgacccacagcaccgctgtgataacgtaccatcaggagattatgtcctgccctctcagaaatcgagactggtcacagatatattgatacgtcctagtagtcagccccagtaatncctcaagatattccccgctcacactctctcctccgtatagtaacacatcacgaagacgttatctcacaagcatcatagctagcgtctcgcgagttttttcagctagccagacaccacaccacctcaccatataacgtatatcacactaacctcaaacccccgcttcgcgtacatttgcaggctcctaccccaccttcctatagactcgggctctacagcgctagtgtctaccgatcgctagcgtcacgagcattcaatattcaccatcattccgatttctattcaccatgtcactaataatacgctcaccgtttcaacatcgccgccatctaaacaacattgtccgccactttcgccacatatttatcggacagtcgcatataacgcgccatcgctacgagatgtgggattgcagtcgagcgggttccctgtcgataatgcgtctgcattatatagacccacctaatatgccgcccgcccccccaccagcaccaccgagc

SEQ ID NO: 20075 - DNA, 1164 bp, Homo sapiens
  misc_feature (1)...(1164): n = A,T,C or G
atataataaattaaactgatcgttatatgtgagagtatgatattgcgtgtattttttaagaggtatgtagatgttgagcgtgtcgagcgatatggtctgtgttataattggtagatgatctctgagttggagataagatgcgagagaggcatcgatagaagagcactgtgtggttgaatctgaacgtctcttgggtgtacatgattggatagataccagattaaattggatatttaagtaacatataatataagtagagatattagggtatagcttaagctattgagctgttattcaagttagggctaatgtaggctcgaggtgcactaccaatgcctacattgtagaagtgagaaggagcaggactgaagatcggctgaatgaggatacgtggcaggataaatgtaattatgtgatgatctccaggaggtgatcgacgtctgtgagatagagaggaagaacgatagttcgatgaagaaattggctcaagcgaagagaataatataataaaaatagtgtttaaggaagagaatatagatagcctaggcggtacagacagtagacatacgcacaaatatataatataagatttttgtggtgttttttgtttcttcatgtctgtgtgtttgctgatcattacgagatcacacgatgtaagaagagcaggtgatgatagtggggagggatgctggagccagagcggagtgcgcagcccgtgcttgtcctgtgtcgctagctcgtcgttagggaggatttattcatgtcctttgagttagtgatttgttgtgtgttaagtgatggaaatcggtatcgggtttgtctatatttttacgtatactacgatacgaaaaggtcacgagagcagtgtgtggggtaagagggaggatggagtgatgattgagatggtgtgttgctgtatggtgggaggagtatagtagagatacatgtttagtggattttgttggttgtgattatgtacgttatgtgttaatgtagcacgtatggaacaaagaatctcttcttgatctattaataaagacaataacatatcngcactgcatttttggttgtgtagggagatatggagaagtagtggtgagatcgataataggaaaattaattgtagtctataaatattgttgttgttactgcttgatagaaatt

SEQ ID NO: 20076 - DNA, 1674 bp, Homo sapiens
  misc_feature (1)...(1674): n = A,T,C or G
cgcgcgacgcactcgaccccagacgtcatgagtaacgcgattactatcaggacgagtgtagcagtacgcgtngatcacgcggagtagacatctgtcgtaacgcgcagtaggtgcgtcgcgcgntatagcgtgtcctcgctagttgtcgtagtcangtgcgccaaatcgtcnactcagtctgtgacgtcgctagatgacnttgtctntctacgtaagcatatatctacactacacacggtagccacgtcgtcagtactctctgcgcgcatacgcagcactatactagtcgagcgtcacancngacgnggcgagnctgcactctcgcacgtgatgtgtcgacancagagagtnacttgagtgaagtccgtacgaggngcgacacgcatctctcanacatcagctcacgcnagagtncgttgcgactcgagtgtactgacagcgatgcatgagcaacgcgcactgatatcgccactcgcgactccactgactgtacacagcgcggctcacaacgcgcggacagcgctctcgcgcgactgacacaccgaatctgacaagctgtactagctcgcaagaccgcgngactccgctgcagcgtatgaaacaagacatagatgatcagcacgctagtcgagtcacgatatacgctgngagtccacgaagcgacgcaccgcacgactagtaaatagtaatatgcacgtagtcggtgtcttctcgtactcactcaccgcctctactactacacncacggagcatcttgccccgacatgtcatcagtacatgccagattactacgcaagcgtcagcgcgcgagtcggccgacgcatacacacaccccgcacgcaactgtagantactcctagcgagacggaggacgatgaggtgtactccatnaacatatcgaccagagcggcgcggacaagaaggagagtaggaaactactgagctatactcgcgcgcgaacgncgatgcgtacatcgacatcggcgcatggcacgtcgacacactgtaatctataggtgtatatcataacgcaccgctacgaggaacggcgcagtagtagtatatagaaatgttgtagtatacacatgacattcgtaaagagtaatgatacgtagttaacgaaaggtcgtcgatgtacttgantgctgagtaggtgacgacgtcacgaggcgacgcctgtattcgctattacgtaatgcataactgatgcgagagataataggcagtggtgtgggagataattatgtatgagacgataattataataacatacatcagccagagatatagccgagacagtccagctgactggtggattgcgagacacgacatgtgaacagattgcgtatattatacgtagacttactgttacttggtgcggttgtacagaagagatctcncgcggcgcggcggccacgtcacagcatcgcgcgtagtcgcatnatgctgcgtctcgccgcgagagcacgatctccgtgtcagacccatcatagtcncagtaatcgtcgtcnatacacgtcngcggtncgacatagcgaagacgcatgcgtcattcacgtcactctcactatcactacaacataaccaattaactatacnaaactacnagaaggctatatacacaccggttgcttagctcgtcgcgtgagcgcggcagcgcgcgcagtcacgccg

SEQ ID NO: 20077 - DNA, 1096 bp, Homo sapiens
  misc_feature (1)...(1096): n = A,T,C or G
cgtcgttctcgtttgtgtcggtcctctacggtctcgacagtttgttctttgtgtgtattctctccgtcaggtccctcgtctnctgcgcctgtgtgtgcctgtgctgcgcgtacgtgtcgtggtgtctgtcatctccttcgcttcgtcacgcttgggtgtgttcgcgtcgggtgtggctctgcgaggcgattggcggtcgtgtcctggtccgcccggccccctcgtggcgctcgcgatgggcgctctcgcgtccttcttcgcgcctttgtgtcatgcccttgccgccttgctctctgtgctgttttcacgtgtcctgcgcgtgcgtgtgttctgtggtcggcgcgggcgggccagagggtgcgagganaccgcgtcgcccggcggcgtcttgcgtacgcgcgcgttcttctcgtcgcgtgtctatctgtatatgtgtgggcggtgtggggtgggcgtgtgtgcgcgtttggttcggtcggggcgcgtgcgcgtgtgttcggctttgtgcgcgtgggcgggttcgctatgttgtgggcgcgcggtgcgtgcgtggggagcgtgtgggttggcgctcgcggcgtgtgtgggcggtctggctctgtgtcttttggcgggcgtgtagtgctggctggggtgtggtgtgggacgtctcgccgccgttggtctttcttttgtcgtccttctgnggttnttgggcttcgtgtcgggggtgtgttgcctccgttgttgtatgattttatttattaaaaataataaaataattttttaataactttattgttatgttttttttaatttttatattgtacttggtctccactttttcttttcttcctcttgtcccgtcgtccatcttcgggtccttcgtcgcctcttcgctccttcttatcctccgttcttcaaggcggcgccgggtttaattgtgtgttattaatatatagatatttagaattcctcctttatcttcattctttctagtggagtgtagggtggatttgggtgcaaggctattctncagggtattccattcaggntttttttttatttctattttttttttttccacttntatnttttttctctnctttcttctttc

SEQ ID NO: 20078 - DNA, 929 bp, Homo sapiens
acccaaactccaagtaataattaatttcccgtgcctttaggtactcccagagagtcaatgcaaagcagcccacgttatctacaaataaatgaaatactattaatcagtgatcaagaatttctcccatgccacataatggatcagcattggaagttttgtgtagaatgcgaggaactatcaccctaaatccttggttctctaccatcttattgcatattggtcaacaaaccgctcacacttcatatctaaccatttctactctctctgtccctcttttcacccaacactctattaaccacatattatgcaacctgtctaccctcccgcacacactgatccgtacacaacacttcgctgccgtgctctgttattttaccccttattgactcttccatttctcctcctccccgtatccacctcagctcccttcttgccctcctttacttaactccctcataaaccactcgcatatacacattttgatactcccatgtcccacgactgcatccgcacaattctcagtcgctaaattattaccctcaatcgctccgtatcctttacttaatactccactatccacccaactcgtactctccctcacatcgtccaatcctcaatcatattattccctccccctctatctacagttcgtgcctgtttcgtcttccctcctttcttctcttcttcccctcttcacttacttcattattttctacctccattcccatttcctcgctgcacacatactaagtcctctaatatttctcatttgcccaatttattaattagcaccgccattcataataaccctgcacagccccgctcattaaaccccccacacatttattgctttcccatcccatagtccgatatgatgacctagctatttcattaacccaatatactctttccctaatcgctgcatattt

SEQ ID NO: 20079 - DNA, 792 bp, Homo sapiens
cttgctctaacaaggaagaggtgggagatctgagtcctggccccagcacccacttcaacttcagtcacctccttggaatctggggttctgcagcttgaaataatcagtttggatttctaaacttatcccgaacataatactactcctaggaactttaaaacaatattttcgactaaatcctacaattattataataagcgacctaataaaacagtctcttcctgaaaaacaaaaaaaaaatggcctttgttggtctgaccgggggagactattgcccccgctatacatgcagtgagggtgcactcctgaaccccgccaattgacttgccgtgtctccttccaccgttgagacgagcagtctagctacatcctacgccgccctaatcccatttttccaattccagggccacccgacgccccactgcggatacccaaggtccggcctgtctctgacctgctgcgccgcccgcgaccacctatgtcctgtaactctcactccccaatatctttaccatctcacgaacgtactaagaagcaccacgccccacactccaacacaaaccctttccgccgcttgcaccgctcttacacgatcccagatgaaaaatccgcacgccccccacacatactatactaccgctccattttatccactctcctgcttccggctgatcactcaatagcatgtccgagccgtcgtcacccccggtacacctaacgatacactgatcttcacccagacccctcctcctgctgcgcttcccagacgcgccagagtaaacataacggcct

SEQ ID NO: 20080 - DNA, 977 bp, Homo sapiens
tttgactgtgcactcgttcaaccaatcacgccttgaggatagccaatcctatctataggccagagactggatcatgttgttgcaaagaagtctgtcccccatttctcagatgaggataaggatccacagtcaagagaagatgctagacgaaaacccacattacctgttaggcctcaccatggcttatgtgcacctgtaaatggagcccctgcgaatgacagtatgttacctaccctccatcatcatggatacaaacgcagatgtaccgtcgatagcggccttgtccttcataccggaccgatttcgccttctctgctatccctagaataacgagctttcacgatactagcggcccgagcaacggcaatcccgcccgacccccacaactaacccacgccaatgatcaccaactcacacaccttgcctactcaaaccgtccccaatactcctccctctctcacacctcgcacactccccgtcgccttatctttccccacatgcctcgcacacgagttcccttctactctcaactatactgacgctctacccgctcatgcgccatcccacacctctaccgcaccacacctcctctcaacgaccaccccctcacacctctatgctcctgatctcctcgcaacccaccaccacactaccctctctcactattatattatcactgtcatcctccgcagacacaccccgacctccctccctattcatccctctcctaaccgctcctccgcaccccacgctcacctcccccccttgtccgcgtactattccagccctataacccatctcatcaagtatcaccccaccacctcgccccccgccagcgcaccaccgttactcgaatacgcccccgctcttcccccgcctccacgacatccccaccctatattatccccactccttccccccgtcacgtcctccatccacttctaaacctcccccccgccatagatgcgaccgtatcg

SEQ ID NO: 20081 - DNA, 1854 bp, Homo sapiens
  misc_feature (1)...(1854): n = A,T,C or G
ctcagatgtgattgatcacataatcatcatgtctccagtgtaagctcacgcgctacagtacgctgcacgcgacgcagcactctcaatgctcatctactccgttagctgatcaatacacattcttgcagtgtatatgatattacatgtcactgaggtgcactcggcgagctcagtcggagctagcattgtggactcgtacctatagtggttctcgatgttcatctctcctctgtggtagcgcgtgtgtgtgtgcgtgagagtgtgcgtctcgctgtgagacgcgcgtagtcgcagacagcacgtcgagtnggantggcgcggttgatgcgactcggtgnattcagagtgctatgagttgtactcctactntgattacactcttcgcatattgcgatcatcatgtgagagcagtcgttctncaccttcgattcgncgtatctttctatagtatatattataatgagtacancgctctangacgaaatgtcaccatctgtagntctntcgnagagccgtccactgagagaanngtngcgtgctctgagcgtagactntcgattntnatntctcatcgacgtcgatttagtgagtngcgntagcgtgctggctngtncgtgagtagagtcgttgcgttctaccgtgtgagcgtcgcaccgatttgagactccgtgtctgcgagtcagagcatgacatgagttagagtggctagagccagatgctgtcgagtagcactgatcgcatatagatntcgacgtctcgacacancgctagatcagctgtctctacaggattgtctgtatgtngtgtgtagtcgctgtntctntcgctcagtactgtgtcggtcatgctcgcntacacgtgatcgcacgctcgnctctcgtctgagtgctcgatctgcagcgcgtgtcgctctattatcgatgccgcgtatcgctgacaagtgatctgtactgtagtgatgtncgctantacaatgagcgtggtccgtactcatataanagacgtctacgttgagagagcggtagactgcatataagcagcgacgagatgagacaacgtnangngncntnacgacacgatgcgatgtacgtgtgtacgntacgactcgaagacgatagacgtactgcgtcantgttgatagagcaggtactctgagnagtgtgantaggaggtcagtgtagatgacagctcacactgtagnaggtagtagtgagtagtcatataaatgtagacgtatcncagagatgctatgcgacttgtagacctcttcatgangngacgtgctcgctcgtctgagcatacgtagtctntagcgctgctacactcgtagagcatactctntcantagtacatnccagactttatgtgnntnatgtganaaaantgtcgatatatctnggcattgacnctgtcagcatacgantcactacgtctctcgtcagtntgcggtactgcntatactantcgcatntggacgngttgatatantnctgtacgcttgtgcgttacgacgtnccanggtnacttgtatatctangngtcantnagcatgtcantgcgtangngtgtgcagtagtaggaatngttaacagacgcngtgagcgcactgtgcgtatgtgtganctatcgcgtaccactatngtgataggncagagatgcgccgtaccgtatagccgtagtctgtcatcagccgttcgangtagcactctccagtagacacgtcaccacgatcacaggacgcaggcggngcaaagcagagactgcgcgctctcgctactgcnatagtccgtctgcgtccgctngttgngcatccgtcgntcntctatcgttgcgcctagtctcatctggtaacac

SEQ ID NO: 20082 - DNA, 1702 bp, Homo sapiens
  misc_feature (1)...(1702): n = A,T,C or G
cacgtcagacgcgacgacacactatgcgaaagaatcgacgcccgcgggcgcagtactccgtagagtgtatatagtcgacttatggttctctgtgggctgtgcntgcagtctcgtgcacgtgacaactatttatcgtgcgcggcccttgtcgacgtcacatcatagannnacacagactcaganatgtgagtactnaaacagaaacacagacgagtcgcgagacaccacactagagcagagctcacgcacccgcgctcgcggngacncgttctactacatacagacgcctttcactatgctacagcacagtcacctacaccacaatctctgttatctatctntcatcaacacacccactgcctctcgactcgagttcaccgtggagatagacacgaaacagcacataagtgaccactctactatagagagaacgtaacttataatntatcaggcgatcgcgatactcgggatacatgtataaaagtacccagccacactcacgtcactcatacgcgctagagactgccctgagcatcaagctagacgtcgcagtatactctgctagtggctaccagcgccaaccgtccacacatagacactagtgaaactacgcatagacggtcgcctatacgagttatataagtnacngacacgcgcgagtcgactaaggtggcgtgcggctcgcgcagcgtctngnaatgacgcgatgangatgcaancagagacgcagtcccacgtagcacggatacgtgcgtgagcacctctactgagcgtcctcgtncgcgcgcacaggcgctcncatactacatntaacatcactgctctagtcatcatanacactgcaacacagacagncactggcagtacacgtcgatcagagcgnttgngcctcgcacggagagtcactactgttctatcgtggacgcatttngtcaataagcggtgtcgcgtgactgagacttcgcatagnnngngactcgctcgcgagtgtctgcttacgcgcagcnttctgtgtancactgncaccctactgncganantatactatagcatgcgccacgcgcagtgtgctagcgtngtgctgacgacgacatcgataggnagngtagatgacacgtacgcacgcgagcgtngagcgctgcgcctatagcagacggtctgatgagagtaacagnantccacncgtagcgtctcaccagagtcatacttctgtacgacacgaaacatcagtgcagcgatntatacatgtactcagacagacgcacactagatngcgncgcgcgtagtcgtgcatctctactgatcatnctcgcattgtgctgnacagacagacaganncngncgttcgactcatctgctatacactgtgtagggntgacgctatgacgcacatcagctantgcangctctcttgcncacatctatgcacncntctgtcacgtcgtatatnagcagtctacttaacataatgtganaatagtcgatgangtcagatctggtgtcatatagacataacataaatacacagagatcagagtgaggctgctgncagtatgtgcacnataacnaagccagagatagtggagtntcagtataatctgtgacgcgtaacgccatcgntcgctcgtctatgctctcgctgcacctnactctcagactcacgaganaatgacagatacgagagaactatgatacagatgtc

SEQ ID NO: 20083 - DNA, 1655 bp, Homo sapiens
  misc_feature (1)...(1655): n = A,T,C or G
catcgacgccatctcgcttctgacatatcgcgcgcggcgtgcacgatctctacacggctcagcgtctatcacatncnctaccatcancacaacgacaccaggcgcgtagcaagggtacttgacttatagactgacacgaggacacgtcggatgcacgcgntgccaagtggttagacgagttgtggtctgacgggnnagcgccaccggaagcgactacgcngcacgctctagctgccgatgtangcgcagcgtagcgcgtgagcatgcacccagtangangtcgtgaacgctactntcgcatgcgcgtggaagagatgcgcactacttagttgagagctaagatcggcggctgcacgcgcgcgtgtngnacgctcacactacgtcgatacgatctgagcgnatctggcagacacactcgtgctnggngnttcactgctatggtncgatantacgacaatacananacacgtctcacttcacaccacgagactcacatncacncanccgcacgctcggccacgtgctactccacactgcgacgcgcgngangngacgccgctactagtctctcacatacgtagnncacacacacaaatcggtgtagtagtgatngaccacgcagacacgacnagactntcanttcgcacgctctagncnactacgcgcgcgctcactccacctctacatcaacannntantancccatgaacacttacgcgagacngtcactcgcgtgcgtcctcctctgtgnccgcccgtcttcgtcgtcttgangacgagtngatcaagtggcgcgcatgagagagggactagggcgantctccgcagcggcgnggactctagccactncccngngacgcgtcanagccgacgcatacacctgctgaccaatatnaagtctaanangacgacgcaccgcnctcgagtgccactgcatctcagcactacacnctaatccactagnanacatactacactactaacctcaccataatactagtacntaaccatacttcgggacganaacatctacaacacaccgctcaacacactgcgcgcgtnaccacaccacttnnaannnccacactactctacatcacaaactanacaactanaccacantacacaataacacacactatacaananacacaaacaacaatcacacataacaaaacacaccncacnctctaatnacccttctacaccatactcactcaaatcctgantnctattatntcactcttgnccctgcanttnacacttcagacctcatcgtctatcatagtnnctctatctanctctattacactatatgaactntatagaatnncacccgtncactcgtctcgcacccatctctcnntctctnncntcttctctacttctctctctctctcnnnccctcccctnccctctcctctccatccttnctccctctccctnnnnnnctcattctnctcttctcttnnnnncctctttcataancttcttnnnntnnnnnctccctcctctctntnnnnnnnnnnnnnnnccctnnnncnccnnncctctntntnnnnnnnnnnnnnnnnnnntnnncnnttttttccnnncnncctntctctctccctnccccttnnnntncctttcctnnntcccttccccccttttcc

SEQ ID NO: 20084 - DNA, 899 bp, Homo sapiens
cttatgtaatatttgatcgccgtagtgactctttcagctgactccacctcagttttagggcagcgccctgaacgcatccgctaccatggcagaggtcgctttgggatcatggagaaggcttattgccattattttgtgaagttggtggaagggcccccaccttcacctgagccaccaaggacggcagctgcccatgccaaagaggatatttagcagcttctcagccggacccatccttcacactctatgatgaggagatccatactccacagtgtgtatattttgccattcattttctaaaaatcagacctaaattcacggtcgataacccaacacaaatgctctcattagccctcatctccgtcctccttctccccctttcctttggcgcgggatatttctagatcgctcttaccatgacctatgtattagataaatcacctctcgccccgctgtatacattccctctccgcctctttttcctattcttcttaacctcgtgttaatctatataactctccccaccctttcctcctctcaagttcctctcctcccacagcgcccctttctttctgatttagactccgccacccacctatgacagttccgatcccgtctagtctcgtccatgctttcctcccgctgcagttcagcactcaccttccctctacttttccttttctctatattccccctcaaacctgcacatacatccttctccgatcttcgtatctacgtcgctcctcattatccgccagtttgtagcttcgttgtagctgttacttcatatcccccgtccaaacacatcaattctgcatgccccgcctatccgtattttctccgctccaacatgactatacttctatctctcctgcgcccccctctcccacattctcatt

SEQ ID NO: 20085 - DNA, 1228 bp, Homo sapiens
  misc_feature (1)...(1228): n = A,T,C or G
cgagtgttcgatgctgatggagggtgcagtgggcgtgtgtgtcgnnagagttatgcgtgggtgtaaggaagaagcgtgtgtagtgatacttgataagttatttgtgggggactgcggggaggggagcgcgaggcgcgatgagtgtagtctactccgtctatggctgctctacgcgtatcgctatataacagaggagggagagagttgttgttgggcgtgtgctgttagtgggtgcgaaaggtcgcagaaggggcttctatgagagtggcgcgtgacgatnggggagtacggcgctagcgcggtgagtatgggttcgggagatgaagtcggtgtgaaagaatgcggatatgaatagtagagttcgcggtatttacgtctggaataggctagttggtgcgatcggggggcggtgggagggtaggaggtggaggtctactgtatgaaagaagtgcggagagtgagcggaggagatgtatcagggcgctcgcgtacaaagagatgatacagcagcagtgtgagagggctgagtgctcggggccttgagggtcgctctgtcgtggggctgtgctggacgggagggtggagtccggaatggtcgcttgcatgcggagacaagacagagaggaggagagggaggggcgggtgtagtaggggaagaggggtgggatcgaggagggatgaggagggggcattgatgcgtctctagtatgagtagagagcaaagtatcacaggacacagcgcgctaatgaatacactagagcaaagaatatgggggctnggattcgatgatgtttgtgcgatgtcttttggacntncnaanncacctcgccgccatatttccaatatgccttgatctgtgtaatctctgtcaacgcactaatctctcttacctcatttctacacatnatggtactnnctttgccgctacactttccttgtggggaagtgggaactctcaatgggtcagcgtnacgttgggtggtgaggctggggtgtgaacatagggggtgttggtcggggttgtctccactattgttntnaatgtctttgtattntgttgattgntcggagntccttgtnctagtgttttncattaatgggttnnnactttaactttnnnnntgttttgtttnnnnnnnnnnnntttnnnatnnattnnnntttnnnnnnnnnnnttttttttntatncttaatatnnctttnnnctttactnatcttattatttca

SEQ ID NO: 20086 - DNA, 1314 bp, Homo sapiens
  misc_feature (1)...(1314): n = A,T,C or G
agtatanatgagatgagatatcgtctcgcgatgcctgatagtcttagagcggagtangcgtaganggcgttgtgcgccgcgcagtgtgacgtcatcactgtacagatgactactgccatgtnttcgactgcatccagcagcgcatgcngccgccatcgctgctcanctcgtgcattcgatacacactgcgtgcgcgtaggacggtgtcgctgtncgcagtatgtcagagctcgtcgcgagtcattgcatangtgccgtcactcacgatgcgtacgtgataggagtaattgtgtgaagtgtggcaacacacgcgcacgacactcgctcagcagtgcgtggtatctgtgtcgcgtgttcgtaattatatgtagtaggtgagaggacggatcacgctcatactgtgactagattattacaaaatgataattttccgtgcgtcgcgcntccatctagcatcagaccactcntcatagtcggcgcgcgtatgcagaacgcgctcgcgtgtatatgtgagtgatacggcggactgcgcgcttgacgcggcttctcgtcagtttgtctcgttcgtgtgagtcgcttgactcgatccgagctgagtacgtgtattcgcgtccggcgctcgtacaactcatcatcgctacaccttcattccgtaggcggttaggtgtcagcggccgtccgcgagggcgtcgtgcgtgtggcggggcgggtagtcataaacgacacgtgaatcacacggctgtccatgcctcatatgcatgtagtgaacattattcacttacacagatttattatatctttaccatctagtcatatagatgagcatacacggagtattaaagatccgggttaaagtcttatttactagttccgatgccgtctgacgcaccgggagggcatgtatagccatttctccgttaccttcttctgccttcatgttgtacggatcactgctgtgtggattgtgtatggagttcatagagacgtatggaatgtgataacctgtgactaatactatttctgagaagccatttttatgttngtgtctttctcctccgctatcacttatcacttagaataatccaagctcctgagttcaagtggctctttgtgggaggtagtctcgaaggcttggggggttggtttggttgtgttggtgtgggtggtgtggggagtatgagggcggatctaacgacatttgactgtgacctacgggacccgacccagcggtcggtgtgcggcagcagggagttgggtcagccgctagtgtccttttgttcttcatataaacccgtaggcccttagctcgctata

SEQ ID NO: 20087 - DNA, 893 bp, Homo sapiens
gttaccaaacgatcacaaaaccacaataaccctgacaggcaacaagtgaacataagtaaccactcgaaaccggtgtctggcgctgggaccgtggtggctgggattgcagcagtcgtgctgtccatctgctcttccgaggggaggcacatcctagcctctatcttttccccagagaagatccccactaggctgctccttccccgcctcacctcttttaatagcgagaacagtcactggagctactctcacaacgctctctggtaccgcctttatcatcacgtacttgctacacacctcaactctaccaggggaactcaccaatcacggataacctaatctaccaacccccacccccttctagctcctcgcacaatgatgacagatcctcgtctctctacgaactactaaatttacttaaatccgacccccccctcacaccacccatctatcactcatgctcattaaataaactcccctacccatcgctatactaagaacccacccctctacccagtcactctctcacccctagtactccaaatcactccaccgcatccggacacaaaagccgccccacgttcagcggtctaccatacacctgctacctatcaccgcccactatacccccccacacaccatctgcgtcatcaccccatatgcctctcggaccgcctataaccatccccacctacacccatatcccctaaactcccacccacaccatacccacatattccccaaccccacaccccagcccaacaaaaattaccacccaccccctaatcattaatcctactatcacagaacaaatctgtaaataaaccagccttcatcaaaccccgagaaatccatagtccccgcataatttctcacccctcaaaccccaccacaag

SEQ ID NO: 20088 - DNA, 597 bp, Homo sapiens
  misc_feature (1)...(597): n = A,T,C or G
ggcggtcggcccccncggggcggttcagtgacaaacaaagtttttcaggatgagtacttgctgcaggtcgcacagttatgactggattggaacttcatccggggtggggggggcttcagagaactttcattcaacttatatagattccatatgaaatgggaatgcaagaaggcatacatatttctggttgattcaatttcctgataattcccaattacgataaaaggagtggggtggtaaggactcacatgtttgagagggggggggggatataatatatgagcctgggatgaaaattgataataaaagagtgttgatgaagcgtaaattaaagaatatgtttctggcgttcttttcctaaaaaaaaaggagccggtcccagaccaggcttggtaaggagggcctattccgatgggttttatgattgggacaggggcaaggccctgtgaacggggggaaggtggaaccgctgtgggggttctgcttttccagggacaaagccacatgcctgaatgaggggcgtggcggtgtagccccgggcgctgtcaccactggggggtcggggaagaagaaaaagagggcgccggggcgggccag

SEQ ID NO: 20089 - DNA, 916 bp, Homo sapiens
tcctatcggagcgtacacaaagacgcggcaacagaacacaaaggggctgggaggcacagaggatcaaacttcagcacaagctggcctgtcttcaaaagcactgaacaaaaatatctaaccttgaatacagagtcaacaagaataatgacgaaactgcgtgctcaacaatgataattctgggcatgattttttccaaaagtcttggaactgcccccgaaatcccgttgaaataaccgtgggatcggaccagccgctcttatcaaccgtactcttaaccggcctgttctggaaaaacaaattcatccacactcctcttattgatcataagcgccccacggccccacgatcattcacagagcctttaataacttccaccgccccttacacccgcagctaaaccccttgccggtgaaagcgcagtccctactcatgccccttctcatcaacacactcgatccaatacccaacaacggcccgtaatgcctaggcgattcacaaactgcaaaccaccccttgcacttccctaaaaaagccagctgatatagttcgggctcagtataaggcaacaatggaggacgcatcgtgaaccggtgtgtggcccggtagcagttgaactctcacccgctttacccttcctccacaccatattggtcgctgccaaatcgtttagcagcgtggcggctccgccacgcacaacataaccacgccagaactcgatcccgcagcgatataggaaaacagccacaaatagccgctcgctcctgcgatacatacgacaaaccaccataatgccctccgagcgccgcgtatctagagtaggacaggacgcccgcgtaaccgcaccgctacactataatatacactcctcatattataccctctcgccccccccactgcaacgaaaagttcaacgtat

SEQ ID NO: 20090 - DNA, 1011 bp, Homo sapiens
  misc_feature (1)...(1011): n = A,T,C or G
aattccatccgttagtacacacacatacaaggaacntagacgcagaccctacaatgaaaagcggcagcatgaaacagttaaactatatgacacacttgatcgaatatgacagacactgaaaatcacgattcatacccctccagcacctctacctgttgtccgtcgatcacagacggaatgcacatcgaaagattacctggggtcatgcttcaactgcccactagcggactatgtagactctaaattcgtatgaaggattcgactgtgaagcatagaatacatggcagcgaatgtgaaatacctaaattgcacaagtacctcatttctatatataagccataccgtttcccttgctatttatcttgataggtactcatgatttacaccgccgtaataatacaattagtagctatctaggttaaataaaattatccaaaagatcactcattatgtcatactacacatacatttcactttcagcgcaagaaaaagtcacaccacaatgatttccaactttgttatcgtatattaaatcaaaatcctcatatgccgcatactaagtatagctccattcgacttatactgtacaaccatcgattatcataatacctcataattaatgtcatagataatgctatgttatagtaacactacatattagagagtcatacactctctactatgcgacattaacctcccaccttccatttataatacacacatatattatattctctatcataccattgaccaccaccatccagaaaagacgctaccaaaccgcagatacctgattaagaaattactatgaagtatagactatttattagaaaaccacactagtgcggaaagacgtgatcaatttccacaacatgtccctctccacgctttgtaccattatacaacctatatcgaacctctcatatacacccaccatcgtagatcctatatttatcctacatatattctccgcaacgccccaccacaaacaaaatcatattatatttatta

SEQ ID NO: 20091 - DNA, 1764 bp, Homo sapiens
  misc_feature (1)...(1764): n = A,T,C or G
aaagggaaaaagnaaaacgaactaaaannaaanaagatagggtnngagagntcagctgtnngacgagtaagaatgcaaacgagtcgagagcanagaaganagacagcagtcttcaccggangagagnagcccagcatcagagnnagcacggggttgccggagacgcgaggagcatacgacgcacacnncccnccatctccacgtgtcaacacgcagcgcacgtcgagtacaaccntcgatgtttcggtgcgaccgcagcgaagacgcgcgtgctagcgactangacgcgcgcggatanactacttccacactccatctcatactacgccaccatacancagcgaccaccgcagtcggtcnctcgcactctctgcgcaatatanatagatgngtgatatggtcagtgtgtatgtgtagcattaggtcgnaacatgatagctagncacgagacgcgcagcgtctgcgacgtgcaacctcgcagatagtatatcgtccgnccatgccatcgtgcgatcgcgcactctcgtcatcatcggcngcgcagttcgcgctgactactcgcaacccaccacacgcgcggcgcgcgccagcgcggancgctgccacactccgttcgacntcctcattctgtgcctatgagtatacgcgattgntgcaggtacanatgaatgcagctccttttcagctcatagtgatattgtgacataccacaacacagtcggatgtagttgtttantatattgtacnananaatacacgcncacatttcgatactcaananagcagcgtcacgagatatgngcgaagagagatgggccgtcgcgcncgcantagtccacgacaccacaccacacacgcactgtgccgcgagagcacagcnacacgcagcgtccccagccatcgccatcgtatcacgctcagcatgccgcgcctcgcagaatgcgaggcgatcgcattctcgntnctcttatgacgtctctactacgctctattaatcacacacttacntcgctacgactgactctgaactcatacatgtacgntgacgcngagcntgtccgatgctactattctngtcgagcagagagacgcgtagtaacgcntccgtcactctcntactatgttncgtagttatgtgcgtcttntgtactattcgtctggancactcgctgcgtctccgcacgaagtcgccgatgcaactacatctgtanatagtgntatcgatacaancgtgacagcgcgtagngcggtaatgacatgcgacgagtagtnatgtacgacttcgcactctctcagagtgngacgctcganatgcggatcagacnctagcagacaatcgtgtgcgnacaagagtancaataactggactgactcagcganatatntcttgngacactagnagnagntagtcatagaactctcaactaggtgtgatcatagacgagntagcgacactcgcgcancaacagacgtcagtgagcggccgcagtgctagtnatggcgaancnacgtncatcacagtctacctcgtccgtgcnatcccncgtgcncacagataacgtccgtatacgtnantaatgatctctagcnctcnacgcatatacactcgccgcactatgtattcatatacntacgcatctgaccgctaggtgcgtagccgncaccacgagtagcgagcgttcgcacagcagtcgacgagacgacgcacacgaatatcgaactatgactaacatacngcgnggtgacgtagtgcgctgtgacana

SEQ ID NO: 20092 - DNA, 933 bp, Homo sapiens
acactgcactccgtatctattactcgtgccacgagaaaaagaacacgctagtacaggaccagcatctcctcgtatgatcaagatctatctctcttcgtagatcaagatcagcttcactcagaagatctaggcctggctctataaaaggatcgaggtatttccaatccccgccgaggtattgacacgacccacgtctctctccctcccacaaaaccctcactccgcgcgcctgtgttaccttcccatcctaacctgcttactggtacggctgtcctcttctgccccctctctctccaccgagtgtccccggtcccctatctacggaaatctatgtccactttctcgtcacaaatccgcccccccggcacgccgcaatctcccccatcgtttcccgccgctttgcttaatcgtcccccccctttcatcctcgccgggtcttaacgcgcacttcacccaccgccgattcaagctttcgtccatcgccgcacggcacgtgcccccccccccgcctgcggtcctcccgcttctctcttaggtccccctcgccaccaccacccgtcgcccgtgtttatgccccgaccgcctatatttcgacccttcgatccttaaccctctcccgtgacttccgccgaatcaaccactccctgatactagccccatgctcccgttggccgtggtacggcccgcgccctccatctaccacccggttccgcaccggaaagaccacgtttctccggcaagcccccactcatgtgctccttactctgctcgcgatcgcgagtcaccgccgtcctatcttaattcactgtgacggtgccctactagcttaccccccgcaggcgaaaagcaataatagagtaacggtgagctccgcgtcgtagcactcggtgctttgctgcactatcctgttctcctttccctcttcccctcccg

SEQ ID NO: 20093 - DNA, 959 bp, Homo sapiens
gcgcgtcacgattagcgagctaccctacgaggagggcttggatccacatgagatcagaacttagcacaagctcgcctgtcttcaaaagcactgaacaaaaatatctaaccttgaatacagagtcacaagaataatgacgaaactcgtgctcaacactgaatattatggagatcatcttctgcagaaggtaataaatgataggaaatgctgactaaccaagtcgggagtagagaaaacaagagccgggtgcacgaataggacaggcctacttcacaatgcattgaaacgacgcgtgatcgcgaaagaaaacatacgaattcgcgcatctgtagcaagatccgtcccgctgaaagcagaaaggaaaaagatggatagacatcataactgtgtctcgtctccgagtttcaaggaggcgagagtgtccgatagacataatgacggaaccaccagtgtaagatccatagcagacctggtcgcacgaggcctcgccccgccacgcagtagtgtgcccgtgggaacgaacagcaccgttgcggccgcgagcccagttccgcgcgcgggcccccccgccacccctgaaataccgatcgctcgcggctgcacgccggaaaaattacggcgcgcgggcgctcgacgactgagtgcaggcccgcctgcccggcgcgacacagtagcgatcgcgtcgccccctatgtaacacacacataccccgagggccgtgcgtggcccaataggtgtgaccacacgcagccctatggtggacttgcggttggtttattgtccgagtagaccccggcgcgcgggtcttgcgaacgaccgccggctccctgacatctccgtcccaccccgccccggagatgattgtgtgtgcggtcggctagccgcgctgcatcgtgcgccacgggctctaaatatgaagcatatgtatcttatccactctacccgacacccgcccgcgc

SEQ ID NO: 20094 - DNA, 900 bp, Homo sapiens
  misc_feature (1)...(900): n = A,T,C or G
cgtcaatacgtctgaagctacgcccaacncccacacctagttcaaggccagcatctcctcgatgatcaagatctatctctcttcgtagatcaagatcagcttcactcagaagatctaggtctggttctataaaaggatcgaggtatttccaatccccgtcgaggtcattatcaagatccaggtctattttacgacctaaaaggatcccgtctgagtccagatctccctttgtaatacgaatttagttcgcgtctaaaacacctgatgcaggcgctacccgagacagattggaccgcccatctccgcccgccctttaccgcccccccgaacgactatttatttacaccgaccaccacgggctatgccagtgtggcgaacccctctttgtatactcacctccaatccaccctctcgttcttctccgcgtctgctcccgccccccatcatatatgaataagactaactgacgttctactatcccccctgccccttccagttactcttttcattcccacctacacatggattccttcccatggccatcactaccccccgcctgcccagtcaatcaagatcctccgtcttccactccgactgaaagcgagcagcacgaccatattatgactcccagcttgcacctagctcgtaataaagccaccgcccaccgtacatataccccaatttcgccgtacgcccgcttgaatattcttaccgtgcacctgactctatgtccctctcgggttcgtcgcgtggtcccgccgcgggccctaattctctatcgataatccattgtttacacccgcgcctccacaaagttgtagtcgcttcctactgtcgtccgcgaatacgggtcaccctatacattgtcaacgccccgcattgctatctccccccgccaac

SEQ ID NO: 20095 - DNA, 878 bp, Homo sapiens
aaaagtgtaattccaggtaaagagaacaaaaacaaaacttaaacggaaacagggaccacagtatggggtgctaccagactgctccaccttcctgggcatcttcgtggccatgatcctcttcccctttgggttcatttgctgatctgacttgaggaagcgacgcatgccccaacgtgcggagccaccttcgctaagagggaacaccaggcccggctgtcctacacccagctgtcttttcctaatgtaaatgttcgtgtacaataattatatttttttaagcttgaggacgtgtatagcaaagccaggagcgaccgatgtggaccacgccagctgcgggtacccggagcgtggagaggcagtgctgctgctcccgcccaaagctcatgacacctcaataaagcactgcttatattgtcgggcaaacctaaatctgagaaacgctgaaaataagcgttccaacaaatgagagtcataccatgggtaaaaataatccaaaggctggcctcggtgggcctcacgcggtggaactatgacgccgcttcactcaagcgagggtaaattctggatactgcgctcaataactccaatggccacgtatgagcggtgcctccaagcggcccacgcccactcaagggcagcaatacctgtatccctcaaaatcaggggatgacccaacgaaaaaacatgtaccaaaaccgcaagaaacgcccagaaacccgaatagggccccgtccttggccgaccttacatgggcccggccccctgccgagcatcacgaaattggagctcaaagcaacggtgtcaaatcccacgggacttcttaataccaggcggtcccccgtgaaacccctctgtcgcccacaacaccaaccagcctt

SEQ ID NO: 20096 - DNA, 1112 bp, Homo sapiens
  misc_feature (1)...(1112): n = A,T,C or G
aagaaaaaaaggggggaggggggggggggggggggagagggggagtggggtggggggggagggggangangagaagaggggtgagttagagagtaatgaggggaggggggaagaggaaggaaagtggggaagtagatgtttaagaggaggaaaatgnaaaatgtagtggnnagtaggaataatcaacagtcagctcgttggttctttctttcttttacaattcacacgttgagtacagatcaaacataactgtctcggcgcggagatagttcgagagctgatatgcggtggggaagagtgatttatctggaggaattagaacagacgtgagttaatataatattttctcgaatgacgcgtcaatgttgactaattaaaggagtaagatctcgcactgggtcacgtgcagctgatcgcgtcggcagactagccagctctgtgtccgattcaatctcctcccgacgactcctacactctcccccgcagccaccaccccaacccaccccgcccccccaaatatgctcccacgttcatnagccacaagtaacacatgaacagtatcctccgcctatggatcgacacccgcacagtgtttcacatattctactcccgcgctccgtcatgtcacctcctctctcactacacctattaatcatcctcccccttccatcatctcgactcgtgtgtttntagtctcgagattatgctatagtccctctgatagattctcccctcacctcaactatttcacgactatgcaagcggactcgcgcttctgtcgcatcacgcacacgtgagtnnaatgtattcgctatacgtcccacacgtcgtctagcacagtatattccaccctctgtgcgattgcacgttgtgatanttcctaccgtgtaggttcatagtcagtcacggttccccctagcaggtgacggtgtcgactgagcgtccacatcgtgcagtagaactcatggagagtgtcaaaagggatacgaggcacggttggtagtggctagctgtctgcgagtggtgtgctcccaagttcacgtgcaccatctacggcnnctgatcctagtctgtgttatgtagcncatctatagtacattaatgtgtnccag

SEQ ID NO: 20097 - DNA, 833 bp, Homo sapiens
catattgcacaatccattcaactactatgagacggttctggagtgacactgttgagaagaggaagttccctcggagctccgggagcgagccatttgatctgccatattggactcctccagctgtgcggattcgcgtgcactataagaaacacatttctacgaccactttaaagctccactcattaccggtttgtgctggagagagatggataaaaagctgtatggctaccccaggctttcattttgagacagcaagagtacccagcactatgacggacgtaactagtggcgagcaagatcgtgtggcttctctctttgatagatcttctgtagctgaacagaatggaacttgtgtttttatgacatttttcaatttttctgggcagtcactgactcatatcattaccaacatcattttctctcacctgaggctaagagattttactttatgccatatcttaatacttcacccgttacaaaagattttccacctcttacattgggcagcttctaatattaggacatgcaatgcctgtgggttcgcaagccgtgtaaatggaacatgggagcaggagtatcatatgatccaatgcatggtgtattgtgtggcctattggtggtggtgttgtgaccagaatgatctagtgtctagtggttaacactataccctcgaagaaaggtcacttttgccctattcatttatggtcttttggctctcatgtggtgactgaacatttctggagattaatcagcgtcagggaataacaaatgtccgcgtttagggaaccatttccttcccgctctaaaatataaccttgttttcagggccacat

SEQ ID NO: 20098 - DNA, 1222 bp, Homo sapiens; identical to SEQ ID NO: 6763
  misc_feature (1)...(1222): n = A,T,C or G

SEQ ID NO: 20099 - DNA, 861 bp, Homo sapiens
  misc_feature (1)...(861): n = A,T,C or G
cagtgtggatgactcagatccagcagggccgatccttcaccaagagccagggcaagaattcaagcagaacctgcatatcatatgactatatttaacagttctaatcacaaagagttgaacaacatgctttctattctccttccttgacaaatatatcttcataatgattagatagaaaaatacgagtaaagttcaaagtttctaattgactgaaagctggcaaaacgtcaacgatgactgaacataattattatcgcatatactgggaattctgttgatgggcctgtggtgtttggatggataatcaatgaagatattaataattcataaattatatgctttttaaataacatttactttttcctttatcctggcaaaatcagtaactatgtcattgtactcaagattttcatgtaatttgtgttctagggaaagtaatgatctaaagctgcatttgtaatatgatataccatgtaacatatgatatgatatataaatatgatatgatataggatacaatataatagccataaaataaatgtggctgttttaatttaaattatagaaaatttanaattcagttccccagttgtaccagtcacctttcagacactcagtagtcacaagtggctagtggttacccatattgatagtgtggatatagagcattttcatcattgcttaaaggtctacagtcatgcaccaaataatgatgcttcagccaatggcagaccacatatacaattggtgggcccatcggattttaatagagctggaaaattcctaatacctagtgataggggagccatgggaacctcttagtgggaatgcctacttactggtatgtggttatgctgggga

SEQ ID NO: 20100 - DNA, 481 bp, Homo sapiens
atgaagggtggacgctggaatgaatttatctccatcatggcttttactgctaaaatagaggccatgaaaactgatccaaatggctagatacgaagatgcaacagatgaaaacaaactggcccacgatggaatggaactaaaaaacgtagaataataatccataccttcaagcaccgatagccagaaagtgtgccagataagttttaaggtaaaaggatcatacataattaaaatattgggactatttttgtttagcagatcttttcccatatttatacactgcccaggtaaatataagccttgcctctgccaagtctgaaataatatgtaccagatattcaggacaaaatgtcctccttagcataaacaagttaatttttttaaatccaaaatgaatttatttctgaaggtacaaactactttgttcagcatacctcctgtcctgactaaataaaacaaattttatggaaaaaaaaaaaaa

SEQ ID NO: 20101 - DNA, 924 bp, Homo sapiens
  misc_feature (1)...(924): n = A,T,C or G
tatagatgtacaaagcttaattcatcgcagaagtctgtctgtngacaatacacacggagactaggangtgatccgggaggctgaagagcttgtcaaggtcacagacccacagttttgggcccggtagggtccaagctctttcctggacatctgcaggcaatgtcgacaccccctccattgtctgtggcgggcaaaggatgtttcttcacccccaaacctttccatcctgtgctaaaagtgtccctcaacctgtttcctgagaggcccaagggctttggggttggtactttttctttctctttaaataaaacagaataaaagacagggccttgttggcctcatctgatggaactctgagggcccttccctttaattgaagggtaattcatgatcctaggtcacttgactcggtgggctcgggcgcgcnngtgcggccagcgggatcagcctcacctaaaggccgtaataacgctttttccaaaaataatgtggttatcctcagaaataacatgttgaacaaaaagccctctaagcgcgcaggaaccctaacaaggccgcgctgcttgccattgttccataaggtcccccccctctgacgagcgatacagaaatgggacgcctcaagtcccaggggggggaacaccccgccaggagcttaaaagaaatcaagcgagtttcccccttggaaaagctgcctttnnnnagctcttcatgtttcgtacccttgccggtttacagagaaacgtgtagccactttatgttcctttaaggaaaaagggccgcgcctttgttctattaactaacgcgtgggaggaattgtcagtntatgggggnnnncgagagtgaactcgcaacttaggtctgtggggctccaaaagacccattcgagagcgagccagtctgcgcctatacaacgtattatac

SEQ ID NO: 20102 - DNA, 847 bp, Homo sapiens
catgtggtttcatagtttcatggtccctgaagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaaccctttcatccagtgtccaaaatatataagtaaatagctgtagagtcacatatatgaagtgaatagcatatgtgtcattaagtctccctgaagattctttttcaagatcctggtcagggtccttcaggcatcagctgttgtgtctctctttgtacaggggacaggaacaaccaccagggctgaagagacaggccactgggtacctgtaagtggcaagggctgatgtgcaacccccctgccagaaacaaactggcctgagaagcttgtcctctgagccatg

SEQ ID NO: 20103 - DNA, 865 bp, Homo sapiens
  misc_feature (1)...(865): n = A,T,C or G
tttgaatttactattgaaagcttggaaaacactgcanttgacttntttnnanctnngacgaanaggggaggcacaaccctaanatatnctctccttctcctgctgaagcacccagaggtcacagctaaagtccaggaagagattgaacgtgtgattggcagaaaccgggacccctgcatgcaagacaggaggccacatgccctacacattatgcttgggggggcgggangtccananatacatttaccttatacacaccaacctaacccatgcagtgacctgtgacattaaattcaaaaactatctcattcccaagggcacaaccatattaatttccctgacttctgtgctacatgacaacaaaaaatttcccaacccagagatgtttgaccctcatcactttctggatgaaggggggaattttaagaaaaggaaatacttcatgcctttctcaccaggaaaacggattttgtgggagatgccttcccggcattgacctgttttattcctgacttcattttacaaaactttaaccttaaattctggggacccaaaaaactcgacaccactcaatttgaattgatttggctttgggccgccttttacacgtggggcttattccttctaaaaaaagacaagggctggttatggttggaaggcctcgactttctttctgtggggcatatgcggtttactatttggtggctttgtaacctggattaactttccgtgctgagattaggaacttcacctcttgcgaagttcttggtcctggccatttttgtttttgattttggaagtggttagtgactaggtctctattaatgggtttattttttttaataaaaatagtgggttgatgaag

SEQ ID NO: 20104 - DNA, 1601 bp, Homo sapiens
  misc_feature (1)...(1601): n = A,T,C or G
attcgacagtgcaatcgactctgatgaacatnttgtcagtcgttgtgcaagagtagtaggatgctcgacgatctgtcggcgccgcgtcatggacgacgtcgtagacatatacgccgaactcatcgcgcatcgatgtgtactctgtatagtcgcgcatatctacatatctatactangnagacacatatacagacgnattccggccgtatgtcggtgcgagccgngcantctcacggagtcgagatgccgcatgacgctcatctcaccgttcactgctatcagacagctgcacgtagagtagtctagtgatngtgtcttacatccgngacatgtgtatagcacaccaggacagagtagcgcggagtatgnacctgagtacangtgcacggactagtacgtcgtcatctagtctctatcgtacgagcgcgcagagcagaagactgagacagggtgcggagacgtgcgcaagacatgcagttaagactcttactcgaatatgatgtatgcgtgtgcgtgtagtgtgcgcgntcgcgtagtcggacgcgaactgcganagtgatagtagattacacatctactctgtgattgtgcgtctctgcgagctcgtactcacctcttcggtgtctcatgatcgagttctgacgatngagtagctggcgaggtccatgagtgtgagagacttnacgtggcgcggtctttcaatatctcttgtgaatctggcctcggtgtatgtagctctgcgactcgcacgtacaagaccgagcatgacgacgacaggcaggcgggctcagatgcgtccgccgctcgatgcgtggcatcgagcaatgtgagctatacgattcgctcttantgttctgtctagtgcgtcggtctctcctcgccagtgtccacgtgttcggacgtgatctgcctgcacaagatacatgcacgacgccgaacttaccaatcggagtagagacatagtgatgcgcgctggctaagacacggtaagagcgccgcgcactacgcagcacactgcgtgacgtctgccgactccggctcgccgcgcgcacgtactcctccacctgtataactagcgatctctgnagtgacgtcgctattgtaagtcatgtcgtagtccgtagaatgacgtgctgctgtgcatccgctgtcactcacgatctcggccaggcgtctgcgtcgcgcgctcttactgcgtactgcgctcgtctaagcttatcgcgcgtcatactctagcgcgatgcgacctcatgtctgtgttaatgacatttgtataccgagtgtagcgtagaacaaactgantgtatgcgtataaatgtatctgagtgtaagtgatattaattntacgttgtgagcgtgctgtcgccatctagttgctctcacatcaatcatctcaatgcactatagantagacacaaacgggacagcacacactatcctctagtatcacttccacatatatatactgactcacgatcatcatctatatcagaagtacatagtcagtacatcttgacttacgtcatctatattatcttacattatctatctatatatacattgttctctcatcgancttattactgcataatatctataca

SEQ ID NO: 20105 - DNA, 1830 bp, Homo sapiens
  misc_feature (1)...(1830): n = A,T,C or G
ctatcgtgtcgatcgacatgtatatcacactgctangtcagagtagntagctagcgtagtcacgcatgcagcactgtcgcgatgagcagttctatgcncnacattatgagcgcgggtngagatgatgcagcgatcgnccgtcgcgctatgtgtncaccncgtacgtacatcagcnacttcatcatgcnagaatcatnccgcaatgtcgtcngagcagcatagctatcctttctntcngtgagactacagatccntcgagacgcgactgcacctgtcgcgtctcacatcncgtncacgactcggtcgctgcgacgatcgcgtgagcgtcntcgntctagcagtcncgacngactcccagacatgagacngtcnagnatactcgactgatattgacgctatgagagtaacgacatgataactactacacantcagctnctatactacgtgactagcatctcaatatgacacgatantnantaangacatctactgagctcgtatactagntcatgcatacgtgatgtagcgacacgcgtctctanagatgagactgtggtatgagtactgctgttgtcgtgtanttacctgcttngagatngtagcgtagacatacaagnaatcgtatatcactgtatatatgtaagcacgacatgatcacnanacaacgctatatagactctacgcagtcgactctacttccgcattagtacatacgatgctntngtcatagactatgantgtagctcgactcagagacgactcnggagtgcacactgngaagtcatgatcntagcacagctaatagtctgatcgtgttcagtctgcgtgttgtatgcctgtttgcatacacatantgtgatattctgatgtcatcatagcggtgcgaccatgatagatcggtatgtacagtagagcgaggcgcgccgcgtgacgagacgtcagcgtctcgtgtcgngtctgagctgagangngcgatgacagtcgagagtanaaagcagactgtgtgtgtagnactatncgctcgtcatcgacgagcgagcnaccgacncagatgancatattgtcataccgntgctgtgctgangagcgcgcgccgacgtactcacctgnctgtcgcgtctgctncgancnacacactcactaaccacaacactaccatcgatagcagagtgcaacagcacaacagcgctcgacgagagtgtggggtatgncgcacgagtcagtcggagatgatctntagacagtggtacggacgagactatagtcgagctcttcgagcgacgactctcacacgagcacacactncctctgctagntgatagactagtgagtactgacagctgtgagaggcngcgtgacgcgtgcgtaatcgtagtgcgnanatagananactcgtagtgntcgtagtgtcgtgtagncngatgtcacgcncactcatacgangatatcctggcatatgtaacgtacgcgacgcgtcgcacacgtgntgagcgtcagcgancagacgagagttcgaggggangntngcgtacgtcgtgcaacacacatcacaccgtgcgtatgcgtacacgacgaaccatcgcacgtacgcttcaacattatcactacacagattgatcaagtacgctggcgctctactcgcacactctgattagtgatccgcgctcctccatcatcgttctgcgctgctacagacagaaaagtccgtagcagcgggctctacgtcgcagtcaaaaacggtggttncagttatgtcgccgtcaataaacccccagtctactgcttgctcctcctcggttgacaaaagtgaaatacgctcacacaacgac

SEQ ID NO: 20106 - DNA, 1936 bp, Homo sapiens
  misc_feature (1)...(1936): n = A,T,C or G
atgctagacgatatactaganactatcgtgtangagatggcagtnagtcgacacactgatcagcacgtaggagtgtgtcatgacacctcgcgcatacatacagactagtgcttcgagccgcgtgtacgcgtaaccgagcagcatgcgtgatatagcaatctaacgtagacagcaacaactgtgtcgcttgtantctantatctgatcgntgatngtcggattaagatgantagctgcgtagacgcgcgatatcttctgcgattagtctataatctactacaggacacctatacctacacagttanatatatcagcgacacgnagacaggatnagatgctagagtactacataggattagctctntcgtanatcgacaagcacgcgacanaccgctgaatacagtcggaagatgctatagtagaacgacaaacnactctgtagtgtcgatcactgatacgtctctgcgatattctcttcactacagacgtgaccatacgtacaccgctgcgcgctgtcgagtgcgcanacagaccatgaagcacatatgactcatntgtatcaccgatgtcacgtgtgcatgcatgcgtcgacacgagagtncgtgaacaacagcattattgactgatagatgatgtctatacgtatgagtgcgtgtcactgacnagcgtatntcgagngacatcgtctncacatgtacagtgntgcacctagctgantagcatgcatntctngntgactgcatagagactactgctatactacctgcgcacctatctcttagtccattgcacaccaatgcgtccacatatcacttcgtgcgcancacgagtagcgacatgagcgacgtagtatacattagacagacaagatgngacatgatacgaatacntattagatatatgcgacgaaataacataaggtggcatagatagatataagacatcataatnaatatagaatatntagtnattatgagnganangntncgtgngacctgcggtgnngnngatgcgcacgcgagcgntcggactcngcgccactcttcacatctatncantatcactantcgatnttcncactatcaccatcgcagctcacactgcgtcgtcctcgtctagtgcgctacatccatngctgaaatgtangnnngncngatcggtncgcnggactgnagncagnncggantataggantgctgcnggcgtgtntngtgagnnacgtaaganagcatggancgaatantctactcgatntanngagcganncatnatatcatgctaataactatctcactgatgctacatacagcaatctagctgcngtgctctgctactgcagtcgtcctctcgccgtcggtctgcnttagtcagtcgtctacatntgtatntataatagtactatattnnncatcatctcagtcanttttgatcatctctgacncacatactanccagcaacgtagcacattactnnagcgncnctctactgatnatctgctatcattnantatttatatngtntatctcgcntgntngtnngtnctnncngngncgntgtnnncctcggtcgnctcntgtgngnncggctgctcgcgtngcgtcgngactcngggcngnggggcntntggtgcgcgcgcgtgaccgttcggtcgtnctnncnctgtggcnggncagttttgtgncgggtgcggcngtacngtggctgttcgccgggtnntgnntncnngggngnggnnncctgngtnggnnnngnnnnnnnnntnnnnnnnnnggggtnngnnnnnngnnnnncnngnnngnnnngcnngnnnnnnnnnnnnnnnngcnnnnnnncnnctngngttnnttctggnnnnaannnggntnntttaccctttnnnnnnnnnnnnnnnnnnnnnnnnnnnnnnnnnnnnnnnnnnnnnnnnnnnnnnngggg

SEQ ID NO: 20107 - DNA, 477 bp, Homo sapiens
  misc_feature (1)...(477): n = A,T,C or G
actttccaagtaatggngctgaaaccattatcctttattaaaatccggcttctaataaaagaagtaaagctttaaaagcttcagcgcctgctcctggtcatcactaaccagatttacttggagtacatgtgaaagaaaacgtcagtcttcctgtaaatttcagcggcgcggnttanatggggagcgtggaacatcaataaacacttaaataagtaccntttacttcatggcatgaataaatggatctgtgagacccactgctacctggtactactttcagtatgttccccctcagcccctccagcttgtgaagcatactctgagtagataatttgtcatgcatgccatcaattaaaattctcctaagcccccatcattgtgaaaaattacctcagtttccangacttggtgatcaagatccctgccctcactttattttctgcttattaaactttattaaacttaaaaaaaaaaaaa

SEQ ID NO: 20108 - DNA, 791 bp, Homo sapiens
  misc_feature (1)...(791): n = A,T,C or G
tctcttaagtcatcgtacanaacntatctcactncanccacctttctacaagagtacatactgtggtgctagatgtcacccctcttcgaggcccttgngatcaactgaganaccatcantgaagttcctccaccttctgaatggatgccattatctgacgtgatagatcctantgggatgctgcttctttcctcacttactaaaataccctgataaggataccccaacctcacacactggccaacttgagggggcatcataacactaatcctggccccaaccattacccccacttttacctttttaccaactttttaacaattgccaacaattgccccccttccctccccattgaattaaataaacttcttgtctcatgattcctcaaattccccaaaaacacaggacctccacaactattccaaccacatcctcaccttgactccttgcatgctcatacacccctccccacctgcaacctcccaccanatcttccccctttccctccacggtaacctctcccccccccccttataagcggtacccaaacccccttcattgcccctcgctccccacttcttctgctccccttttcccccctcagcgcctcttccgttttccccaaacggcggtaccccgaagaatctttcacaaaccccccaatatgccctccctccacaccccctcttctctcttttcctagccctcccactcccacacgcaacaatcaacttctatccatcctggcccgccctctatattttatactgcccttctccctgaacctctcg

SEQ ID NO: 20109 - DNA, 1233 bp, Homo sapiens
  misc_feature (1)...(1233): n = A,T,C or G
atgacttgcgtctcacagnagtgtagagcgatntaagtctgtgtgacgtagngnatctcacgtggcagtatgggtacacagagatgcacagacgcagcgactgtataacatactagtagatatcacgtaacgcgcgagaggtatangagtgacgcgtgttggctanatcngtacngacgcatagcgcgtcgcgagatcacagcagcgcaganaaaattcactagcacgcgactacaatatacacctctctgacacactcttaactaagcncagactgagcatgcacctctacaagtactatcgtaactgcacaacacataatantanaggagtgacagaaatctgtcntgtcgtgactatgtggagntccgacagacaactctctttctccatacactatgcatcatcagtgtgtgaccgcagagaccttactgatatgtcatatctnctactgcgcctctcaacacacatcaccacaccaccctactcacagcccgtacaacgcgcagaccacgaacccgtcgacgcagttcacgtcaataacgactctatgcctctactacacctatacagagaaaatatagtcgattattataattgacgttcagatcatatcatacaattacatcgaataccacaacaaaccaaatagaatatagtcgagatggcgcaagcctcgagtatagtcaggtatccgcggcatcgctgactgcgggagaggaggagacgagagaggacacggaacagtggaggatattatacgatgtagacggaagagaggtaggagagtagaacatataaagagattacagacgcgtgtcaaaatagtagcacaagacaaaggtcgtataatgaggggaatgaacaacactgcacaataggaagagaggggatcatataacacatccatcagttatagagaagtgattangtcacactggcagctagaaatctactataccagcgtgcacgtacgccttacgtacgaacaagaccatccaccacacacacacaacacctatctccacaacactatatcctcctgagttccgaactgtaacacagcttcactcgtagcctgtctcgcactctcaactgtcttccacgactgcctatatcccttaggaggaggtaggtggggggtggtcacctggcgtgggggtgcgtccggttgggtggtgcgtgcctggacgcgtgtgctgggcggcgggcagcgcgcgggtgcggaaaagg

SEQ ID NO: 20110 - DNA, 976 bp, Homo sapiens
  misc_feature (1)...(976): n = A,T,C or G
gtatttgtgtagtggcgagtgattgagtgaggagtgtgataaataactgttagtcgacacaggcgagaccaagaggtgtgcgcgggggagttgtaggaggaaaagaagagttaagggtggacacacgtggnnggttatgatggacncttncgnngggaagggggggggggggagggtaccaatagncagacggcaatggcagattgtccacaataacatggaaagggaatgagggaaagaatggtaaaaggtgagtatagtgggggtgagtttcctgtgacttaatatacgatgtggaaggttgtttatctctcgtaaaccgttgtcggcacggtctgtgagctatatattagatgagaggttggacctgattagatacgaagatggtcggtccttaactagatcgtgtcggtctatctgtgtgcatagtggataggtgataaggacgataggtgctaatttgtccactatgttgctcttatggagatggggatatcgaaatatatatgtgacagcaataggaccgcagagggaacatgtaggggacgcttggctgagatttagggcgtgagtacgacatgagaatttgttataattgaggtattgatacatggtcgggtggacgtgatcggcacacgtagaggtgtctctccgggcagtagtaggagagatgtttcttgnagtgagagagggaaagaatgtggcggtgggagtcctggggcccgttcctccaccgctcagctagagcactgagctagaagaaagttgtagcgtttggagtgatcttagtgggaactctgtatcgggagcgtgcggcgtggacttggtaatcttgacacgcatcttttcattcttcatgtggggctgggaataaaacacagtaatgagaggagatgcacaacgggagtgtgggtngtggctttcaaataagactacaacataagaagctaaaaatagtttagtaagagtcacaatg

SEQ ID NO: 20111 - DNA, 959 bp, Homo sapiens
  misc_feature (1)...(959): n = A,T,C or G
ttgtcctgtgtgctttgttcggcttttcgccgcgcggttgcctttgtcgttgcgcgtctctgggtgtcttctgcgtgcgtccttcacccgtgctgtccttgttctcctgttccgcggccctccgtttgtcgttctctcataggtcgtggctctgtccttctctgcggcgtcggctcctagttccctggttctgctctgcgctttgtcggcggtcgctgcgcgtcgttgctctgtgcgtgccctgtgtccttgcgcgttgccgcgctcgcctctctgctgctcgttcgccttgtgcttggttgctccctcctcttgttgttcctgctggctcgcctctgctttctgctgcggtcgctttttctcgccctcgtctcgctcgtcttccgccccggctcttccctctctctcccttcgtctgtcctcgcttctcccccgtctcctctcccgccttgtcgttgttctgcgttgttgttgtctctgctccgtcgtctgtctgtgctttctgtcgttgtgtgttgggtgcttcgtggtcctccttgttccttcttctccctctgtgctcggcttttcttcgtgtgtcgtttgctggttccttctcccctaaaaagaacttctcttcttctcccctcttcctccgcttgatgatcgcaacaaaatttctttctcgttttctttccaccccttgttnccgagcgggantctctttcgtgttggtgtcctttctctctcctctttcttcctttttttttctccaaacctctccccttcgcccctctcctcttcctcctcttttcttcccccttcccctcttttctcaccttccctttttataaaaagcgtttccccccccntccaaaccccccnccccccnncnccnnnnnggggnnnngttnnncnnnnagnnnnggcgcggttacaaacgctttttccttgcgcttttattgttctcttgttttttg

SEQ ID NO: 20112 - DNA, 443 bp, Homo sapiens
  misc_feature (1)...(443): n = A,T,C or G
atgcctgaatagcacggcccgaagttttgnagaanaancagagacccccctaancagagaancatcaactgattgagcaacaagagaaagccggccttttttatattcattaaagcaactttgcaaagaggagagacttcagaatcagagacactgagagcatatcgctaaatttattgttgaccgttacttggaaattcttggttgacctatctatgcttacaactgtggctcccctgcaaaaaatagaaacggangcacaaatctttgaagctcactccgacaaaaaagccgcccaaggaaaccgcggtctgtaaatcacattcaaaagaaataaaggctttttataattcaaaataagcaataaacctttcaacaaataacataaatttttaattaaaaaataaaaacagctacatgcatgatatgcaaaaaaaaaaaaa

SEQ ID NO: 20113 - DNA, 972 bp, Homo sapiens
  misc_feature (1)...(972): n = A,T,C or G
ccaccacggcacaagcccgcgccggagaagcttagaggcgacaccatcatcaattttcctggcttctgcgctacatgacaacaaagaatttcccaacccagagatgtttcaccgggggaggtggggtggataaaggaggcaattctaagaaaaagaaatacttcatgcctttctcagcaagaagaccgattcgcgggggaaaacccctggccgggatgggacctgggcggtattcctggactccattggacagaactttaagctccaattctccggggggggggaaggacccttgacaccagtccaggggggaatgggagatggcctctgcggccgacttctaccaggtgtagcttagattctggctaaacaagagcagtatgcctggcgggctgctgagcacggcttcggacctcttgcctctgggggtggggcagccggcattaccgggacagcgttcccccacccgcctggcgccacttacgcttccgtccaaaatgtatggaaaagtgaaggttaaggcgcggaagagtggctctcgggcggtgaggagntatagagcgcctcggacactcgtgcnaacgcgcaggcagggcctcgcccaggcagccaggccgagtgancgggcgcgccctcggtcgcggccaggcacagtacacctctcccgcggcgtgcgggcgcaagaaccgagttcttctggcccgcggcgcacgcaaaccgaagagaggcacgaaacggagggcgggcgcccggnnncccggcgngagcgcccggaccggccgagaggcagcgcggggagggcccgcgaaatgtatcgagaagagcacacgccgcgagcccccgacgcggtgcgcctcgccgcgcggtgagctcctccgcgcctgcgacggctggccccacacccggcggtagagcgcccccgcgttcagaaaccacacgcgaggaggccgcgggtgagtaggcccccggcgg

SEQ ID NO: 20114 - DNA, 1129 bp, Homo sapiens
  misc_feature (1)...(1129): n = A,T,C or G
gttgttgtggtacggctgcgcgggaggtgncggcgttcgtgattgtttgtttctgatgtgtttgtgtcttcggtgttgagcggggcggtggnttgtgcgtgtatggtgtgggggtgggggggggngggtggggtggtggtgggatagtgtagcgacgtggcgggtggtgcgtgtggttgtcggtggctgttgtgttcttggttgtttggggtcagagagcgatctctgactcctagtgtggttgtgtgtgtttgtgatgcggcatctgctgtctcgtgtgtgtgtggctgggtggtggtcgctcggggtcgcgcggtgtgcttgttgtttcgtccgcggncggggttgtgtaggttggggggtatgttgcgggggtgtgtgtgcgtgtctcggcgcgcgcgggggagtgtgctgtgggttgtagttgtcgagggctgcttgttatgacgtgttgattcgcgtcgtggtcttcgtacgcggggtggagtgtgtcggtcggcgcgcggtgtannnngcgtttgtcgggttctactcttcatattgtgtttgtgggcgctctgcggcctctctgcgtctccctcgttagctcggctggcgttcttgtctcgttgggcggtggccgcggaccgctgtcgctccttgtcgtttcccgcgcttcgtccctgcggtgtggctacgctctctgtgcctttttggccggctcggtttgttatgtcgtggcgggtgctttggtgcgtgggggttgtttgttttcggtgtgggagggtgttgcttgtgggggtgtttaagtggagtgctctttgtttgttgtgtgttttgttaatgtggagatgttttgttttgctttctgtttactcttgnccttcgtagggatccctcgctgctgggcacctgggtgcgatcggggaagataaaaaagaatgagaaaatgagaaagagaaagaagaataaaataaagaaataaataaaaaaagaagaaaatgataaaatagaaggagaataaaacaaataaataaagtggtctctncgttggccatacatgcggtgtgtagttgttngccgcgcctagatatttttgaatctcgctgtgtgtgtatattgtgatctgtgcgggtgtcggttggtgtgt

SEQ ID NO: 20115 - DNA, 738 bp, Homo sapiens
tcgttgttggtgttgtttcttgttcttatctgtttcgctctgtcgccggcttcgtgtcacttgtgtatgtctcctcctgccccaacgggtgttaggtcttatagatgcggttccgaggcggcggacgacgggtgttgcggtctatttgcgtccttcgttgggaagttagtcttctttcgttcggacaatgatgagatatctgtatcttttttaatcgttgtcctcgttgttgctcttggtcctattggcgttggcggtcggcggttggcgtagatttctggcgcgcttgcctgccgcgccttcattgcgccggcgccgccttcttgactctctcgcggttgcttgccttgggtagcggcgaccgctttttggtcggactgtgccccctccgctctccctcggttctcgcttgggttatcgccttctttttcggtgtcggcggttttgttggtcttcgtcgggtttttccctgtttcgttcgtgcgcgccgcccgtgtcggggggtcggagctggttgtctgtctcttcccgtttgtctgttctttttatggtgtctgtggcgcttgagaacgcccccccccttttttgtcttctccgttttttttttcgctcgctttttcatacctcatgcgtacgttctgtggctgtttgtgtcactaatgggatgggggtgtttgtggagggggctagcgaaagaaaaaaaaaacaataaattatatttttacaaccccaaacccc

SEQ ID NO: 20116 - DNA, 903 bp, Homo sapiens
  misc_feature (1)...(903): n = A,T,C or G
caggaaagcctggaggaagcttncatctgacaaattctctaagcttgttaaagtgcttgaagggagctactacttctaaaacattcaataatctgaaaaatggaagaagaaaaaaatgttttcattgttcaaattgccttgtgtccttatgcttttcaactacatgcttcaaacctggacagtagtattgacttccagatactaaggatgagtaaattacagactttattcctcctaactttttactctataatggtttacaacttttgattgtgcagccataattttcacaattgtttgattttaggtccatatttagatggactcaaagctagtaactagattcactgtttgggtggctgatttccactgtcaatttattgtgtgtgtaaaaggctcttatgtgcttaatattccttgatttcctgcatatttgataaatgattgcttcttatctttaaagggaaacttgactcacataaaatttcaggttatactgtctttccttctgaactacaatttcataatatctcttagcattctatatcatatttagtcattatgctataatctctttcatcttttggttggatggatttctttttaagtaagaacattttcttctgaaaaagtcctacgactgctacggttcttgaatcttttgtgcttgagaatatcttcaattgcctccatacataaattaaagttacaaatactgacagatcacaccttttgtcttcaaatacgtaagacctttgaaaaatggaaggcacgctgatttatccctttcttgccgatagcttggattaccacaccggagccaatgttgacacgatattttgttcaatcttctgacaattttggggaccaagcacccatcatctattttatacaaaaaattct

SEQ ID NO: 20117 - DNA, 1622 bp, Homo sapiens
  misc_feature (1)...(1622): n = A,T,C or G
cactcantgctcncaactttatatatcactatnctactatnagtngatntatacactctagctctgtaatcttcgactatgtgtgcgtnaggacacancgacgtgatcganggcgcatcgtgtgatcgattgtnanatatgtgtgtacgcgatgtatgagtnttatgactttatagatgnctgtntcgcgtccagctgancgcactctatatangacaatatatacttatatatgatctnctagngacacgtatctctccacatcacttcacacatatngcgctcatcgagtnnagacagtaatactgtntgtgtgntctattcgtcagtgtgatatctcagctggtgttgnaggatttcgctcatactaatangactagactaaacacgtgtatactcgtgctgctataactgctatatgcatagangcgcgtcatatccctnnactgacgtctcatatcgngancatacacagtcatcaatgcntctcactcttcgctactatcttgaggtcgtcatgagagagaagaggagagttccggtcctatcttgctgtctancgnacgctatctgctataaatcactatcttgcgtattcgtgcgttcatgtgtacgcgcacagctgcactctctcgctgtctcacgcgcgcctctgcgcgtctggtcgcgagcgctgcntcttatcgggtcgntgtcgtgtgacaactgctcgtgaatataaactctataggatacatgacgggcatctgtggcacgcacataagcacttcnctctcgtgtcctcctacaattgacatatctttgacattataattgagtctgtatcatagagatgtatcgttggctggcgngcgacccgtgcgtagttcgtcttctgatcaagactacactcatacaacactcgcgtgaganacgaggagtgtgtcgagtatgtatagaattanggnggacatgcggaagtagcggagtagcgagcgtgagagtcgtccgtgcaangncggggnggtgngctcgagttctccgctggggacntccgatgatggcgtgactgatagtcgtncacgcctactagcacagnnnacngtgcactactatnttccttactctatnttnnnttctactctctatctcnnnnccatctctttatattacaaaactacttcctaactacttctacatatcgnnnnaactcctcaatatattgatctcacccaccactacacccaagnggcgctcacgcacctcactctttcagcgctcgtgcgggcctncgatgttgagtctactcatgtntttgtgtgtcctggcctcgccggncgactcattgaggcggtgcttgggctcggcctcctcgtgccccctcctcttgttntttatactgatcttcctctcttttcnnnctnnnnccttcctcctctcttnnnnncccttnctactnnncnnnnnnnctnncccttnnnnncnactcannctctnnnnncatctctctacnnnccctttactnnncnnnncctcntnncatnnncccacccttactcancaccccnnnacatctttatatatataaaacaaaanaaaccacccataacacacatcatancctaattacactctatattcaa

SEQ ID NO: 20118 - DNA, 159 bp, Homo sapiens
  misc_feature (1)...(159): n = A,T,C or G
cttcaggtgacatgccctgctcccctcttcaccctcgatcatgattgtaaacttcgtgaggacatcaccaaaggctgacattgacggcatgcgtcctgtacaatctgcanaacaacgatggaacaaaataaacaccttttctttataaaaaaaaaaaaa

SEQ ID NO: 20119 - DNA, 1906 bp, Homo sapiens
  misc_feature (1)...(1906): n = A,T,C or G
aacacantcagtcgagcatntcaccatcagtaagcgtcagtcaccgtgcaatacgacacntcganatcgctnatccgacntncagctatactncgaccgtgtagccgctgacgcganccaagactcgctgtgcntngcgacgcgccgacgactcgatatctggtagacacgtgtntcactctatcacatgtaaagcgangtgagacggaatnnantcagnacatctcgatntgctanagcagtatcnactagctgtaggctnancgtngcngcncgancgccgtgcagttcngagnancacananccggtgcatctngttgtcgcttcnctctcggctngcgacggcgactgcacnacatcnctcatgacaatnatcgncgancgagtccanatgctatagatgagcgtcnagctgtagaatgatcgngacnactgatctgcacagngnagaggaggctgagntagatcngcnacgtcgctggcgcagtgcactgcagcgagcgctncncncaggtgnnngctagcgactancagcactagcancaacnatanacactncngtagcgcgatcactacgtacgcntcactcatcnntnctaacacacactnaccactgacacagcgantacttactnaggcatcatggcngataggacgagtgtacatatcagcatagtntancantctcacacacgtgcacnccacaccgacgatacacgactacantgcncgcatccatgtatacnccanccgcnaacananntncaatcgcagctcatcgcaagaacacggcactcgctgtcgntnatcacagtactgactacaatanaatgatgttgagcgagancctacaacatanacgcagattatacgtcagagtgtactatatgtnattactcgagacgtatcgnatgacacacaacnacgagagtacgaatgacagacctagtgaagancgaccggatacgacgctagctctggtggcgagnagtgtcccanactgnaatgcgcggcgtgcgcgggcgaagtacgtatgagagtcgagtagagtaattagattgagtgacagcgtatgaggagatatatgatgtcagttgcgcgtatacatgagcgagatcacacatagtngtgtgnctataggacacaggaccgagaagaagttntgatgtatgagatggtatgatattgttgtggattgngatagcggtagaangcgtaggagctcgtgtgaagactgacactaccacggtgatanantagagcggcggacatagcctgtatactcaacaatgcnnannagctgnggncggcgatcaaccaacaccactnattatacacactaaactacntacagagtcacacgattaatcacgaatagtacangcacagatgtatcactncctgcagcactcacnaaacttgtantgatcagtgaggatgactctgtgnanaagtgtctgnacgcaggcgacgatgcgaagtagtntcgcatcgagatgtntgcgacgtcgngcgccgactanacgncgacgatcactacggcgcgcgcagtaagtgagcgcagccgagtagatggacgatcatnacgcgggcacgctcgcgacgcgaccggcngatcatcccctgcgccaccgtccgcggccgncgcncactgcgcgccacacggtnntacgacaggtacgcgtctacgcnancatacgnccgcggtaacgcggnnnnnctgcatncnncanacctcgtatntngacncagnnacacaatangtnnnnggnnnnncngnnncnnnnnnnngcnnnnncnnnnttnnncctnnnnnnnnnnncnnnnnnnnnnnnnnnnngnnnncnccccnncctnntnnnnnnnnntncgcctaccgcattnnnccccnnnnnnnnnnaaaac

SEQ ID NO: 20120 - DNA, 576 bp, Homo sapiens
  misc_feature (1)...(576): n = A,T,C or G
ccccctccacccaacccaatcacccaccaccctcgagtagactcttgctctgtctcccaggacgatcttggctcactgcaacctccaccttccaggttcaagcgattctctcacctcagcctcctgagtagccgggactacaggagcctaccaccacgcttggctaattttcattttttttgttgttgtttttattttgtagagatggggtttcaccatgttgaccaggctggcctaaaacccctgatctcaagtaatctgcctgcctcggcctccaaagtgctggaattacaggcgtaagccactgtgccaggcccatttcatgctattctttaaatttacttnctttgtaaatgaagacactattaatcagtttaattttaatgtgtccaatagaaactaaatgcttaactatcgattgcatgcttatttactttacctttgtcttaactctactgttcttacctaatttttataactactttctgcatttttgatcttcattttccaaccatttttgaattattaaagaaataccattagcattaaattattttaacaccaaaaaaaaaaaaa

SEQ ID NO: 20121 - DNA, 923 bp, Homo sapiens
  misc_feature (1)...(923): n = A,T,C or G
tcattacctcgttacaccaaaaagaaaaaccttcctaagatngacgnacagaagagctgncgggaagaactctgtctgaggaaaagaatccacagctctaccctaagttctagcccagacttctactactcaaaagcggccccgcgaaggggaagccgagggtgccgagaccacaaagcgcccagctgtgtgcgctgatgcgttgcgaactccgcggtttgaacaccaaagacatgtaccttctttcactctgtcatatttcttttttttgagactgtatctttatagactcgattccaactatcggaataactcgctctatcacagcacactgatgcacaattaaaaccctgatggaacctgtccctccctaatcgcccgtcccccccaatacccacatattgccactaaccattcactcccccccatcccaacaacatcaaatcaccatctccattacacgcccatcctaccctacatcacctcctcccccccctccttcgcatcctatcatccctaccactacccaactcccctaccgtcccctctccctctccacaccacttccctccgttacatactcccacaaccgaattatctaaatcgacctccaccataacccccacaccaccacactcacctcctctcccacactccctgccctctacaatcactacacgttcttgccccccatacacacaaataccactcatatccttctaaacctcttctttaatactaattcagtttaccccctactcctattgtaaggcctcctcacacccctccccagtgtatacccttcatattcacccctataatctccctcagctacccacctacacccccctccacccacaccttctcctcgtcactccaccacacaccacataccatattcgccacattattttactctcatt

SEQ ID NO: 20122 - DNA, 1956 bp, Homo sapiens
  misc_feature (1)...(1956): n = A,T,C or G
cgcatctgctcctcncnctctcnctgccttcgcggccctcgctantgccgctctctgtttcntctcgncatgcgtctgctctctgctgccgctcctnagtcncgtcnttccgctgcgctgctgtgtcttcatcgtgctctctcgcgtcgctacctctctctctttgtnattcttgtgnttctgtctgtgtnttttctcgttgtgtggtgcgtgtcttgcgtctcgttctgttntgccgcgcgcgttgtgtgctgtcttcctcgcgtctgtcggncntacttcgtatgtgcgtgtgtcgcgtccgtgtctctcttccgctgcgtgcggcattctcctcgtctcggtngtcgctctctcctntacactcctcgacgcttgcgnccgctcccttgctccagtnttgcgctgtctcntnttcctcgcctctctggtccgtcaggggcgtgcgacgccctcgatcatgggttaattcctctcgtcttcnctctctgcctcatgtcgtgtctctctaantattctctctcctcctntcttctcctctctgcgtcgngtctgtcgtctgtcctgtgcgtgtctgggtcgtcgctcggtctctctgtgtgtctctctctgtgggctcgtctccgcgctcctnctcgctacgtctacgcctcnctaccgtcgtcgctcgctgtatctcttctccctccgctgtccgtgntcncttctctctactgactgtntcctctcctctcctcgttntatgtgcgtttgtcttgttgtctgcgcgtgtgctgtttctgttctgcgttgtgtgnttggtgttctcgcttgctccntagctgtctcttgtctgcgtgcgtgtactcgctgtgcgttctgtctgccgtgtcgancnccctgctagcactcgcgctctcgccgtntntatcgnctctcncnttcgctacnctgtctgngcngttcgcncgtcgctgcgtgttgntgctcgtggtcctgtgcgtgcaacgcgcgctcgtgcgtcgtcnctcgcgctgcgcggctgcngtcgtggcctgccgtcgtgtgtgtggatctcgtctctctccgctctcgtntgcaccgcgtcggcgcgcgcgtcgtgcgaacgtgtcgtagctgtcntccgtgctcgcgtgctcatctctgcgccacggnngcgtgntctgtgtcgtctgcngngcgtcgcggctgcccgccgcgcgcgcgagcgccgnnnagtnanncagnnngnngnncngtcttctctctcgaagagaagagangctcctctctctctcctgtccnctctgtctcgtgtcncctccttcgcgtgcntcncgtcncncctctcgcncgccnncncggcnctctctgtccctcncntctctgcntcgtcnncncnnttcncttgtgtctngggntgtnctctnccccngntctcgctcgcggcgcncgtncgtctngngccctcgtctgcgcnggcgcgtcgctgcgtctctctcccnnctcctcgtcgctctctcttntctgctcctctcncgcnntgcncgcgcccgcncgccgggcgccgcggcgcgggcgcgggcgcgtcttctgcgnntgtcctcttgtgtcttgtcnncctcgtcgcctctcgcgtctcgggcngcgnnncgccttctctctnctngtcgttgtcttcgtgctgtctgcttcctgtctcttctgtgctgcggctgtctgcgtcncgctgtgnnngtgtgcgttgtncggggtctttctctctcgccgccnnctcgtcgncacggagctcttctctccttcncncngcntgtgtttnnncnnncccngccnncngaggggnnccntctctttcttcnttctcttctntctctatcctctntccttcgtcttctctcctctatctntctctctcttcntcctcnncnctcnncctctctcttnncccnantcctctcttcccctttcccccccccc

SEQ ID NO: 20123 - DNA, 987 bp, Homo sapiens
  misc_feature (1)...(987): n = A,T,C or G
cccatccctcatccaccaaaaacagaaacacgtccttttgtaactanacagcaaggctcgcgggcaggacttctgtctgaggaaaatgaatccacagctctacctcaggttctagcccagccttctactagtcgaaagcggccccgtgaaggggaagcctagggtgccgacaccacaaaacgcccagctgtgcgcgctgatgcgctgcgaactccgtggctagaacacccaaacacacgtaccttactttcattatgacatcttttttttctttgagactgctgttttatagcaagtaccaaatcattgcactaaccgctcccccacacaccactgtgcccccctcaccacctcctcacccctgtactaacatacccgcccgcggtcccctcctccatatctcccacacatcccccacaccccccacccccttacccttactttcttctctctccctctagtcgctccattcctctccccctctcctccccacacactccccgacctacccaacaccccaaaaccagtcatagcaccaacacaacacatcaactcacatacactctcctctcctcccctcttcgccccactcaatctgcaacgtaccccataccgcacccaaactctcatcccctccacacctactaccagatctacttttaccactcacctctcccccaccctcacatcccgcacacccctccccatatatcctcacctctctcatcccacctctactattctcctccatcatacccaactcaccttaaatcccgtggtcgtttcccatttcacatataccactctatcccctatctacaaccatcccacatttcaaatccctaatataattccgtgtttcctcccctccctttctatattatcttttcccgctcttgtctctccccccaccgtcacatgatattgtaattcacccctccacatgctccacatcccacacaccataactcctagcccgatcacatg

SEQ ID NO: 20124 - DNA, 1248 bp, Homo sapiens
  misc_feature (1)...(1248): n = A,T,C or G
cgtagttgcacagttctatggtataattgagggttcggtacggtgcatccgcgctcgacctccttcatatgtgtggcggatgcatgatctcagcaacacggcgagcacggcgcccttactgtctgtatcatggggaacgaatgagcagtgtggtatatctgttcggtgatgcgtactcggttatacgntaatcttgtatgtgatctactacaagaaatgcttcgaacaatgtaggtagagaaaactgaccagagagatgagctgtgggncggctcaatgttacggtancgcacgatgcgaggtgtgcgtatctgtagaagtttattatcaccaccaacaatctttaaattaccatgactcatttcatccttatcatcttatatatgcatctcagtttatgacttagtgatatgctacgtatatctaatctatccaaatgtaaagtatatactaattaattaggtcgaaagactacatatgttatcgtaagtattatggccgtgagtctattaataatatagtcgttctatagatactgtatcactaatccatctcgcgtttaggtccgcgagatatataacctcattgagtcagtacgaggattgcgcagaagcgacgtcggtggcgcggagactgataagagaggctcagggggggagggcggcagaagagagtgtgacgaagataatgtgagtggtcgggcgccgcctaaccgacgtgcctatcccagaggtctaagacgtgcgctttgcgagaagagaagaaagtagagagaaaagtaagtgacgtgcgaagatgtgaaggggtcagggcggagggaagctaaggcaatttngtngagttgtggatttataatatatcatnngatggaggtgtatagaatataatanaatagttaaaggagtcgtatataattcatgacttatagtatgtctcacactttctcgcgttcgacttctctggtgtcgttgagccagatggggagggtggaggagagcgatgggtggcgttaacagaagcgtgggggtggctgtcgtttgttgtgtgggtcgggcgggctgtgtggcctcgctgtcggcgcgtacgtcgcngtgngtgcagttggcgtgtgcgcgagttgtgtgtgggtnggcgcggtggttctgttnnncggcgcatcggttnnnnnnngnnnnnnnnngnncccttnnnttggnnnnnntcnntnnttnnnntttttctttctntccnnttacttttcnnnntttt

SEQ ID NO: 20125 - DNA, 1071 bp, Homo sapiens
cccccaaccccttaacaccaaacacaaaacccccctcagggcaaacccagtgctcctgtttctaagatcgatcccgaacacccgacagaattgcttactactcctcagcagctcacccaccaggcgttcagccacagaagtcaccatatacaggagctcacactcaagcaggtcaaattgaaggtcagatgaccaacagtaccagctacaggccggctatggagcacagtagccgcaagctccacctcagtagccttaacagaattggcctgtccctattacagcccgcttatctgtcaccacgactgcgacctgaccacctctcaacaatttccagtgatatcggccaacgaccaactactcaaagcaccagactcctgacttcccatggccacaccacccgaactcgcctcgtcctaatacgccacagtaaacaccatggcgagaaactaacaactgtaaaaaagttatctcctcgacataagcttgtcatccgctactaatttactcctactgccacctctgcactctaaatctctgcaattgtgcttctcacaccattcttgatgacctcatatactacgaaactaggatattacattatattctgctccaaattcaccacttatactccgtagaccatccgtgccatcacgcctctactcctcggagatcacgaactgaccttgagaataaggtcgatttcgacatgtcaggtctcaaggatgtccaatgtaggaagctcatcgcaccgacaactaaatggaataatcataatcactatcatgaagcccagagactatcttatcaatgctccaattaacacaagacaaacaccaaatttcataacctgttatagccacatccatcatgaggacaagtatgactatgcacacccagttcatgagagccaccaacgatagagcaatctctactccaccacccacccacatcatgctcgctctacggccaggagacctactgcacccacgcgaacttcgactaacgtatatataacccataacaaatacaacaagtcaacatcagcaaactctaccagaacgtaattgt

SEQ ID NO: 20126 - DNA, 1038 bp, Homo sapiens
  misc_feature (1)...(1038): n = A,T,C or G
atcagtatcgttgacacattcgagtgtatagatactaatgtnatattggnctcgctatatggcactgtatatagttcgtattctaattatattagactatgtggacttacgtacatacttgtgtagagtgatagattgagtantattacatcttatatatctctttatattttatagtcctacttgtccggttcaatgaactgttaattattgaatacaacactcattcttctctgtcgatattcgcaatttatcgactcgataaagtccactggctcggctagcattacgaatagttcgtgtnccctatgggtgcgagctgcgactgttataatacaaagttattttcacctctcctttcatcattcttaaaaaaattactatttatgtttaaatgcgacgggtatcacttaatatagagagataacttacttcaacgataaaagcgcaataaaaatataaatttgatttatatttaattaaatgtatattacatataaataaatactaccacttgcaaaaacgcagaagaaagaggaatacggagcaagaataggagaggataaaattaaaagggtatattttaaattaaataaaaatgatcataaaagtctaattcttgcttattaaaatataaattatatatttattctaatacgatgaaaaatggcaataagaaagatattagtcgcgggtgggtgtaacatcaaatcttttgtacgtagggttactatttcttatccttggtgtcctgatagtatctatttttattaatttaactacacgcataccatacaataactattgctgaggtgcgttgaggaatctggttggggttgcccagcgcctcgtaacaagtgcagaggtaccgcggactaggctggtatttttgaggaccttttttttgcattgtttgctcagtctcccgttttcttccgttctagatgcctactaaatagtcagaaagttnnnnnctgcagtccncaaatncnttnnntctncactccnncctttctttttttttnnntttttaatttt

SEQ ID NO: 20127 - DNA, 1401 bp, Homo sapiens
  misc_feature (1)...(1401): n = A,T,C or G
cagccggcgcaaagaaataggaaaataggaggacgagatgaggacattatgaggactntctatttncgaatcgggtcagtattaagngagaagaagtaaagaggcaggtcacagtaagctagtggaggttgataaagaagtatgtagaatacagaggnggagatggagaggggtcgcggtgcaagagaatgtattcatagtactagaaggcacgcagatatgtgcggtataatgatcgagacagagagagcggtagngtatatgtngcggagtggagttgttatcactgtgagagncannatacagaganagaagangttcatctagtgcgcagaatagagtctgaggattcaatgataggccagatacaacnaacggatatagttgagcgagcatgaggagtaaacgacatgaagagcgtgagatgagtagaagagggtgtgtgagacgaggantactatcagccaagtctgagcgttgcaaggagcaactgcacagagaacatgaggacacactaggcgactggtagaggtaaatagatgaagaacngcccgctattaattgagacagcggcgcgatgcggtggtacacacaagcgagtgaataaataggctggaatatgtcccaacacactcattggcgagagtatattaaaggtaaataaggcgnaactatggaaacgggagtgtcttgagaggacgcgtaagtatngatatagaaagacatcncacnggacagcaatcgtcggtgtagggaccgccttattacntcagagcgcagcaatagaagtgagaataagaggtataaatcggacacacctaataggtgattagtgcgatacaagagaaggacncaagaagagtgagagaggtagaatgacatagatggggcgtcacgggtatatacaacattcgtggtgcgtgacatgtctatnaaagtagattatatacgaggtaaggaggtaaagtgagtggcgctatagtaagataagagagagcacgtatagggaacacgcatagacagaagaggagatagtgtgtatgtgtgattactataggatgcgatagggggtgtgcaagcgataaaactgaataaggcacgaatgtatgcgacgtttctattgtaggcgtgacgttggtagtaggagttgatgactatattataaaggtaatataaacacacagaaggcgcaggttagagaagatgaactgtgtattttaatttgaacaagaagaacacataaatacaatagaacaatataaagaaaactactaataataaatataaataatnagatgtgctctncgttggtcgaactagcgtgtggacgntggtactgactctacctgnttctggcataatcattaaataatataaaaataatagttggactattaggac

SEQ ID NO: 20128 - DNA, 769 bp, Homo sapiens
gccaaaaccgttcaccatggaaagaaaaaagatggtcaaggaagcccagagggagaaaagaaaaaaacaaaattcctaaacatgagaaaaaaagaaaggagaagacagccaagaccaataaaggcaaatagaatgagaaccatattatggacagccattttcctcagtctcttttctcgcctgaactcttaagctgcatctggaagatggcttattgggtttaaccatatcgtcatcgtcggcccttgtttgtaaagaccggtttccaaatcgtcctcatgtaactgctgcacaaagctctcaagttctcgatgttacatcccgcccctcgactctgactggtgtatgacagaggatctatttaatctactatacttcaataacgaattttgtgcatgttcccccccgtaccctattgctcccccgtcccatatccctccccaaacctgtagatccgcaagtcctccccgctctatataataatattacttccctaattgatttattctcgcctctccgcctaatatttaaagttctcccgtctgtccgtccgcaccatctctgcacaacatcctattactccttcctatttcactcccccccttaccttatttttaccacctttccccccaccctcttttaatatcttacaccttatcatatggtgtcactcccatcttcatctatgccctatacgtccaaatacggtgctctatgctaccgatttatcctttatatcttgtcccctctcattcacccaactacctcg

SEQ ID NO: 20129 - DNA, 1468 bp, Homo sapiens
  misc_feature (1)...(1468): n = A,T,C or G
ccgtttgagcgtcacctggttgtagtgtgtcatgtctcttcctcgcgtctgcgtggtcccgtgtgccggcgcgcgacgctacctgcgcgttctcttgttgttgttcgtgtcgcgtcgcctcgtccttcgcgtcgcgtcggttgtatctgtcgtcgtagtgctcgtcttctctgtgccgcggctgtctgtctcnttgtgcgttgcctgtctgtcgctacgtctcgtgctcctcgcgtnctcgtngtgtgtcgtcggtcgtgctnttcgtcctcgcaccgctcgtcctggctccgctgtcgcgtgcgtcgtctcttgctgcgctttctgcctccttgtctggcttcgtgtgtctngtcttcctgttctgcgtttcggcgtcgcgcgtccgcgcttctctttcctatgtggtgtatctctgccgtcgtgctggtggcgcgcggctgcggtgtctgttctctcgtgtgctcgtctcgccgtcgtcgcagcgtctccnggcgcctcagcgtgtctctctcctcttcatgtngtgtcctcgctgtccgcntgttcgtgtcgcctttcctcttcgatgtgacgtgctgctggcgtcgttgcgctggctcggtgtgcgctgcgctggtatgcgagacgtcgcgggcgcggtgcgggcgtctgctttaccatgcgatctctcggtgctctctcgctgtgctctactctcggtcacgctgctcgtccgcngactgcgtgntgtgngtttngcgcggctgctgtactctggtcgtcgtagtatcttgtcgcgggcgcgcgtgtgtctatctgatcgtgcctcgcgctcntcgtttgcggctgtactgggctgcgtgctgcgtcgctgggtcacgttgtcctgctcgccgcgcttcgcgtgtgctgtctccgcgtctgcgcgtcgtcagtctctgactctntntttctctgctctctgcgccttgctcggtgtgngtcgtctgtgcggcgcgagggtcggtgctgtctntctcctcttcttctcctgcgctgtcgtgcctattgcgtcgtctcgtgttgtgtgcagctgagcgccgctcgcgcgggcgcttacacacagcgcgcgtggtntgtgtgcgtcgtgtccttgctggccgtgctctgcgtggcgcgcgtagccttgtcggcggccggtgcgccgggtcctccgtctcctccttgttcgctcgcgtgcgcgtcgcgcgcggtgcgtgtgtgtgctcgtgcgtcgntctgctcgctgtcgtgctctttcgcgctgcggctcttcgcggccgttcctgtgtcatgccggttctgctgcggcttgtgtcgctgcgggtggtttctctctccttctccttgacgacgcgcgctcctcattctacacctacacagtcaatataataataannaatatgtggcctnctgttcgcgcnctaagcngctgngtgganngctnncggtcnngtcgtaagccggg

SEQ ID NO: 20130 - DNA, 1744 bp, Homo sapiens
  misc_feature (1)...(1744): n = A,T,C or G
atctgtgtctgtggtcttacgtgtcgtgcgcgcttctcgtcgcccgcgtgcgcctgggtactgtctccgttgtctcgccgcattnctcggctcttgccctctgtgcgtgctggctgcggtggttctcgtgcacgttgccgctgcctcgtgtgctcccgtgttgttctctctgttcgcggtgttcctggctcgtgcgcgcgtgtgtgtatgngtgtgagtggtgcggcggcgcgtgtgttgctgtgcgtgctagagatgtgctcgattgtgtcatagtggcgtgcgtcgcgntgcgcgcgtgccgtgacatcacgctatcgcggtggtgctttggttctcgtctcggtcgtattgtgttctgacggatgcngtacgtcgtccgcgcttctctctcgctctgtgcgcagtgtcgctggtcgtgctnctcgcgcggctgtctgttggtgctgcgtcgcgcggctctcgcgccgtgtcgtcgctggtnttcggttcgtggtctntagtcgtctattgcgacgcngttcctnatcgccttcgcgctcagcgtcgcgcgtgtgtcgtcgccgtggttctcgctctccgcgcctcgcccgcctgtcggacgcgtatcctngtatcngngcgtgncgtgcgcggcgctggtctgtcctggcggattagtctgtgtctgtctgtgcgcgaggttactgttgcgtcgtcgtcgatcctcgctcgcgtgtgtgccagtgcgtcctctcgtcngtcgcgccgctgctcncncagtntgcgntgtcgtgncgttttctgtatgtgtcgtctctcgtgcgcctgcgcgcgtctctcgctgcgtntctgtactcgtnggcgctcctcgtgtcgtgtgctgtgctcgtcgnagngcgcgtgtatagcgcgcggctcgcgtgtgcgtattctgtctgcgcggacacgcngcggtgggtctgcactcgatatctcgctcgatctccgcacgcgatcgctctgcttgcatcgttgtagcgcgtgtcggtgtggtggtgtgtcgcgctcgtgtcggctgcggtgctgcgtgtctgtcgcctctcttgcgcgctcgtcgcattggcttcgntnctggccgctttacggcgtgcgcttgctggtctctgtcgtctctgcgtcggtctagagtngntntgtcgtctgtcngcgnttgntgcttgtcgtcgtagatatgatttcngtggcgtctctttgctctttcgctcgctattcatcgtgggtcatgcgagcggtgtgtgtgcgtgctgcgcgtctcggngcggtgtcgtggtgccgtctctgcgtcgtgtcgtccntctcgcgtcgtcgtnctctgcgtcgctccgtcgtgctctcttgccgctgtgcggcggctctcttctccggctgcgtctttgctgctgctgcgctgcgtgctcgtctgggcgtcctgtcgtggctgtccttctggtgtggcgccgcgttgctttcgctgtcgtttccgtctgcccgccctcttgttcgctcgtctcctttgtcgcgtgctttcgcctggtgtcgcgcgtgcgctcgcgcgtcgtgcttgtcgtcctgcggcttntcgcgggcttctcgcgtgtttgtncgccccgtttgacaaacagtgcgttggtggtcgtgttgttttccccgcggcgcgaccgcgccgtgtngcgctgtgtggtgtgtcgcgggcgcgccgcggcgggctgtctccggcgttgatctctgctgtctcgtgttgcgg

SEQ ID NO: 20131 - DNA, 762 bp, Homo sapiens
  misc_feature (1)...(762): n = A,T,C or G
gtcgtagtgcattatatctatgtgtatcatntnagcgatactactaataacatctgtgcgagtccgacagtagngncagcgcgctgcgctgagcgtgagggatagtcaataggcgagagcacgcagtatgatatantagtgaatccctccatctactacagatcngatgccgccgcgccgctccgacgcggtttatggtgctcatgagtatatcgacgtcagagtgtgagantgtccctcgtcatgtgacgagtccgatactgcgtccgtgcgatgatgtcgactatgcccatacgctctcactttgactatttagagctactcgtccgacctatcgtagatcattgagcacgtagncgacgtctacggtcacaggtgatatgttgatcacagcgatacnctgtgcgacgcacgcggacatcatgacgactgttttnacantctcgttcgacgcgatcntctctcgcgcgcgcggcagtcaccacatcccnactcagctctcgncatgcgactgctcatgcagatatgccgtgcatcgtacncctgctgacgttagtgacgcaagcgagtcatgacgattgtttacatggtgatctcatgacgagttccgtacgacngtacanacgcagtcacgcacgcgcatcatagagatatacgtgatgcagtacagaggcggctcagacgatggngcgtcatagattattgttactattgtcgatagtctcagagagaacgaagacagtcacaggaagtaatatccat

SEQ ID NO: 20132 - DNA, 717 bp, Homo sapiens
  misc_feature (1)...(717): n = A,T,C or G
tagttgccgggaccgacagactgagagcagcgactagacgaccgagacaagctgctgtccgcgctctgactgnatttgagtgtacttatcgtcatcggtctccgctctctatacgatagttatgtgagttactggcacgaatcacgagtgtatcgcgctcacgacagcagcgngcggattacagatgtatgccgttacgcactgcgacgtcgacatagtactaactaaagagtgggagctgtgatgtgcgtcnctgcgacatcacgaataaacatgcgcacaggatcagagaacagaggcttcgacagcagaggagcgacagcggccactacagcactagcatcaccatgtgtgtaatgttcgaagttgatgtcggcgagtctctcgatgttcgcagcgatccgtgtaatgacgtagcggttgagtgatacgacgtgaatgacgtacagagagagntaagtctacgaggtgccgctctgcattatcatcgtatggagatgctcggctgctacagcatcactgcacgatgagcgcagacgcatcgcgtaagaggctgagcgccgcacgcagccgcagtgcgcctcatcntacccacgcgcacatctatatactctgccatatnacaactataataacacgacacgtanataataccggcaagagtacgacaaggacgacggaaggcagcgctgggactgagagtacacagtcttcgat

SEQ ID NO: 20133 - DNA, 574 bp, Homo sapiens
  misc_feature (1)...(574): n = A,T,C or G
atcctagactctactacttcactcacgtgtcctctccttcacgcctcgtcgaccgactgcgacatataaagtcctgtgtcactctatagcatgtangaccgtcctaccgctacactctcgcgtctaggacgttactatctctatatccgccgtctcctctcgtcccaaactctaaccgagcacaagaattaacgctaaccaatcacgacgtaatgtgtcttttctccatctagtcgctcataatattgatacatcgagcgcagcgacatgtatgatagttctctcgtctcgacgccaggcggagatgagcagtctgcatgacgttgtatgtcgctgtcgtgtcataagtgctctctgacctctcttttantgcttgcattgcgcagcgagcgtggcgcatagcatacatcgcgcgactntagtatatttaatggtggtggacactgccttcacacgacaatcgtcgaatccgcacggtgcacgtccgctactcgctcacgttcaacaccactagacggatagtcggctcatgtgtgcgggctgagacacgatcagcaaactccccatgacttag

SEQ ID NO: 20134 - DNA, 726 bp, Homo sapiens
ccatctgatttttggcccccaccaggaaccaactgagcgcaagaagacagctcggactccctataatttgattttgggcaatcagcactcctggctcactggcttctctccacccaccaagttctccttaaaaactctgctccccaaatgctcagggagactgatttgagtaataatagaacgccggtcccgcacagccagctttgcgtgaattaccctttctcaattgcaattcccctgtcttgataaatcggctctgtctagcctaggcagcaggcaagatgaaccccttgggccattacatttatgacctgtatcttgtgctgacctgctatctcatcctgtgacagagaatgcctaaccatctgggaatgcagcctagtgggtctcagcctcattttaaccagcccctattcaagatggagttgctctgtttcaaacacctctgacacagctagacagactcttgtcacaaaccattgtctgcactgcaggcccaacagactttgtcccaggcctctgtatactcttcaagcccactgaatcccccttaaaaatcatatactaaccccctaaccttatccacactttgccatctccctttcccctaagaagaagggtatataagcatctgtaccccatggtgcagtggagcaatcagtctgtgatttccccccatgcatgttaataaacgtgcatgccatttctcctaaaaaaaaaaaaaaa

SEQ ID NO: 20135 - DNA, 1342 bp, Homo sapiens
  misc_feature (1)...(1342): n = A,T,C or G
gaaccacgcacagagacacgagaggaagaggangaaaanaanaaaaacagaaannacagaaaaggcncncaaanacaacagcgacaacccaaaaaaaaaccgaggttaaagannnaaaagagagaggngnaggaacagaacagtcttangacgcaaaacatagcacacgcnncgcaagacagaacaaggccacgatagaatcgcggcgaggcacaggcgccgcctccgccgccnacgacggcgcggntcgganncgggtncatattancanacgaacgcggcgaggacggacgcagagcgccaccagaanacccacgagtcgggcgcacgagcgaacacccgngacgacctaggtgcacacctagccaccttcacaccgcgcgagtggcgcgccgcgcgtcccggccggcgcctcgcccagcgcgccgcactcctcccgcggcgcggcgcntttttattgnatcagacgcgcncgcgcataaccaccaaccntactatgttcgtatatccccgtatccccccnacagctccgccgccgacgacaccgagcgcgcgcgttgccacattttcatccaatcaacgatatcaacacancccttcacctctgtgtacaccaaacatcatcgtcactaataataacactgtcgagtangtccgcttcatatcaatttatcggcagccgcgacaccaaacacacacaatcccgccacactgccgcgacacgcccgctcatactccgcgcgcccgccgtcaacctatcacacaaacccgcccgcctcctccctcaccggcgagttctccccgcgagccgcgcgtactagtaatctcccgactcatacatagttccgcgcgcccggatttgtggcgccgcccccgccatatgttcctccccgtcacgcccacgctctccgcgcgcagttatcaccggctcctggtgatgangagtattgcgtcgatacccgccgccatccgcctcgtgtgtgtttctcgcgccccgcgggcccgcgccgcgtgtatgtgcattggtgcacgcgccgcacttatatatcgcgtgcctcttttcgcaggagatccaaatagtaagacaacgactcctggacggcggccgatgacgaactcgcccgttccccgcgccttccgcccggtgtgcgtacatatgccgcacgcccgatcccgcacgatgaaagcgcccgatcgcccgacgcccggccgccgacattccgccgtgtatacccgcgcgcggtgtgcgaggatcgttgcagcgcgcgtgtaatcgcaatgtgtatgtcgtttagcggcacggcacgaatacgctccaacaccgtatattcgccatcaccgc

SEQ ID NO: 20136 - DNA, 930 bp, Homo sapiens
taatctgggcaagatcttggatcgctgagagaattccaagatgctaagctcctacactactttaagaatttggaactgatcgtgaagcaggaagacagaaataagaatttgggaacctgactagctctgcgaaaaacaccaaaggaccgtgttatcgttctctgtctgtgctgcggaggagtgatgcactgggcactgccggtgggccagggggcgggtgctcatgcggacgaaggtgtgcgctcgcgcctccccccaaaaacgctgtgatggtgtgtaccgcccatcggcctcggtttggaactggctcgcccaggacgtcttcggcctcaaggctgctcggctagctcgccctcgctccctgcggggcgtccgctcgttgtcgtgccgcgcgcgtgccgcctggccggtatacccgtcgtgcgccccccgaggatctctcgtggggccgtgttcgctatatggagttcgttctaggctgatctgcgtcctgacgccctcgtggtacaccgcctgccgcgacctcgaccagcgccggagggtgagtccgtctagcgcgcttcatggagaggtgctgcaccgaccgtctcaatcggcgcgtcgcgcgcgcgcgcggcaccgtcggctgccgcaatatctcccccgccgcgcctttctagcgcacgcccccgcccgcccacgtcgtgtccaggagtccggatcgcgactactcagtcgcgacagatgcgcgcctgtgagacgctccggatgtgtgcgacgcacgggccgattgcgtgtgcccgcgcccgcgccgcgcgatacgcggcccgtgttggtttcaagtagtcggcgcggactcctcccctccctccacacacgcccggcgatgatgtgcgcgagcatcgtaatggctccgccgcggtcctccctcccgcccgcgcgcgttccccg

SEQ ID NO: 20137 - DNA, 1131 bp, Homo sapiens
  misc_feature (1)...(1131): n = A,T,C or G
gaacgcgcgctgtggggcgggtaggtggttgctatctcctgggtatgagagcggaaagaatccgagaagaggagtaaacgagaaggtgtcgtgcatggcgcgncgccgcagaggcagtgacttgtgttagtctgtgctgagcgtgcgacaacgaagtccgtaggtgtgggctcgctgcgtgccgggaggataatggtggggagaatctaggacattgcgacgcgtagcgggcccatagtgtgacgagaccgcgcgcgtcaacacgcggaatcgacgtacggcgatctcacagcagtcgaggagcattagtaggtganggcggcacgtgagtgatagaaagcgtagagttaagtttgatgataggggggggtgtaacggaggcgctggacacgattgtgttgagcagccgcgcaaatagtgtgaaggaggtgatttgcgagtccgcgatcgcaacaaaatatagctgggcggattgtgggagtggggtggggagggtgcgcggcgcgcgcgagtgcgcgtcacagatggggtctgggacggtacgaccctcatcgacttcgtggtcgcgtcgcgggtgacgtgggacgataagaaacaataaagaatgtatggggcgtactgatcagaagtgnggaacgacgcgtgacntgcaggggccggctgggagggaggggcgaagaggagggggcagtggcggagacgggagngtgtgtcgtgggggggtcgtgggtgggttataattaaaaagatgttgattaattaataacttttttaattctactttttatactcattcttctctctccactcttttttnncctatccttctcttttctcgctatttgntgtagttgctcatgcggggggtcgccactcgaggtacgcgggcacccgcgcggcgcgggtcttccgtttcctggagcttgtatctcggtcctctgtactgccctcctnctcccgccnntcttnntatttctcctnnncgccttcccgngcnnnnnncccactttngtccctcttcgcnccaaacctttcctcttctttcttcacaccaaaacaattactctttctctaacccctcaccaaaacacttaaaaaaaatatctacaataaaacattctctctcatact

SEQ ID NO: 20138 - DNA, 1015 bp, Homo sapiens
  misc_feature (1)...(1015): n = A,T,C or G
gagggattggcttaagtggaaagaaaaaaaccttcgaggaaacatcttgnacatcttgcaaggaatacacgatgcgnctgggataaaaggtgatcaggaggcttttggcgggtaaagatacacctgtgggcgaagttaacctgcatttaatatccgtaagcatcacggcgaggcctgatatagtagagcgtgggccttcgcctcgcgaattagatgagctgcatggccggcgcctcgataatgggaacaacggttagtcggggtcaccgaccctgttttttgaagacggcacgcggtgacgagccaggcggcggcgccaagaacgtgttgcgggtgcacgtggcgcgggcagaggcacacgtgcggagtggaatatctagagggcgacccggggaggccccgcgccaagctctgatcaaggcactcccgtcagttttgtctccacacactgaaccacacctaaaccctcggagccagaacgtctgacacgtggtcgacaccgcgaccatacctcattgacttcaaacttcctacgttctcagccaggtcttcatactccacctaaccctttacactgccgagccgcggtacgtaagcaaatgcgacgtagaccgtaatctaaactgacggggagaagatgagcaaagccgtactgatcatgcttgagtgtgacaaggttagcagtactgatcaacactgcggctcccgttctgaatctgatacttcccgccggagcgatgtgccgcgagatatagaagagagtagaaagcactagccagtgtgacaaccgcgacactactcaccgcgccacgagaactaaccatcattctactataagcagttgcggactcctgatggccgataaccttcagtagcgcctgtgacggctgaacgtaacgacaagattagcagtgcagacacgcgcgcgcgccgtaaggatggggtggcgaggcgtcaggagagcagtgaaagcgagatgagcaaggatgataatatagatctagtttatataaag

SEQ ID NO: 20139 - DNA, 1681 bp, Homo sapiens
  misc_feature (1)...(1681): n = A,T,C or G
gcaccgcgcggtccacctcgctcccaacacacgagccggcacgcggagangnanaggcgctgcncttttgtnctgnacttnccacgcnccnnaannanccgcttgnnngnngggggngngaaacccnncacgcggcgcacagncgnncnngngcggnantggcggcggccgcgcccaccgcccgcttctctcgccagcaccgaaccgcgccgcgcgccctcgtcggagaccccagccgccgcgcccgtcgcggacgccgagccacgccaccacgcgccccgcgtgtgtnctggtgttgccgcgtggcgtgtcgcctcgcggcagtgacgctggatgcgcgggtgtgcgtagcgcagcgctctctgtcgacctctngcactgcgtgttccgtccacgtgtctcgccgcacgcgccgacgatggtgtcacgtcggcgacggagnccgcgcgatggtctcttttctctcctccagcagcangccaancacccacgacgcncctacacaccacgcgcatccccgcgccctgctccgcgggcgtatccgccggcgccgccgcggcgccgcccggccgtgcctccatcgccgcttcgtgccgccagcgtgttcgtcgcggacgtgtcggcacatctagtagactagttcctccgtgaccggacgcccagccctccactgagctcgacgcatgtcttgtcgtctcatagcgcgtgttgcaggcgccgctagccacgacgtcgtcgtgctgatcgccgggcgcgcgagcgtcgtgtgacangcgtggttgcgcgcgctgtcgccgcacgcgctggtcccgccgtctgcggcactgcgtcctccaccgccgcgcgcgcacgcgccgctgtcaccactgcgacgtgacggcgcgcctcctctcncatcgcggccggcnacctctcgcaccngctgcacactgactagacagtgactctccccgtcgtcgggtggcgcggacgtccgttgacggcgtgttgtgctactcacgtgagagtctcatctagtgccatctgcgtcatgtgtcgacgtacctatgctcagccgccgcgccgcgacttnctcgacgnctagtgccagtgctggttgcgcgtcgctccgctttcggcggcttngagcgcgcccgcgccgcagcggacgnctgcgcgagccgctcctgcaccatcacgcctgccgtacgcagatcgtgagtatagcgcacgtaactctatctacggtcatcggcgtctggcgcgatacgggcaccgcacgtgtacgctgcgactagtcgtcgacacatcntnctacgatgcgcgcgtcccgtgnagcnaggtgctgccccatcgcgcgcacatctgcgctcgcgtcgcatcgtcttcctccaggccgtcctcactgctccgtgcgctcactgctccgcgcgcgcatctcaccaacgcacccnacgtgtcgtgagtctgcncncgcgtcgcgacgcgtactgncngcncgcatcgtgtgcggagatcgtccactcgatgtgtgngatgcgntgactcgcgcaccgtcgacgcgcgctgacatagccggngantgtgagactacgcgacggcgctncgcgncacgcatgcgacgcggcgcgccnacgtagnacgcagacgcanacgcagagagtcgtnagtcgcgtacttcaggtggctcngctcgtatcgt

SEQ ID NO: 20140 - DNA, 805 bp, Homo sapiens
atggtcatgacatggagatgctcacgtgcgaggatctactgtgcactgtctgtatactactcatgatggggagcactttcttcatgcgcatgttgccacccagccactcactagcaagggctattcaccatccatggccatttttttgtatttttaggacagacggtgttcaaacgacgagagcctaccatggcccattatctcgatgacctcatgacacagacaccttggagtgccatagtgtgggactacagattgaaccaccgctcccgggctgctgatacatatacaacatactgacttacatgtaaacatgggatagtctcactagaacaggaagctgtcaagctcaagatcacggtgttggcagactctgtctggtgaaggccaaataaatctaatggctgaaagggtagggggattccctcttgggcctctttgctttcttgaaaataatgtctgccaagatggagggatattttggtgtccagcctgggagtaaactaaggagcccaatgatcctccacacttcactattcaaagtgctgggaagaccggcgtggacccacccgcatggccacgagggccttcatttttaagctaaaaaacaactccatgcccctggccgccgaagccctggaataaaagtggggggggggcgaaacccaacctttttaacgctcattgattgttatcaggatttgaataggaaaatctccactttggggggtgggtttagtggtatgggaaggttaggttgaccacgaagggttcaaataccgactagaacgctccaatacaaaaa

SEQ ID NO: 20141 - DNA, 1530 bp, Homo sapiens
  misc_feature (1)...(1530): n = A,T,C or G
attttttatatttnnnnnnnagagnnnaatatgaanganatagatgagaagagngtganagagttgggtgttgtgtgtgtgagtgtgtgagngntngtgtgtgtgtgttgtgtatgagtattgtatagngtgtattanntagaattgngaanaantgtggtacgagttanatgagaaaatattanaagtgaaanatttnannannntattttnnnngnnanagatgtnnaanannannnantnnnncttntgnnnnnannnnnnagnagnnnnnnatnnntgatnnnnnnnnnnaagggggggnannggaggggntntgaaatgagaggggttatgatatcgtagatattganctgtatatcattgagacanctatagttgagtgtgagtatagaggttatgagatgtcagtagttgtgaggcaagacgatgcaagntggagctagtagagggtaggcacgcggtagatagttagtagatgtgnancaacaacgctcgttgtcaaacattagatcaaccactaatgatatgtcatgtagcgaatcnccccgcgtagccatacgctncggtgcgtgtgcagacgacgtcangcntcgccggcgtctccacctatgcgatgtagctgcctgctcccacaccgcgccngcagtcgtgtgcgccaccagcgtcgccaccacacaccgcaccacgcagagcaccacacactctgtctctancacatctatacgcgcctcgacactgatacttggtntcactctagtctcttcgcnctacatncacgctacttccctcccgcctccggcgcggtcgcattcatccgctcaccgctgcgcacaccgcgtgccactccccctccaacgctcacgccgtctgcgactgtctcanagtgagactgctgccactatatcattctccncacttcnatatccttatacattgtgtcatanctcatacgtgcgcatcgacgtgatgattaacagagtgagctctgcgaatntacgtatgtgcatgcagcacacagtcggcgacaaccgacacgtagtcggcgtgcanccgcgagcatatnattcacacgccgagcagacgtcgntcacgcctcacatctcatgtcagtatacgtcgcccccgcagacgacatgatcgctagatgtccatctactgctctcgaccacagtgtctgtcgggttcggccgaaccactcccccgtcctcctctcctctcttcgcgcgccgtcaatgtccagtacattcggtgcgtatgcaantctctctacaccaagcgnagcacagagtggctcgaancgcacgctgtcgacctatgtcagtccgcggcacgcctcgcagactgcaataatctgtcgtgtactactgtcctcaggtctcgctcggtcacgcggtagtggtanccagcagatgcggtgtctcgacactcgcgcacgcgggctcgcgagtagttccgacgtgatgtcacacctcttcccctgtcttcgtgcatcgcccacgcaggctgccagttataactctgagtcct

SEQ ID NO: 20142 - DNA, 742 bp, Homo sapiens
gttttcaatggtacttgtcgttttgttatttcaagtactatgtcccttttccaatttttttctgtaccggtttctaccatgtgcaaaatctgccaagctccattttttgaggagaatccccattgtttgctaaagaacatgtaaaaggtgggatctaaggtgtgcagaatcttgttggtctgccggttcaaagggatccgcaagatggggaccttaataagcagctgagattctcgactttcggaaggcaaggtagaacaaattcaaaggtgttggaagaaaatggtgtgttaaggtaccatttcctctgaatgacagaaaggtaatgggaattgttccttgggcctctgcttattcaaagaaatagtattcgtggaaatggagtctactcccaggctcaggttggttttaaggtagggggtcccaacttttctcggcaagaaacattcccaagttctgggattaccggctggagcctccatgcatggccgcaatggcagccatccttatccttatggatgatcccatctccaccaggaggaggcatgcccatatgcaatggttggggggaccctataaccgcttggacaagaagcaggcatctcttatataggcatatgatgaacagatatcccccgctcagtgggtggtcttttcatgtgtcccgacagattactttgtcccagctatagtttgttaatttcgatttaaacccattcaattccaaaaaaaaaaaaaaaaa

SEQ ID NO: 20143 - DNA, 1657 bp, Homo sapiens
  misc_feature (1)...(1657): n = A,T,C or G
agtttnnaaaangtggagaangagaggnannnannaaaanggagagtgannnanngagagagtatgagaagtggnnagagangngatgganaagnnnanagaaggananngangnnnnnnnagagagnnnnnnnnaaaagaannaannnnnnnngagnanaananngagnnnnnnagtgaaaananagagagtgnnnnannnnnnagaaggagaatgggagtaaagtgagaananannananagaaagatgagnnannaananataggagnanannnaagnanaagagacagagaaagaagtgaagaagagataggtagaanagnnnaaggagagaganagagaagannaagaggnngagagcagcagcagcaaagataaatagagtcaacgcngataagtnacacacaacggagagtcnctaacgtgnntctcagcgtcctcgctgggcggcggtcgctgncgcgcggagctnnctaacagagtacgcgcgtgacgacgaggagaaggccgtcgactgcnacagacacgtaggaccaccgacacccaagcgtagctctcgagctgnccccttctccaccgagcgcacgagncccacatgccncgcgacgcccctcggcgccnnaccagaagcgtaccacannncatcgaaacagcttaggttnnctccagctgcgttgtctagctctgagtgtgctctctntcgtgtcatcgcgcgacggcactgcgagcaaccgacngcgctcgcaagagatatatagtcaccactcgcnccgcagagagcgnacggacgcgcgaagagtcgagcgatagtcgcggaatgtntttagagagagaagcannacgcctctatggagacgtcgaaatggtacaatgcagcactnnnnaaaacgcgagaantgtatgannactactactatcgtttgtctgttgtaggtgtagatactnacgatgtgtaggttgagattggagtcgcgagatcacattagatgaggagaaaggagcgatgtccncgcacgtgacagatcgcgtgaagtgttcaatcgacaatagccagtaggtgatgtagtcnntcctnctcgtgcttccggactgncgcttttcgtgttgtctantnagtatatttcatctactaccaaatgcgagcgaaactatacatctcgtatacgaacgtacacgaatatcaacatgtatcataatctcatcacacgcaatagactaatgtatggtataatcnatatatcanacttctatacatatggtagcgcaagagtcntagtacctctatcactttatattctaatcatatgtttctcgcggtgttaattaatgaaatatatgttntcanncactaagtctaatctgtattctatccgactntcactcacagatagcattncactagtgtaacaagcagagatnanatatgnncatagagaggagatgatgtcgatcagtgtgatagagagagccncnctcctccgtgagagtctacctacagtcttatcgattatttattcacncagtagaccacacctgttgtcgtcgtgtgcacactatnnttattccgtgagatatagcgcacgatngtgtgcntncgaatgcacagcacgtgctngtgnccgctctctatcattactcgctcgcacatcgagtcc

SEQ ID NO: 20144 - DNA, 1531 bp, Homo sapiens
  misc_feature (1)...(1531): n = A,T,C or G
acccaacacagtaccgccggagagcgcaacgaagagaccaggagagacccctcaaaggacgacaaccagacnccctaacgggnttcnccaagaactgcnagacctacctgggtagnaacagcagatatcctncaccactactcngctngtgagctgaaagcgtcgatcgcgaagggtagcgacngctngacaggagagcacgagcgaacgatgacgatacacgcntcgacgctatncactagcgagactacngcgtccacaacgctccatagccctactgtacacgacacggaacacgcacacgtgacgcgnangctaaggcgctagacgactcgactcgcgagcggtgcagagtgaggcnacggnatgcgcagcccagtcgagtacggcacacatncgaaacctctgccacggacgacgatacatagacacagntgactacagacaacgaccgcgctnagacaacaccgcagacagcacgtgcactgactcacgcacgtgcgagcgnagccgttgcgacctcgcacagcgacgacgcgaaccacnacgacgcgccaaagtaagacccagtcacgcgcacgcgacacgccactacgcacaacacaccccgaagacatgcgaccgcgtcagccgcacgagacggcgacgcaccgccgacgagacgcatacgaccacacacgaccgtccacaacggcgcgcgcacaccgtctgaagtcaacgcgctgnagtgatgcagtcncgtcaggagacgagtgaatgtgcgagcacaggcggcgaccgcacccagcgcgacgcggcgcgacaccacacccagcgagatgtcatacaaggcgccacgacccctccaaanccgcgtgcgccgcgacgcccgacgcgcgagacgcnctcgcacgtgcaccacgccgcacnccaacagcgacggagccgcgcacgacggcgacagcgtggcgtcgcncnaccgtgcgctccgccacctgcactcnccgcgtagtatgagagcacaccacagcaccgctccagctcgatcgagcgagtgaagaganactgagtgggngcgacgcaccaccaggggnagtcatgcagagacagctcacacgtaagcaangcanacgaactcgcgaccaacgagcgagcagacacgatagtaggagcggcagcntnncgtcaggatctgtccacggctatatcgcgcagcgcatgacgcacaggatcgagcgcgccgagcgatgagatccagacatcatatgaaagacntatcacncaggagaacagaggctactacgtagcgtctatggcacagacacgcacgctcgccggcgacgatgagagacgatncgaggtcgagcctctacgagctccagtagggtcgagcgcgagcgagatgatgaccgagaaagaggagacatcacacgnacgtcctggagcgcatctcgcgcctcacgaggcgtgcgtcgcgcgggcgncgcnaccgcggacacgcgagtagacgcggccgacggcgcgcgacgaccctacgacantaagagccgag

SEQ ID NO: 20145 - DNA, 1456 bp, Homo sapiens
  misc_feature (1)...(1456): n = A,T,C or G
agtcacgtgcgacagactgtgaacacggactgatcgaggagccaacagcatatgcacgacgacctgtcgatacatgatatgcaanacaacnacatcanagacgcgaatgacaacgcgatancgatgttcgtgcaacggcatgcgatctccagtatactgcctcagaagagatacgcacacacatcattcgtactatctagttantgcggaagtgacgagacgggnacgcggcgctaggtgaccgnacgcgatctgtgtgtganagatcgtgaganaccgtgtgccatctgccgcgacgatacactgtgcactctaactcacctgcacgagtaatagaactggtgtagagacaccagtacatctgcgctcatgagacacagatacgtatactcgccatcgtctcttantnagactctcactcgcacgacaacaccggtctacactaacagcgtatatagactccagatacagtatcataattatacatcagcagcacctctggaaacgtatgcgtagtgttgcgccgacctatgtcgccctatcgactntccgtcatcgatcgatgttgtgcgttattaatcacccttacacatatcagtcgcttctctcgctactactatgaagaggctggtagtcactcgagatataacgagacgnatactgaaacgacgatccagcgtcgccgcataagtctcactctccgatatacatacggcgcggagatgtgcagcgcgagacatgaagaaagaggaggtggggagagtgaggcgcgtcgtgaggcggaagcaattaaaactgccccgatcagcggggcccgtctaanaaaaaagactcggttgtcatgcaccacacagaacattcgtcgctaaaagatagaaacggcctacgtgaatgtaaacggagtgtctcgggatgcggcccgccgcgccctccccctgcactacatcccggggtgcgcgtgtaccactgcgaccgccgcccgcgtactcagcgacaataactgacaaatcgctactctcaaataattcagccgcagcacgcgccggcacaacatcaccccacctgcgctgcgagncgacgacgcgtcgcgccgcagggcggcgcgacgggagtgcggttgcacactattaactatagctgaatgatcataagtaccgatcggggcgggggtaggcgcggatncatgcggcgtgtggtgcgcgcgtgtcgcgcggccgcttgcgtgctgcgcggcgcctgtcgcgcgcggcgccgcgagcggcgccgtggcgttgcacggccgcgctcgtccgtgngcgtcggccggttnncgtcgcggnttgcnnnnnnnnnctgtcttttcnnnnngcnttgnncnncnnccnnncgnnntnnncacnncgccncctcccctannttcnnttcctntctcncnnntctnnnnnccccnnnnnntttnnnnnncccccccnncccc

SEQ ID NO: 20146 - DNA, 1869 bp, Homo sapiens
  misc_feature (1)...(1869): n = A,T,C or G
actcgcggttcggattcgacgttgcgggctgtgtngctgcgtggtgggtgtggttgtggtagcgcgcgcgctgcgcgcccgctcttggtgcgtgtgctgcgccacaaaacataatacagtcggtactatcatttatatagttagacaancaaataacggagactatgcgcgnagtaagtattgtataanagcggagagtgnaagtgtcgcacggacagngtatgagtcncgtatnactgtngtattactagagtagtgtgactcgatgctgtcatancacgctaccgcagagcgttgaccagtatgtgttnagtagcgtgagagcgaggcgctgattgcgcncacgcactcgtcngcagagtgacacntgtcgagtattcntcgcatgccttgancagtccacgtggtctatccacatcactacacttctcgatngtacacactgncactcgtcgcgcataatatgcgtnagcttagcagacgcgggacgagtgntgtgtgcagagtgagagatagtantgtgtagctctctacgacagancgtgtttggaataacgtacgagtntgagtatgtgacaatcagcatatcnctancaccancacacacactagcgatatcatcttttcgtacacacacntgagtagctgaaagtatgcatcgtctcgagaacagtgtatctntactggtcgtttagtagagcgtgtaganatattacgcagtaatgtacntgtctgaatanantgagaatgatagagtatcgacagaacntctggatacacagaactcgcgagactgtgcgctgccgcagccgtacgacgatcanacgtaaagaaacgantgatcacaaantagaagcactgtcctacgtctangagtaacngctgtgagtgtgtcgaanctccacagacgcagaancgactgtcgnacagatatctactagtgctactatcacacatcgtgtatactgtcgtcataactagngtgcttgtgcttatacaagacgtnctatagctnataacgtagaagaganacagtgccgaggttgggcactagaggaacantaantcatagcgcacntnagtgcgtcgatangatatactcgcgtcatatctctactcaacatacactacacctgtacgtaatgcancgtgcgcgctgcgcgtgacaacacgatgagttgtctatgtgtagcgcatgacacaatagtcctnacaatctcacatacctcgancntacgcatcgaccgtngactgagcagaacggcgcgtggagcgtcgattgtcgcatcagtgagtgcgcgctacgtctgcgaccgactacagcntcactcgctcactcagtatcgtcactagatacatcacgtaggacgtactatgtgctgntgtacgctcntcngaagtctcantncagagacggatgttatagactatctagggatatcgactgatccacganacgtcctagagtgtgtcantacantctnactcagtatntntntgcgtgnatcaatacgtggtcgatggtaatatctggaatacatgtgatcactatctcacntctnggactgcagcgtgctcgagcgcgtggatcgcgttacacatagcatcagcagtgcncccactcgagacgacgtgactanacntaagtacttgatgtatacttattaatcacattcacagtgctgatatctaaatcagtaacancagctatgctgtacagcactntgctacgtgtggngtgtncgtagaacaccacacactcatatagaacgaatactcatgatagctagatagaagtatgttcagcgaaantaaatatantaganagagtntatacaacttctttgtgtgttgtattattgtctgttg

SEQ ID NO: 20147 - DNA, 880 bp, Homo sapiens
  misc_feature (1)...(880): n = A,T,C or G
gtaacgtcactgtccattttntttggttccttctctccagaatacgattcccttctctgtcaaacttggtgaaggtggccgggagctcagtgatttcatgctctgcgtgtcccagtctgagaagaggatgatgaaatgatttctgcccagctgtggctgtgacctctcagttatggacttcctcactcttttgcttgactctggcaaaagctcttgcttgtggtaaagattggttctacaaaggctaggcatcttaccccgcaggaaaacacttaggctacgcggagggctcttcttagtgaccctgagtgctcgctgcgcaggccgtgcggcctcatgacgcgttagagggattatgcgcgacggctgcgcacccagcgcggagctgggtgtggcccgggctcccgcgtcgcccgagtgccggctcggggcccgacgcgatcggctgagcatggccatgcgcggtgctggccaggcgcccggggacactggccggtggcgggggcggcgcgcgggggtcggcgtccggcgcgcccgggtgcgcgggcttggagataggggcgcgggcccgccgccggcggggggggcgcgcgtcctggcggcggggggggccccctcgcctgttcgctccggggcgccgccgcgccagcgatagcggggcggggcccgcgcgtcgcacgccgcgcggcgccgcgcgagtggcgtggggcgggcgcgcgagccggccgggcaccggcggcgggcggcggcgggagcgggcgggggggcgcgcggccgccggcggtgcgggggcggtggggggcggtgcggcgggtcggggagggcgggacggccccgggcggctggggcgggccgggcggggggcgccgcccgcgcgcgg

SEQ ID NO: 20148 - DNA, 266 bp, Homo sapiens
ctttctgggtacgccatgcaccagcgtgaaaagaagcgagccggaactagctaaagatgtgatagaactgtggatctgcatgtgcatcacccttccttgttataagacaccaactgcttgaagacataaggatgtatcagttcccccatttgacagatatgaagagcattttaagaggtgcagcctctggaagtggatcaaactagaactcatatgccatactagatatgagtgttatgatacttatgacgtgaaaaaaaaaaaaa

SEQ ID NO: 20149 - DNA, 1232 bp, Homo sapiens
  misc_feature (1)...(1232): n = A,T,C or G
gggtgtggccgcgggncttctgagggatttcgtcggtnggtgtggccgtctgtagacgtgggcggacgntcactatgagcggagtaggaggttaggggcgtgcgggcgcgggcgggtggggtggactgcgcacgngagctgtggtacacctganatagtggtagggggtgcggatagnnggggtgggggtgcgatggacaagggcgtcgatgagggcggggtagagggtganggcagctgtgagacatatgtgagacggttctgcatggngtggtggtggaagagtggtggtggtggagacgcatgacggctcataagtnaaaatnccactacatnnaactgtgtatngcatcacatcagttgngacatgtgacggatnttgtgctgtattataatgtttannnnaattcacatctgctcgtatctgtcttcctgatanntcctataaccgnaactagagtacgcagtggnatcatagtctactcgatcactacttnacttatagcactantatctattaccggcatctannacaagtgacctatgatcgtcctcgcttnngcgtgatgtgctctcgctgttactgacggccgtcgtgggttnnatgtaagagactctnagctgttacgtagttnagctctggngctcgcgncgaccacgtgcacgtcgacgaggcaggtggctattcacgccttganaaatcatgtganggtacaatcttatctctaacaatacatcttcgtnnctctctgnctctgttattacaatcacgattactcatttttcgttctgacactcttcactttnatagttccgtnctttttncatcttnnntaattattataaaacttatcttcatcaccttgtattcctataaactctatttgtgctttccatatctaanncaagttggggcaacactatatatatagtagtcatcgttatattanctaattatagtataagctagattagtgaccatgtaaaagactctaccacacagacgaattaattaacatacatgtaacagtctaaagcgtaggattacctttctacggtctagtagcatactacgtgtgtttacagtactgtctatcacggctcacttcctgcatcaagaagagcaggtggcaatactacaancaatcttagattttactactatcctttattctctcnnctcnccctctctatcttctcntccctattctcccnnnnnccctaaccccctt

SEQ ID NO: 20150 - DNA, 939 bp, Homo sapiens
  misc_feature (1)...(939): n = A,T,C or G
accacccgtccgaagtaaacacacaacaaacaaaaccctataggggacttccctgtaatgctgcgctgaggaacgtggcacaagtgccatcgtaggggtacctcctgtttcccaaaacctctcaatgaaccctatgctgctactgactggacgcacctggaagggagctattcttggtggctataaaagtaaagaatgtgacccaaaacttgcggctgattttatggctaagaagttttcattggatgcattaataacccatgttttattttttgaaaaaaaaatgaaggatttgacctgcttcactctgggcaatagatccgcaccattctgatgttttgcgacaatacaaacgtcttcccttgcagctaacttaagactcctataccctacatagatatggaagaaaaactggcaactaacattaatccacgtcaccacaatcgtattcaatatattacattcggcggacttccaaagaactgcacaaaacgtacatctatttctaacggaattgtccaaatatcaatagaaatataaataatgtactcacactccacacaagtaaccacaagattctcgtggtctcaaactcggccactctcgcccgaccacgttattccagattcaccacagaaccgattgttatataatatcatgatacctcacgcgctcgtcgacttgtcttgctgtctcctgctctggtccgtcgatgcctgtgctcgtttgcccttgccgcactccgccctgtatccccttccgcaatgttcagcgcatagacatcatcctcgtatgtgattctatctctgacatatgcccggattccaccccgcttacacgatacacatttctccggctcctccatcctncacattgtctgtttatctcactgtcaccctatcttccttctctcctcgcgcaacatgctacttactcata

SEQ ID NO: 20151 - DNA, 1573 bp, Homo sapiens
  misc_feature (1)...(1573): n = A,T,C or G
caaagagatctacgacacgacagttgctacacgtgtgcgtgacanctacatcgtactcttctgcatctcatccaccatcagacgatatctagcactgcgagcgccttcactgccgcatcacatacacatattggttatattgaagctcgcatangttaagtatcttgtcgtttatacttacgctcgactctcggcgctcctagctgcttcacctagcgtgtatccatagtcgcgtagtatacccttgtctcatgtctatccgtccacgaagagcganggtctgattaaagtgcagagaaagcaagagcatatgtntagacagataganactatatcgtacgcgctcgcatcccacagacctacacatcatcaggcctcactcggctacgcactgctctcgctgctgaattcaatacttatatcttagtaccttatctacnacagtcngagactagagcaggatatcgctantggagcgacggagggtcgataaataagatacagggaaagatgaccgatcgttatgttgcgcganagtgangtacangaacctatgtgattgcgtcattagtgcgtgtgttatgtgttttgtatgttgattctctatgggtaatgacgtgtgtgcgtgtctgtatgagtgtttgacgtagaatgtgtgttattataggtcgaggatattgagtatctcgacagatatgaagtgtgacgtgagaatcgaacaaccaattntgaaactatacattagtacacaatatgatatgaatgctaagacactaatgttatatgcgatatctctagatctatgtcttctgtttctactatttcttcttgttactatatatcctcaantgtagtgtgcatgtcttgtctattntattgcgtggatcggtgacatgtgaggcgcgtaatagtcatatatcagtctactacagtacgatagcaacgtaagttatgcagtctcactgacaataatactgaaagtgctgtgttattatcgcagggcgaggtcttgagtcaacacgcgatgnagataaattcagagagcgttcgcacgtgtagtagagctgccaganacgacatcgctcgtcacgangngtcggcggccacatcctccacgtctgccatgntttccatatcatgacagacctaacgcgcacgtacaatctcgtagggcatcgtgtgtcgtggccatgagctgtacacagacagaacgagtcggctcatatgacttacatcgcttacaacatatgtcaccacgacgacgcacaacacgtcatgtnacgtcancagcgtatgtcgataacggaagagtgacagtagagtgncttggacaatgtntgcgaccgactatgcgcgcctcagctgtcacatatcacacgtggncgagcncacaatgcatatcggcgaggatgtctagaatagncacgactaaccagtactacagtcgcgctcacattgtgtacgcgccgatctcacagaagacaccttatctactgcagcgagntacgatgtatctccttgatacgatgaggtgagagaagcgagttactagagtgcgtccgtaggatagcag

SEQ ID NO: 20152 - DNA, 779 bp, Homo sapiens
gggggtatatttttgcggcttctaaaaaagcgcggaattcccctctgcccggggggggtataagggcccttaccccccgccttaaaaccccccaaatgttttttctggagcccctggggataaacccccgggggggataccacaggtttttttggccacaaaaggcccccctccaaacgtgtttttggtccccctattttttccccccctttaaagagcccgtttttattttttccagctcacgcgaaaagtgccccggggcaaacaaaaccccgggtgggggaaaaagcccccccataggggggcggggttcccaaaaaaacccctttttttttatttttggggggccccttaaaaaacccggtttcccccctgggcccttttttgtgggcccccaaaaaaagatttttcccgccttttttttttttcaaaaccccaaaaaaggggttttaaggggcccaccccgggaacccaaaatttgggactattgggaaacgggaaaaccggtttttatgggtcccaaaaatttccccctttttggggtgggccccctgagggcctcccctttttaaggtttttttaccgggggtttttaaaaattcccccccccccgggggaaaaagggttttggtccaaaaaaagggggggattttctgggccccgccaaaaaaccctttccttgtttttttttaaaaaaaaaaaaaaaaaaaaaaaaaaaaaaaaaaaaaaaaaaaaaaaaaaaaaaaaaaaaaaaaaaaaagaaaaaaaaaaaaaaaaaa

SEQ ID NO: 20153 - DNA, 1792 bp, Homo sapiens
  misc_feature (1)...(1792): n = A,T,C or G
cgggtcgctngtgcgcattgtatcgacatctctcggttactaccgtctatcagtganacctcgctctggctgctcgngggatacatcgtgtcgtcgctgagatacttcccggcaacacacgacacanatgcgtcaaacgcgctcctcgcagactgtcggccgaccgttcanntacgtactctacacactcgggnngagagtatgtgctggatgcggtgcgcacatgccatgtgggagactagtctgtatagtggnnagcgtcgtagagcacgggggtgcgagagaangcgaatcagtgctgaggtgtgcgcgagcggatgaggtggnncgtctctaggcagttcgataactgtatannacgacactcgntacattntnancatacctcgtgttanagatctaaatataatatatggtacgacgcggatanactgctatgtggctatncatacgcaagactcgcaacatanaacgtcatgtgacgtnatctatccattgtanactcatgnnngacttcacattanaaccgtctatattgctgcagtnacttacatcangttnnnntatcatgtagattntatatattctatgtacgtganagtntactagagtaatntantctaacaacatncntnactgctgcactatcactatacgactgtnnnacatcaactacatatacaatanctctctcctaactantgcatatattatcgcacttcanancactcgtcatnacnttcttcatacntctcatganttacctacgnagtanacacagtcgcacgacacgatctcgtgngctacctacgagtaagcgacatgcacacgatatncanccagactaacgacacaatataacatgnnancaagaggtcgnaccagtctanacgtctgtgtctactgcatngnagcgatgcacgcggcgtgagnnacagacactccgtacgatatgtacgccccgcgcgctagcagcctctacttcactncgcgcncgtaccatctagcanganattcgtactagctgcnctagcnagagctctccaacaacgtgtacacgtctatatgtngtatatctanatcagancnatcaactcaggcgaantactctacatagcacaggnncgcacactctacactagttacacttatcatcatcattatctctnccattctcntannccactaatataaattnntatctctatattagattcaaaacagtatatgnacnatntatatatatcatatgatctctcncactaccngctcattctcactctnntnaacgattctcatcgccgngcgtnngatcgtacgtgcgtgctntgnntggtcattagcntactcgccgctatcctcagcgtgggattagcacatcgtcatgcatatgctgatcatcagagtactcacacaggaaacagaaccatttgcgtccacaacaactanacactatcattctnancacctatacctnagctatatcatcttanaactatatctatngacnataaaatannatatctatcgtnanagaccagtctgttagtttactataaacatacgtaaacatctctactcncgcgttactannacacctactcaatacanctcatcanacnnnnacatctctnttntacntnncccatctntntatcccatttcttctcaatcnctnnncatttctncnttnnnnnnnnnnnacctnnncnccttctcaatcttnnnnnnnncnnnnnnnnnnnnnnnttttnnnnntnnnnnnnnnnnnnnnnnnnnnccccccncccta

SEQ ID NO: 20154 - DNA, 2011 bp, Homo sapiens
  misc_feature (1)...(2011): n = A,T,C or G
gagcgtatgtgtgatggtatcagatgaatgtgctgacgagatgacgccttgngaggagtggtgagttctcttcagcgtggnacagacccatctgagaggttagaanggcgaagatgttcgatgagacttgtttaacatcactagagatganatactaatacgaagtgctagcgatcaacgcgagagagccgagcaagcgaacgaagntacgacgaatcatgagagacagctcactanancatatcgcgtcgcatctctagcgtccagcttctgtgcgcgagtaatagcgtagtactntatcgtacagtgatctgagaacgcagcangacacgcacagaagagtcccggcgcgagctcntgatagctgctcatgacgtcaaaccacgatgtagcacatcgacacagcgtgatagtatcagttggntacacacatgacatacatgtgtagcaacatgtcgttatcgtgcgtnagncnagcgaacgtcatgctggtggacgcacgacatagatatacaccacgtgtgtcnacagatgatgctgnananagaancacnacgcagtatactggtgattgatgtaaagaatatgantnactcttatcgaacgtacagatcactnacactctccagccgccgaccctacgatgtgtgactcatccncgctcgcntagacggctcgtgtacntcgtctcntggtcgtcatatanactggnacgtgtcaacgctgcgcgcgcgtacgtgcgactagattagacatacggagtacgaacgtcaggcatngntcanaaagtaccgcatatacgcgtctatgtcacgngangtgagttagtgtgatagtgacatcgacatatcgaggactgtgtgnacatcgacacgcntacacatcatagagatgattgtcgtcatggtatncgctgntgacatgactccgtctagccactgttatcgacagatacanatcgctagcgtcntcgagacacatgcgagtgtagaatgtgngatanctgagtntanctttattgtggtacaacggcgcatgactcgcagtgtgacgctgtctgtcatagtgcgactatacgtacgcatcagcgaccaccgcgcnagaangtcaancacgcatcacactagaggacatgtatctcaactgtacgtacgtgtgcactcngnctagtcagctactcgtgtcttccgtatcgcctccacntacngtcgcgtcatgcactgacaatcacgtgtgctcgcacccgtncagtgcgacgccgcagtgtcgtnacgactagctatactcagtgtactatcttgacgtgagcacgnagcgtcagaangatagcgactacgcgntgntagatgcgtaagacggtgcnacgagtgcgcgcgcgagaactgacgcctatgcacgtcagctcgccgcgtgcgagaccgagatctacatcgctacgcactcancncgctcatctnatcgtcaatgatcanactcacacacacgagtgcacgattgantctagatagtaactagtgtacaactcatacatngtacgtntactctctagttnatagacaattcgatgtcgtagncntantcgacantatangcagtgnaccagcagancagcgtcgtagtagagatgacgactatcatactcatccantggntnctntatangcgtacgtcgcagacagcgtctagcgntcagcactcacgacgacgctcaccactagcttcngagatagtgcatancancatctaaactggcggcagngcagntaggtcatgtcgttnantgaatggangccgtcggtagatcaagagttgatcgtangcgactgtgatgagtatcgcgantgcgangngacgtcactncataccanctatcatacgacgtgcatcagatacacagatcgcgatacantncgtattagatcntgcggcgngntcgtactgtcagagtgtgtntgctgcgtgcgactgtgatacgagtngtggcagtgcncantnagtncgtggatacatg

SEQ ID NO: 20155 - DNA, 264 bp, Homo sapiens
tcagactttgtcctgcaaatcactctagtagaagaactcagaacaatgatacatactgcagtatggagtctgggcttacctgcactggtgcctgcaccagacgtgaggtctccacccatcagaccacctatggattaaagaggaagatcaaaacgagaaaggctaaaggcccacagaacaaaacactttaccttcagcaacctcagtattttgtcctcttgcaatagtcataaacttgtaaagtacaacccaaaaaaaaaaaaa

SEQ ID NO: 20156 - DNA, 954 bp, Homo sapiens
tttcagatacacttgactctagtgactgggacagatagccactgtgtacctgcttcaaatcatcctgatcgttttctctttggaaggataagcgctgtagaaccatctcgctaccttcagcagaaatggtatcaaattaagacattaacaatgtcgcaccgtgtcagtatctatgcaaggttcagcagaggatgttttcatgatggtgtgccttactagccattaatcagaaaagatcgaagctggcgcttttcatctcaccctgctccttatattaaagcatctcctccaaattaatgtcttttgaaacttgcattgcttttgatcttaattgaatgcttactatttgtgaaccactgtaattatatgggaagaagatgtgggaaacacagtatgtgagccttgtttaaataaatttggagttggttttagggtacattgttgctcctttcgatgcaacctttgcgtttccccaataccactcaattctcgtgtgagtgtcgtatcagtctcatcctcaacacttccttatatcctcacactctactgccactattaccagttagcgagacttacgtagaactcgccatatattacgtgatatgcgccctctccgtccacccgtcgtgccctgtgccgtctctccccttttcctccggtgccattcaatctctcttcctcccttcacttctctctgtcccgtccccttcgttcgtactgagtgcttcttctcgacgtcccccggcattccctgttgactaccaacgcaccgtgcttcaaccgtgtgctctgcctctatacgctacgccgcacgcgcgccgatcgcgcggcggtggatgcgcgttgccaacacatgtcacccgctcgcgcctcgtgttactgtcgtcgtctcgccacgtgcactgctctcgcattctcttctgcgcgctcgtctccaccgccctcgcctctcct

SEQ ID NO: 20157 - DNA, 1618 bp, Homo sapiens
  misc_feature (1)...(1618): n = A,T,C or G
cgagcggcgcncgctcgcgtggcgntctcctcgtgtcgtctctcgcgtcgtgtctngcgcgctggcgncncgcgcgccgtcccgacgtctcctgctggcatcgncggncccgctgngntncgtgcgcgcgtcggcgccgctgcngctcgctcggtgtgngagtgcgcnggtcgcgtcggnncgcgcctcgcgacgctngcgcgctgctgcgctgcgctgcgtnctcgctcgctctcgtcgacgtcgactgntgtgtcgcgctgcgctgccgnagcgtgtgcggcgcgcgctgtgcgcggtcntnatgcgctcgcgtngggtganctgctgngcggcgtngcgntcganngcgtcncgcgcgcgntcgctgtncngcatctctcagtcgcgcgcgtccgcgcggcgcggctgcggcgtgntgcgcgcctcgcgctctcgcgcgccgcgcgcgctcgcanccgcccctggcncgcctctaccgcattcgctctgntctctaccgncaccnaccgnctgctcctncttgcacntngctctctnctctctcttcgtccgaccctnctcctcgctcccctctcgcgacntctctctntctcctcctactcacctacactaccccgctcctanttccacctnctccacctcncctctccctcgtcacacttgtccgtgcgcctctcgtttgccnctcgcantctgatattgtnttgatgcagtgagctgctgnggccgtacctcatctcgctntatctctatgtatncntcgtgctatctctcctcgtctgcgtccgtctccgcgctcgaccgctcttctgcctcctgcatgctcctctcnccctccatgcgnctcncgccgcatgnnnggctcttgtccctactcgtcgtacntggtccgcggcgtcgcttgcncccgctcctgcggcgctgggtctagtcctcgcgctgcttgctccgtctgcgngngggccgtgcgcctccgcctgntcgctctgctnggngngcgctggttcgcgtctagtgcttccgtcgtgtcatnccctcgctatccctcttccgttngctgcgcggctcgcgcgctgccgtgagngcgatgcgctcacgcatctnctccaccgcgcccactccgctccttaaataaaactcttctctcctccccctcttcttcttctctctccctntncccntgctcgccctcgcgcctnngtnttntntcctcgtnttctntcgcccgctgcgnccgtnngncccncggctccctctcggccgctcctctcgctncccgtcccctccgctggcttcgtctccgcgcgcgtgtgtncnggnnncgcgtccgnnnncnncccccncncncnccgnncccgncnnnnnnnncnccncccccccnncggggcgtttccccccgcccnccncncnnnngagggggnccccgcgnncccgcnnngncnncnnncgcnnncnccnnngnnccgcnnnnggtttcnnccccnnnnnaaagngnnnnntttttttttnnngttnnttctntnttaaggtttttttctctctttctttctttntctctccctcccctccncccctcttnttttcttctcctctnctncctttttcctcccatccc

SEQ ID NO: 20158 - DNA, 1376 bp, Homo sapiens
  misc_feature (1)...(1376): n = A,T,C or G
acacctcactctacagtccgttcatgtactgaaggcgcgaggagtgagactgccgacntncgtagttgacgcggtcactgcgcgtagaatgcgtcgcatactacctntcttctagcgnctgcctcgtcgttcgcgctcactgactgantgcagcacctgtgtaagtacgcgacgctcgcgcttcgtgtcagctctgtcgctgtcgtgtcgtgtcgtactgtgcgatagaccgctgacgcttctccactantaagtgttacgtgcanagatcgaggcgactactagaacacgtgtgagaataatgtattgactatgtcgaatgatcgagtnagccgcgcatcatagtgagatcgcactgatanaagacgtagatatcagtgatggnanangcatacggatggtgctgctgtatatcacatcgcctagacatgactagatttcctacgagcgcggtggtgtgtgaaagcgtgaggcgacacgcttcgatgagatagaacatcntatganatatgtactacgaagatcgggatgtgcgcagcagccgcgctacgctccgcgtagcacggcaccctacggcgcgtggtgctggcgcgacgagatagcatatgagtgtgacgtgntgaagtgagtgagatgaagtaataagaattaataggtgcgcagagagtagctggcganangagctacatgtgacgacgtaactgagtgatgagtcacacataccgcacgacacatcctctgctatctacacttctcgcgtcgtctcggctctctcgtccgcctcccgtgcgctcgtgccgtagactcgagctgtaccaacggtcgcgacacgaccgctcttgcgcgcnggccgctgccggcgctgcgcctcgggcccggcctgcgcccgcgtgctgggnctgtggtgtgcgtgtgtgtgggcgtttgtttggtgggccatcatctatatacctttcagtggggcgtttatattagtttattattattattattattattatatattttaatatatataattataatatatatangangacaagaacgacttaactcccacntcccgtctcctgtctcccgcccacaatctctactttcttcttctgcgatgtcctgcctctccatactgtttcgtacctatctgctttctctcctgcgacgccgggcgcttcggggtgtgtcgtggtggtggggttgnctnnnngtttgggggtgngggggtggtgtgcgggnggggtnggattgaggtggtnggcgcgnnncggtagaantgctttcatnnnngacntcnccntacaataccgccttcaccnntactaaaatacattaccacctcactcacaccatctctctcttctccaccnccccttcccttc

SEQ ID NO: 20159 - DNA, 1033 bp, Homo sapiens
  misc_feature (1)...(1033): n = A,T,C or G
tatctttctatacctataacacacaacaaaaacacngtgatctggaacaatgggcaaaacgttgtgagcagggccggagctgatcataaccttccaggcacagctggttatggcggtcaggaaccccataggcgaggtgtgtggagggtgacccggacaaggtgctccggttgctgttcgtttgtggcgctatgcccacactattactagctcagtctcttcgctgtctgacagtctcctgcacatctatcgctacagtcaataactatattttctgaccgcggtggcgtaccaaggcaaatcagaattgcgaaatcatgaccataagacctgcaacccctcttcgcgctacttctgcaactttggccacacccaatgctcgactcctttccttcattcccttactcatactaagcacgatcgcctcgtaacgaattgctgactccgtactcatgtccgcccacaccgcccctcctcactccattccctcattctcgactcccatcgcctttgcgctctcgttcgtcgatccgccccacctattttgtcttattatccacacgcctctagattagagacttagtccccccgctcaccactgtccctcctcctcctctctataatgtcgtgcctcgtctccccgtcccgtccatactaccacactttgcccttatctgatttatctatctctgtgcactcgcctcttctccgatccagacttcgccaccgttctcctccctgctcatcgtctgcataattgggccgtaccctcaggtcttcttcctcttcactcgtatatattaatttcgaacaaattacttgcacgccccgcgatccttcaccacggggcgctcccagccgattatctgtctcggattctcccatcctgtctgagacaacgccgattctacactcgtccgccctgatgtaccaaccgaggtgactcgtcatccctctatccaaccatntccatccccctgctcagcgagcacgctgtgcccttcgtcctttctgttctcctctgtgcagatgg

SEQ ID NO: 20160 - DNA, 928 bp, Homo sapiens
  misc_feature (1)...(928): n = A,T,C or G
cgcggtgtgcctcgtccttcgctttgtcttccttggcgtttcgtggggtantcccgtcgtgtggcgttggtcttctgtttgccgtccgtgctggaacgctcgtttctttctggttggccttctctctctcctcccgcctcggggctgcctccccctgtgctcgctggcgcctcttccgcgctggtcggtgttctgggtgagcgcgggccgcttgggcgggtgtggcgggtggtggcggngggtgctttgtctgtgtcttgtgtctggggtggtctgccggtcgttggtcttcgccgcgtggggggccctctttgtgccctggggggtgctgggtgttcgtttgtggctgggtggtgtgtgctggcggggttgttcgtgtttgtttgcgctgtgtgtgtctggcgcgcctgggctctgggggtttcgggcttggggtggcgggctcgggggtcgcccccgccgggggcgctgtgttggtcttgctcgttctggcgtctcttgttctgcctcctncgtctttctttcgcctttctctctgttttgcccttcctcggtcctttgtccccttggccttgttgtggnttttggtggcccccttgtgcctgtcttcttcctctcgcgcctcggtctgtggccgcgcgcttgggtcgctgtccttctgggtctgaagcggggtgtttccgggtggcggccttcgctggtggtctgggcggcggcttggtgggggcccttgtcggcgtcctgcgggctcttgtnccttctccttcttgggctggttccttggcggtgcgtctccgggttggggtgtgttcgccctttggggttggggctcttttgcttctccctgtttntntnttgtttcgccggcaaggggtgggcttccccccaggggtcctgctttgtgtgtttgtctcttctgggccttgtt

SEQ ID NO: 20161 - DNA, 1742 bp, Homo sapiens
  misc_feature (1)...(1742): n = A,T,C or G
agactgtatgtctcacagcgagtattggtgtgttgcattatatacgatcatcttcagactacctgtantgattcatgcgatggatntactcgattnacacgtgagtgctgatctagtatacacgatanattntnttgagatagtctatataatacatagtgaggacatatggttctctctactccgtgtagtgcgagtacgtgcagagcgaggtgatganggtgtgctcaccacaattatagttatactcttagtgtcaactcgtacgcgagtgtatacagtacatgtcgtattgagtattataagtgacggaggtgcgatgntacgagtgctgtgcnacgtacatcacgtcgcagatcacatagtgagttagnatgtgncgcgcggagtactatagatgtctnagtgagctagttcgtacacatatctncgcgtgcgctgtgtcggctcagaggagatgttagagtcacgctgaatgtgatgcagagaggtctgtnctcgatagctatgatatctgcantcactgatagatcatgctctacgtgacatcgactactgagcatagctggnnnactctcctcgcactacgcacangtcgtgcgcactagtcatnagcgtatgngactntagcanaacnacattcncgacgtgctgccactcgagcgtcgtgntgtcgagctgcgaccactcacntaagancacacgatggcagagctncattgctactacagcatacatgtntacatctatcataactgcntcaccactgcaaactcgcgctgnttcatactgcgcatgtgtctatacatntacgatactgntgatctacacatctagagttgtctatgttgttatctctgttctatgtcgatgcgaagtacgctgtgttgatgatctacatggtctagacattccagtatatggagtatcgcggcaagcacgagcgatggantgtgatgagctcggatagtnggtgttagagctgtgtagatagcgtagagtatgctagtaatggatgtntgagatgtatatgcggcatnatgcattgnacacatggctgagactggtgcgtagtgcggcgacgtacgatgctctatntctacctatgtcgtacgatagctcagatctcatcanatcgcgtcagagatganangnnatgngcattcatctcatcttcgaatgttgctantcgttatacgatgcgtatactgngacgtatagaccgtcgactgatgcgcctgtactggacctacctgaacgtcgatgtctatngtacgattatgttctatagtatcgatgtgtcgtatctctaatgatggatagcgctatacatcagcacatgtctgcagcanacactgatatcagatgcagtgtggcgtgtccggatggatagacgtccgctccggacgctatgacgtgtgaggaacatgcgtgtgtacgctcatgagagctacgcgtatgcactcagcnactagtgtcgtgtgtgtgctgtgatacgncactcatctctctatatatcacagacagtatagtattgaatggttcgtttgtctcatagtgactcatacagtcaatataggacgcagatatcgtgtttctgtctgcttgngcctgtaaccataccgttgtgtgngagnctggttcntcngcctcatntagcgctcgtgtagtatgtcgcgtctacattcactcaggtagtgtatgatatagatagatatatgtgcatatctcagtcgtgtcgc

SEQ ID NO: 20162 - DNA, 913 bp, Homo sapiens
  misc_feature (1)...(913): n = A,T,C or G
cgctacgtctctagtcatacactaagaaacgaatgagtaactatcctaaatactgcaattcaatcgcataatagtaaatacactagtgcacgagatgcgaccgtgatcgatgtnaaaactaatgtacgcatctatatcaataaacaccgatattgggacctactcatcngatgagcggagatgtgataaaatcctcaacgagataactactgtcgtaatacatcaatacaaaaatctatcatatcatatcacctgtaatacctatatataatctaaactctgtagaattgatatatatccgatccaaataaaatgagataaagtctaactattaatataaactaaatattaaaaaaacgcgacaaatctcactttcatgtcatacaacggtctacatctacatacatatagattgtaaaccggactattgactgacttctgccttccacactcccagatattcatcatcaagctaaatccgtaagaaaaaaataacaactgcgtcacgtcatttttgggcgcttgttgttaattccataaacagattagatataaattaaactttagagtttactgtcaaattcttccttgcgattttcttcatgtcattttatgtaatctattattgacactccttatacatttggtctcgcatccaatatttcatatatgtattaagcatttttattcaaatatatttttggttgatgcctactatcgccggcataagttcttcttttaggttaactcttattgcctttttctatttcatataaaaaattagaatcaattggagtctagcagaggctctatgccactcctcttcttttttttcgggtttattcgggcgctttaaaagtgttttgccttttttttgtccgtcgctgtnctccttngttctcnccngtaaacg

SEQ ID NO: 20163 - DNA, 1176 bp, Homo sapiens
  misc_feature (1)...(1176): n = A,T,C or G
aaaaaaagaggntgtgnggggtntgtttctccgcgcccgcacgccncaccccccccgcgcgcgcacccaacccagagaacggggcctgagaggggaggaccaggggggggggaggccttcngcgggcggggggacccggcgggcgggggaggcgcgagaggaacacaacggcagaaatctaacaggggggngcnnagcgcgaggnggcggangngggccgggggcggggcgccccggcggcaccgggancgcgccgcgcgcccggacgcggcccggcacgggcggggggcggggangagagggcaagggggaagacaagagccaccccacccccccccccccccccccccccgcccccccccccccgccaccgccccgcccaccccccaccaccgcgcgccgccgccggccccgcgaccagagccagcggcccaggaggggggagaggagagccaggaggagcgccggggggcggggggaaggacagccagagagagagcgggggcggagcggcgaganncggcagggggcggcggcgcgcccgcgggggccnccgcgagggcaggggcgggcgccgacgggaaggagggggcgcgcgcggagcacccacgccccgcaacgcagagcggggggccgcgacgcccacgccccaccaccccgaccccgcaggcncccccgccgaacccccgacgcgccacggggcgccgggccgcgacggccgcgcgccaggncccagcgggacggcgagagcccgccgctagccgcccaccgcacccgacgcgagggcgnncagcaagcggggggcgagagaggcagagagggagcggnncgcgggagcctcccacgcgacggccgcagcgggcgagcntagcgggcgcgcagacgccctcagcgacgagaggcgggagagccggggcagcagacggaccggcacgcaacagggacccgcaacgncggagcaccaagcagacaaggcggccacacaggcagcagacaagacccgcttacaccgcgacgggagcagcggngccgcagagccgactcacaccgcgcgcggctccgagcggcgaacgaacgccttccgcagagagacagggagcgcacagccggccgagaggagcgcgacagagggagaacaacgagacaaccaccaagaacggaagcaaacgcacagcg

SEQ ID NO: 20164 - DNA, 578 bp, Homo sapiens
  misc_feature (1)...(578): n = A,T,C or G
anattggttntaaaaaaaaaaaacatgttttttgaaaaaggtcccaatccnaggaaattattggnccnaagntnntnccaacnaaaaaaggggtnaaatcccccnccnccagggggntttnttggggggaaaaaccctttncaaanagggttggggttttttttntcccccnaggnaaaatgggaaaggaannaaattgggaaatttcaaaaagaacttctttttaaaaagggtgnccntcaagcaagttgccttnccaatttatgccaagcccttacagaggttaanacttgaatagtaaatatgtcttctgagtttaacagtgtcttaaactcaatgcacatttttttttttctttttccaccccttcttgtttgtagttcattaacctgtcctatnacagaactgatttccttcctggctgtacatgttggggtgctggatttttttccgtgtctttagtcttccataaatccacacacacacacacaaaaaatatatatatatataaatatatatgtaggatacatgttctcttctttagcttgtggtgaatacagtaatttgcactgaagaat

SEQ ID NO: 20165 - DNA, 887 bp, Homo sapiens
tcagggcttttagcagactgaagccatggtttttagttttgtctctagtgatgagcagaaaagagggatgaggaagaggctggacgtgggccaaccagaaagagaagctaagaacccatgactggattctctcccttggacaccccacagaccagtatcttaccttccaggagaagacccttccagctcttgcttctttaaacctattaacttaggtttctttagctagactaccaaacatcagctgggagcattcagcctatgtttcaatcactatggcaagatgaccattccggtagtgtgtgaacccccactggccatctttgggctttgaagtatacccactcgaggctcgcggaccttcctccacaccccactcgatccatgggcttgatatacgatgtagacccctaagccaggcctcagctcaggtctcagacgccgcctccccgcaggacccccccccccgtgttctggtaggagcctcagctaacggcggcgctcgcataggatgcctcacttcgtcgggcgatcctcgtcgaagacgtcacagtaatgatcacctgccacttcttgtgccacggcgtcgaccgcgtctgcctcgctaggtccagacacgtgtggaaacacgcggcgagccggccctgccttacacacaccacgacgacgtgcccaccacgccgccactcttccatctgcacacgccgcacatccgatccacacggccgtgccgaccgtcatacgcgcctagcgcgtccgcggcgccttctgagacggtactaccacggtgccgcacctacgcctctgaccctacatggagaatcgcgaagtcccgccgcctccagcgacgtccgcccttgcttgcgtcattcgcgccccctctcctt

SEQ ID NO: 20166 - DNA, 931 bp, Homo sapiens
ttagactcaattcctgaagattgtcaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttatagtattccgtgcgacaaaatccccaccacctttataaccatccaccacaatctaattcttgactatataaatcgatggtttgataatattatcactctcgaaccacctgacatttttttcacagctcggctattatgtgaccccacgtgcccccacacctgatttgtctcgtaaacctgtaaccaaataggtcactcccttcgggccctcgaccactaaagcacaagacaatcaacacggccctcctcccctcgcacatttcattttggcctcagcccgtcctgcgcctcgcataccgtcgcccactcccccttgtgttcctcgaccccccacctacccgactgcccccacccacatgcctctcctttctcgtaccccagcatcgtgcctcccgttcaacgcacttttgcgtgttctgctctcaccgcctcgacccacccctagcacgtccatagccacttctacccgcatcctgccctatcatcgaagtcacccctcacctatcacggtcctatcattcactcccgaagcaccctgagcgtgatgctcttcccctc

SEQ ID NO: 20167 - DNA, 747 bp, Homo sapiens
attatggtcatcatggcggtgttatccattttctggacaccctcacaatgtggttatccttctcttttcgaatcaatccatcttatttggaatgactgtgagcggagcaagcatctggacctggtcatgctggtgacagaggtgatcgcctactcccactgctgcacgaacccggtgatctacgccttgttggagagaggttccggaagtacctgcgccacttcttccacaggcacatgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacatcttcacacaataaaaaaaaaaaaaaaaaa

SEQ ID NO: 20168 - DNA, 251 bp, Homo sapiens
ttgctaggtacccatacccgtagtgccgtacgaaccaatgacaacatttgttgtctgtaatgaatgtggaaatcgatggaagttctgctgagctggaagaattgcaaaaatatctggaccattcataaaactgatccttcacatatactaaacacctatgccaatcaccaacatcctactgccaccccacatacttaacgtcacttgtagtccgaccacaaccttccccactccacctccctcttttacac

SEQ ID NO: 20169 - DNA, 301 bp, Homo sapiens
acagttgccttttcgggccttgtcttcccgacgttctacttggcgggcaagctgcagtgcttcaccgagagtgggcggggaaagagctggcggctctgtgctgccatccctgcccttgaactcgaccatgatgatcgccctgtaccgtatgcgcgactacaagcatcactgccaagatctctctcgcgggagcacacacccgcactcactccctcgcctcccatctgctacagacagcttctccagtcctctcgcccaccccacgcacccactaccccctcctacccactctcctcacctc

SEQ ID NO: 20170 - DNA, 1139 bp, Homo sapiens
  misc_feature (1)...(1139): n = A,T,C or G
cgccgctatccccgagctacccgcgccggccgtctacgctcaccgcgccgatgtatttcgtaggcgcagatctgctctggacttgtagactatgtgctgtgggtacagcgtcttcagttgctcgccattcgacacgcacnaaactcttctctaatcgacaaaaacgcatcctgctaagtccttgcaatactcgctaatctctacggacttagcatacctagctagcacagagcatccatcggtcatcaccacctgctaccagtggtaccctcgcgccgcccttgaccgacgactgttgtctcgcgcgtccgccgctgcccggcacgcggcgccgccactgcatctccacgtgtgttgtcgtggggcctcgccgcgccgcatgtgggcgctcgctccccgccgcctccgccggtgtaccttccccgcgctcaccccgtccgccacccacgtcgccgtgtcgctgtcggtcccctcgcgttccacgtctcctgtcgcgtccccgccgccccccgccccagtcccgccgcacgcacatcgtgtgactacctctccctacagaatacgtggcccgcatctcacttcactgcccccccccccccgctccggcccggcttatccccccgccgcgcaccggccccgcacccaccccctcccttggcggagtgcccgtgtggagccagcccgccccggctccgccgcgtgcgcagaccccgcgcctcgacgcgggggggctgagcctcgtatatcctcccgcgtctcggcccccgccgtcgccctgccgaccccgtcctccctcatcccgtgccgccgggctccaggtagtccggagtatatgcgcgcgcgccgtgagcaccgcccgacgctatcgccgcgcgccgccgtgcgcgtcgtcccggcgccgcgcgctcccgtccgcctgccacgccatagtgcagctatcccacaggtcacaccgccagcgcatcccgccgcattttgnacgccgaggctctctcgtccacgcgcccgcgctgcgaggcgcgtgttgcccgttggtgccggggccggcgccactgtcggcggttcattgttcctccgtcagattcgtgttcgcgctcgcgcacacaccgggcgcccaactctggcgtatgcgcggccgt

SEQ ID NO: 20171 - DNA, 949 bp, Homo sapiens
tttctcgccacggcacaacgccaccttgggcaaacctaattccagtcttggatgccaccttgctgacgacaaggcacttccttacaatgagcctggaattctaagcagcagcttcacaatctgcaattgcacgtttctgccctttacaataaagaaacacacactttcctttcaccacccacacccaccaaaaataccaccacactccaacacaccccacgaagaaagcgagaaagcccaaaactgggccccccaccacaaccgcacccccacgaatctgtcatacatccacaagacacccgggccctctgagcacccacggcgaacggccgccaagccgccacccccctcccaggcggcagcccccacatgcgccacgtcgtacatcacgtcacccaacgccaccgacctatgcgcaatcgcgcgcatagccccgtactcgggccagcagccccaccccagccagccacactgctccccctcgcacaccacaccaagatcgcgcgacccaacgcacccactccgcaccacaccccacaccacccccaccccgctcgaccagcatgtgtcacaaccccgtacccgcaccctgagtaccacgaaacggacaggctaacgacgcgaagtacctcacccacccgaccgaacgcgatccacggtcccgtaagcgctaattccagactacacccccatagctcgccgcaatggtctgcacgtccaccccacaccaacagagatcactacagaaatatgcctccaaccccgcccacgttaaactccccactccacacgcagcaatgtcactcggcaccgcgcctttcacggtgtgacaggtcttctccatagatgtcggatcggcctccttactacctccccccttacgaaagagtacacactccacaaccacagacctccgcccaaggcgccgcccgcgcgccccgcgcacgtg

SEQ ID NO: 20172 - DNA, 983 bp, Homo sapiens
  misc_feature (1)...(983): n = A,T,C or G
gcaccaccccacaagtgcacgcccacactttgggaaagctaattccagctcttggatgcaacacttgctgacgacaaggcacttccttacaatgagcctggaatctaagcaggaggttacaatctgtaattgcacgtttctgccctttacaataaagaaatacacaatcttcctttcaaaaaaatcaaacacccatcccacgccactcacacgtaaaaaccgccaaacaggaacaaattacatcaccacatactaccaacctctttgacagaataggggggggggcacacagtgcccgcaccaacacctcgcgtgcgcttctctccctcccaccaccggacactggcgtacctccctcactatggggggggccaacaacccacccccggcaaccaccaccaagataaccccctccccttcgccgcgggcataccggtccctcgtcccctctacgctcctcactcgaggctctccaataaaaaccagggtggaccaccaataggacattgtgtgctcaacagctcctctcacacccaccaccaccctaaaaagaccgaactttacctgagttaatactccatcgccctcccccccatcttctccataataacaatcctattacatctacctacggccacacacgcgcctacccacacccgcgcacactacactacgtacgcctacacacaatgcagtccttaccacgcctgcgcactcatctaccgcgcccanatccccctacccctctcactgccttccctcttctcaccatcagcggcacgacgcaacgtattagttgcagtactaaatcgaagatcccaacccccacctaccctcctacatctactcaaccttccctcctcttccgcnacaacactcacaactatctgcgctacacactatgtgtgaccatattgtcagatggctgctgccacacggaacatgcctcattctcgactcaatctactacccgctatctatcc

SEQ ID NO: 20173 - DNA, 1420 bp, Homo sapiens
  misc_feature (1)...(1420): n = A,T,C or G
caagttgttatagttgttttgcatcatagataatcagtgtaaagtcaacgacatatgtgttgaagaacaggtattacttatcactgttncgcattccactgtgatgtagtaggatagtcgttcagactgtactaagagaataggtgatacgaagtacggaagacacgcaggacgaacatcgagacgcttattacttatgaatagcgtcggcgtgaggtgtccacagtctgttgtnagttctcggcttacccacnacgttgtactgctgcagcgacccctataagctcctcgcgcttctcctcatcatgtgctctaggcacaggcagacgacagtggcgcgcagaagtcacgcaaggtctctccttcttgttatcgcgactggtccncagatcctctaatcattccacatttcgatacgataaggcagatgtgctagatgcgagtgcgggtcgcngagcagnttacgctgtcgcagancagacgcgctcccatcagagtcatgacgaggcaccgccgacgcgctcgtgactctatcgcccctggtcactcacgccgactccgctcgtcgatgatattggtcttgtgtacnctcncacgtcaattgtccatacggagcagctgtgcgtagacaatcccattatattacatattcgtatagcgacgtgatgttccgcgcccccactctctaagcaagcactcagcctcaacaacgaccactacgactcttcctccgctcgcacgtcctgtcaatcgttcgtgcttccgcacgctctctagtcgctctagagatattcaccggtcaacacatgaatgtgatcatcgtaccagacggtactatcttctaggtcncagtgtactagtatgtataacggatgcgactaagatgtcgtaccatcgtcgatgtgtcactagttaccttatcgattacnggtcgtaccgtaacggtatatttgttcactctgcatcctatncaatacgagtcgatctgcggcgccctacgtagcgtgcgtcatccaatgatggcatgtagcagagtactcatcatatcgattacgataaactatgagatctcnaagaatagctatcgtcctcttcttcggttacagtctctcgtcgatgtaggcgctatatagtatcgtgctactctcgaaccacagacaagcacaagagatatcagcaactaccgcactgtcngaggtgctacatcatcaagtactatcagcctgatctagactatacaatcatgcaatcancatgttctcgtatccgttcttgaggaagactgttgtatcaggattcgccatgtggtcncgctatgtattcttcatgagcgtannactatgctcttgaaacgtgcagcggtatgntggataatatgtataccaacggcnactatgatagtcgataggacncaactcgg

SEQ ID NO: 20174 - DNA, 203 bp, Homo sapiens
attaaatacaacattaaaaacacaaaaaaacttccagctcacactaggaactttacccagctgaacgaatccttgggagtggaatgaaaaccatttcaaatttgaagtgaaacaactcagaaacagaaactcaaataccacactgttctcactcacaggctggaagctaaatacagagtcccagatggacaaaaaaaaaaaaa

SEQ ID NO: 20175 - DNA, 870 bp, Homo sapiens
gagcccatgttgagccggagagggaatgagtaatggactcagtttggttttagtcctcatggcctcctgtggatataaggatatctgtatgtggaaggattaagagctcccccaggcagctataagaatattttagttgttttcttatcaagttcctcaacctttatttttaatgaaggaggtgctgagttttgtatctttttaatcataatcagcatgagtttttgacccaactaaccttgactgtattcaaacttatgagagtataaaggatctggacggtggcgatatgactgacaaggaaaggctgtggccacctgatgacccttgccctttttatttaacccgacacacactgactcgcattcagatgtagcacacgcgctttggcttcgggcgtgggactactagctctgacaatcttgagactcgccctctaggatgctatcctaagaccacctgatccccacgaaatcgctcctaatcctcttgcccgccccccgtttttgtgtaaaccggaatcttgccccctccattgtctaagaaaggacccagtcaatcgcacgctcctcccggatccctcacgcccgtacccccccttcccccctccctcccaccgcacccccccctcctgccctttcttctactaactgtcccctccctcccgccccgcgcaccccacccccgccccaccactcctaccccccccccaacccccgccctcacccaccacccggtcatactttaacaccttctatgaccgctcgctctcccattatacggtccccccccccccacccccccccattcttatactccccctacctcgcttgtacttctgttctatcacccgtgtcctcgtccctcctt

SEQ ID NO: 20176 - DNA, 899 bp, Homo sapiens
tcttgagtacttgagctgggccttgaacgagctacagtgtgtgcagaagggtgagaaggaggggcgtggtcggacccagtggatcgagggtgatgagctgcacctggagatgagagtggaaggtgtggtctgcaagcaagtattcaagacggtgcagtgaggcccacgcatacaaccttgtcccaaggaatcagcacgatgtgtgggccaggatccccctctttgttcctcccgacgcaaaaatgtccaaccccccccaggccctctgccagcagagtctgtctcttggctttcccacttttccttttcttaacacacagccctgcctttcacgccattctgtgccccacaacacccccctcccccggccctccttgttctcccccgcaggctcttctacgttccttctcccttccccaggcctatatacccaccctcccctcacctccctcacttcccccccgctcccccccccgcgccccccccaaccccccttcacacactcctttttccctccttccacccccctctacccccccccctctcacacttgtcccccttctcccccattacttcccaaacctcctctctgcccctccctcccgcttattctcttttctccacctctttactggtcccaccaggactcttctccacctctccctgtccccctcctacccactccctgtcccgaatcatctctcaccgcctcatctactccttctcatccctcacgtcccccccatcttactccccatgctcctatctattcactctcgcccacccacccccacaccaactcttcaaccacccttttaatccaatatatcataccgttatcccaccaccccccccacacccctctacctcccttctaacgcactcccaccctctccatg

SEQ ID NO: 20177 - DNA, 224 bp, Homo sapiens
atgaccccagatgcctaccataagatcacactacccttgcttcatggcattggttgacatgaacccttgcatacatggctcccttaactaaatctccacgcattttgggaaagtttcacgcttgcattcacatctcctagtgcaaccacacggcgaagatcactatatgaggacaactcttcgctaggaatagcaaagctaattcacagtccacacgatgcacc

SEQ ID NO: 20178 - DNA, 899 bp, Homo sapiens
attccacgatcacaacaaaagaacaaccctattgcaaccactgaagatgttaaggggctcaccacctcactccactgattgctgcagctaaggaggtttcaaagaacaatcaccactaccacactcaccccagcctcattgtgccaagccttctgtgagataaatgcacatttcagaaattccaactcctgacgccctcttctgcttgcattgattctaccatcatcctgatctagcactgctcacgactctgatttttttaaaccgcgtcgccaccatcgaagacaactgcacctgacagactaatcatatgatggaacatcacttaatccggcctttacttccaattaatacatatgatggacgcataataaccccagctggtacgtatacacgcactttcacccacccaactaaacaccacgaccacatatccaataccatttagactaaaaaaacttagtattcccggcacatgttaattgcatttaaattaccgtcttacaatccatgctgccccactcccttgcacccccacctatatattgccccccacgtataatcaaccgaacgacccgttgtaacacaaatcaaagtataatccgtcaaacacacaagaacacaaacgatatgcctcaccggctccccaagttatactcgacccccccagcgaacaaacctctctacaaatacactataccagttgtcacatagcccccttatttcatacatctctcattcctcccaatcaccaatcatcgctcgtcccaccgttccttatatattttaaactcgcctcacaatgtaactcatccacaacaaatcactcgcgctccccccccacacctcccacccataataaattatttaatccaatcaccaatcagacgagtaccaat

SEQ ID NO: 20179 - DNA, 852 bp, Homo sapiens
  misc_feature (1)...(852): n = A,T,C or G
ctcagagtaacttcaatgagcttcttgnaggataccagactctataaccgccaccacaatcaagatatcaaagttttatcaccccacaaaattccctcatacccctttgtagaaaattctcgcccacacccagccacagacaaccactaatctgctttctgcccctatagttttttgcctttttcaaaatattgtgtaaatgaaatatcgccttttatgtctggcttctttcatttttcgtgatacttttgagactcacccaagttgttgcatgtatcagtagctttgatccttttcattcgagcagtattccattgtttagagatcacacaatttgttcatcaatctactacctgagttgatgttcttctgggtcattcatcatacacgggtcggattactcgatcctccaattccgtgccgcccatgtaatagcacaaatccatacctcctccgtctcgccccatattctgccttcttctacaataacccgcgacttcttgttaagcaccgctactcgtttcttcccctatctccctaccctcttaacaccctatctatataaatacaagacatcaacaggcattatctcctctctctcacctattacttaccccactcccaccttcccaccataacaacacctcccatatccactcaccccacgttctagtccattacaactcagaccacccacacaataatcaccctgtggcgtccccttcggcccacttcgcaaccaccccccccccgcacccttcttatcttcttacctcgctcaactctgcacacgtcattcaatgctacccctttgtaacaatacacatcaaccagctgcaacacattacacag

SEQ ID NO: 20180 - DNA, 892 bp, Homo sapiens
cctctggctactaaagtggtgactagcagaagtcacagaccgtgacttggccttgtgttgctggaagcgtatgttggcagagccacagcgttgcagccctgacaagatcaagcaaaagtttcctgtctatcacatttgaaagtcttttttcacatcaaggactgggcatgtagattcttttgtagtctggacaaatcacctacttgcgccatctttcgttaggatttcttttttatatcttttgtatcctttctttcaaaacttctatatccttatattttacatgcggctcttcgcccccacacatcccctgaaccctgcccttgcttcacccaacctggccatgccactctttacctcccatactcccttcctttacccacccccgccctacctatatatgagcacacaaccctcatgcccctttacctccccttcgcgcctcccccttcctacccccttctcctcctccccctctcctcactccctcctcttcaaccctcctctatgttacctccactccctaccacaaacatatacagactctttctgtcacacaaacacaccactccctccacctcccccttcccattcttaccctccccctccacctctcttttaacctatatctccccccctcacctcaacctgcaacttatcactatccattaccttccacactctgtcatcacgcccatcacccaccacccatcacatctatctacagccgctctctccctcaacccccacatccactccatacactacatccccccccccatgctattctccaccctctcactacccctccctcgatttcccccctgccccacacccctctccaccacatcacccaccatcctcactcatcacaacaacaatccaccacgct

SEQ ID NO: 20181 - DNA, 936 bp, Homo sapiens
ctcaggatacaacaccaggctattgcttcaggaagccagacttgacccagacttgaccttgcaaaaaatagcaaccccttcagaactggtaaagcaatgagaaagaattgctcagaacttcatggagctgagccattcacccatcccggaacatccaccttcctctggaattatttttttaatgtttttttccttcttgtttaatccactaattctctctcttttcctctgtttctctctctctcatctctgttcctttccatagcaacatagactatatatgagtaaatatttgaatatatttaataataaaagtacatacacaaacatctacagaactgctcactcagaaaaaacacacttaatatataatcgtccaccactggtcttgatgtgctgtaatccggatttccaccaaatgagtcccagttacacttttatgtgtttttcccctgctcgcttacctctttcatcttttctccctatactacacaaatcacccctcccccctccccccctcctacctcaaccgcgcacatcttctcaatcacactaatagaaaatctgcctctcctggactctacccctatattaccactgctacccccaccccctcctcccgacgcgcctacattctcctcctccaccaattcctccttctccacccacccccacccaccctccaactccttcctacctctttccattgtcccacctcctctctctccctcctcctccacattctctattatactttatacatctctcgtcatccttcctctctcacccttcactctcttcttctctccctctttcatccgcaccccgcctcctcaacttccagtgctcaattccaatcttctttcttctcccatcacatatcgtctctacatgccacacccccctcacctttatatctcttactccttctacccc

SEQ ID NO: 20182 - DNA, 152 bp, Homo sapiens
ccttcagggctaccgattctcaagccttgctcttgcagcgcactgatattcaggatgcaggagaagagtactttgcaattaaatcagaataaaagcagttttttccaaatctgaagaataaaattgagctaatggacagaaaaaaaaaaaaa

SEQ ID NO: 20183 - DNA, 241 bp, Homo sapiens
tagatctcatcagatgaaggataaataaacgtgtctctcaaagccatctttgttcgaagaagtttccttcgcactacaaatctaaagttctttctacgaacatcttgtatgaattgatacctgattaagcgcatctaactacgtatttgtatatgtgtctcattgcctcataaaaatccagaagtctttaaatgtgattcaaaaccaacaaaaaatcaaataaacatttaaataaattagt

SEQ ID NO: 20184 - DNA, 1160 bp, Homo sapiens
  misc_feature (1)...(1160): n = A,T,C or G
tagagaatgtgaattctngtgtgtgcgagcacccaacccaagccctcgagtgtggatacggngatgaaagnagacctttacatnatcgcatcaacccaagaacgagtatcggacatgcgcatcgctctaccctagagacatagcaacttgcacctcgacatgtcgccgcaacactacgcacaggtggcccaccactggtcacgcgcagatccaatgacgcgtcgatctcctcccgaccaggccagccgactcataaccgacgcgatacggagagggtcgcgcgcaggcagctcaccccccgtgctactatcacccccacatgaggagtgcgatcgcccgaatagaagtacggttcctccctcccgacaacgggacgccccaatattcaaacgagttcctactaggcttatgacagagcgcccccccgtctacccagctggagccatatattcagacgagaacggcagaacccaccggcggctcgacggctcgagcatagaaccggaacaaggatacagaagtactaactcgcgtagacccggtgcggaaggctacgaaagttcaagagcacacgcgaggagtcccccgcgacaccagcgccccgctagacgataattcctaacagcacgcccgactatgcaactgccttctgtcgatgcgacccctcgctacgaaaccgacctcaggtagcgacgttacgttgctgccgcgtgcgttacacgcagtacgctcagggtcagacggagcnctcttagcgtgcgcagatcaaacacacaagcacgaccagatatgacgatgtncaaaagaagaaggggacgacacccgcgcggaggcgctcgtgatcggcggactgagcacacgggactcacacccaaggcgcgcccgccactgcccagcacccagcgcctcccgcgggcagcgcctcccactacaatttctcgcgacattcgggtacgtcactttcgttccacccccatcaccactcgtgcagccgctggaaacgaatgcccccgaggaaaattcggaactaagtgaaataatggaacaaaccacgtgtgggcgacccattagaacggatacgaccaatgtacccccatttacaattatgagggaagacccgaatttatgtattgtagattgtacccaccgcccgacacacg

SEQ ID NO: 20185 - DNA, 301 bp, Homo sapiens
cttcaggagacttctgcagagagatactcgggttgctgtttaatcatcagagacactcagttgtagctggagacatgaagacatataacagacacgtctataaacttcatcatgaaagctaccatgaaatgtactccaagaagtacaaaatgttcatctattgatatgttgacaagataacttttactcatagggcgggaatcccctggtcattcgcttccttgaacactgtttatgatcaactccatgatcgcgcacaatacatactcactccaccttttcccgcgcaatgtcccacact

SEQ ID NO: 20186 - DNA, 899 bp, Homo sapiens
tttcaggatgaagacattgaaggctgtgaaagtcaaaggaggctcggcgcagtggctcatgcctataatcccagcactttgggaggcctaggtgggcagatgacctgaggttgggagttcaagaccagcctgaccaacatgaagaaaccccgtctctagtaaaatacaaaattagttgggcgtggtgacatttgcctgtagtcccagctactcaggacgctgaggcaggagaaccacttgaacctgggaggcagaggttgtggtgagccaacatcatgccattgcactccagtctgggcaacaggagtgaaactctgtccccccaccaaaaaaaagtaaacaaaacacatgacattgtaatcaaaatagccattcttacctaccatggaaatgcaaactatgtgccctgcttgacaatctgttctgataattatgcaatgcccttcttggattctgcgactcactggcgttgctcttacaaaaaacaaaaacacggccccactggcctcaccgctggattcctcaccattattcccttttgtgagggccttttatttgtctccattgcctcactccccggccctccccacccctcttgcgcttaccggcctcctctccttcattgcgttcgtcccgtttcctccacatctcgggatcctcgtggagactccacctcctcctttgcgctcgtcacgcccttatctggacacagccgagagcatctatttattaaactcccacaccctcctcccccccctcttcctcgcctctccatgttccccactccgattctcagttacattatgaccctacgctcccacccgcacctttcttatccaccctcgccccccccacagtgtctgcatcccgcccccttctccctcccgacatccccctat

SEQ ID NO: 20187 - DNA, 1630 bp, Homo sapiens
  misc_feature (1)...(1630): n = A,T,C or G
atatctatagtttgtatgtgtacagatatctgacgtattcacatcgtaatcactgctagcctgtacncgncttgcagacgtgtagtcagcactaagagacnatactggncgcaccnctncgatgcgtcgtttacatgagnatnctaaggcgctactcggcgnacagntatgtgcaagctgtntcttctgacggncgtacctcgcacttcgatgtcgacatcgcactaactctgcgtcnatgttctactatcccgatcagttaccgtcagcatcgctcctcatatacgctgacgacggccacncatcacaggtgttgtctcntcacgtcagactctcnatgactggcagtagcgagcntcctacgtacgtacgtgcctacctctactcgaccgtacctcgtgcttccatacgtcgttatgtantgtgactgcctcggctgtcgtcgctgtctcgtgggcgtatgtagatgtgcgctcgtagcaggtattgaaatgagtctcancnactacacgacgagcgancnctgcacagagcgtacactccgcgatagtagagatgagtcnagtatagtangnagtctaagtnagcagtacagnactnactagtgntcatgccagtgtncancncntcgtacgatacgtagatagcactgccagtgttggttgagtgttatagttatatattgtagtcntctcgactgactactcatgatgnnantatagtcagaagactacnacgtagtgtngtagaccagtgccacgtatgtatgtcgatagagagtatcagcataggtgccantatgctcgagttacacagagcacagcgtgcgctngtcncctcgcccncgctgtgacgtgcnttcatcattgcgatgtcatagantcnnttacgtngcgtgantgtgtgaatctacattatgaagtgcgcagaaggactncantgagagctggagtatatantagcgaggtgatagagacacacacataatgcgtgtgngcgagctatctgtagcgtcaacgcgtgcagaatctatgagtagttatctgtacgacgtctctacaatatgtgaatcatatagnanatgtcgagtgtcgtcgctatgtgtagtgtcantgtcacgatgcgnacatataatcctcacagaaaatgcacggnaggagagctctcagcgaggcataagttgtccaatgaccatcgatataccaggcgccngcagacgcgcgtcactcgtgctacgtgcgtcgtttctgtgccttccatctgcacctatgtgcatcccatacgtttctatgactcacgctagtacttatttccatagcttcgtaatagctcgttcaggatcaccgacaaccctacactaccatcgtcgtgtcactatatgcacgcgcccgctcgacgcgacgctgagagcaacgtgtgaggttataacgacgctctcgcgtagctcactatcgatcgcgccgtcgtgacctgcgaggcgtccttcatgctcggcgcgattcgagttaatatcttggtcgtttcttgtaatgactctagcgtccattggtctctnacgcactagacgccnctgcactcatgtttagtagcacattggcntcacatgataccgcaccacatgtctagtggt

SEQ ID NO: 20188 - DNA, 609 bp, Homo sapiens
  misc_feature (1)...(609): n = A,T,C or G
acgtaggacgcgacgagagacgagaatcatcgatgcagagctctcccagcgacaagactgcccanaaccattgtgcgcctncagagtgagcgtaggacgctgagctagccagcgtcgtgacacagccgcgcgagggcgaatagtatctagcagcgaacagcgacccgccatgctcggctcagtctagtcgatcacttcagtgacttcagtcactgtctgtcgtgtacgtgcgtgtacacaatcatcacggtttaccggtatgtgctatgcgctgccacgatgctcgctcagagaagcgncatctcagctacatgacacacacgttcactaccatattgttaatcatcttaattatagtagtacantctacnagtatctgatgagactactaagttacaacctactcttatacccctcatatatacctcaacgatcgcctcatctagaccgtagattgacattatagctgaagctacacgctcacgatctcggcgctcgacatacacgcagtaccacataattgcattacagagatgtagtttcatctatcatagattactacggatgaattgagtagtacttaagtaggtcaatacggcgatggtcctt

SEQ ID NO: 20189 - DNA, 507 bp, Homo sapiens
  misc_feature (1)...(507): n = A,T,C or G
ccaatatgaccgcagagcccgtctacagcctatcctgtaatatacagagattaatgaggttacaacccatcacccaatacactcatcccgttcatccggcacacagcccacagtaacanagcttaggaaatagtagattaagtggcaactgtcagatagaagatgtacgtacaaagtcatggatgacacctagagtcacgtggtatactaagatacaagcacatagacacatacgtctccgctgtcctgcgtggacgcatgtatacttagaatcatcattctntagagttgtaatgacggagtgagccagctcgcttgtgcgccgtcgcgggcatcgaacgtaatcgttctggtcagcacccccactccagcaggcgcaccatacagcgctattgccaccgacgccagcctaaccattcccacgcgctctcgcacacctatatcacccaactctcgaaacaacccaccatgccaatcgagtacatgaaacatcacactgtattaccg

SEQ ID NO: 20190 - DNA, 605 bp, Homo sapiens
  misc_feature (1)...(605): n = A,T,C or G
tacgtgagacagctgatgatatgatgtcttgatgatacgaacgacatcaatctatacttgtagacattataagcgtagcgcgtgtaccgtacattgttcgtgacacccttatacattatgtgatgtctcactaagctaccagtatattcagagaagtcatcgaccagtataaatgtcnccactctgactctagaaagtatccatattagctaagcataacaacgtataatgtcatgtattgccacacagccggtacgtactcatctcatatactatacgtatctcgcgtaagcacgcatttacacgaaaatgttgaccggctaacgagggtagacggattgatgaaagtatcgggtacgaaggtgtatacaaggtgataaccaagggattgttggggtatagaagatttatagtaggtaagattgagccctagtatataaacattgcctcctagggcgcatgaagcgcgcaccggcatagcggacgcctgcagaagtgacgacgactcatgtgagatgggataagtacgcgcgtgcataagtaaagcgaacggacgactagtacagagaaatagcagaacgacaaagcaaacagagagctgccgt

SEQ ID NO: 20191 - DNA, 936 bp, Homo sapiens
  misc_feature (1)...(936): n = A,T,C or G
aaggatcgctagtgcttgatactcagtgagcatgtanctgtctactatcatctcgactgatcnctgcntctagnactctaatcagacgagcaggagctngcgcagcactcgtatatatgatganatgatgacgncagcntgtcgactgtgctaccagtcaagcagcngtccgacgtcagtctgtncnactccgcagcacacatacgacngcnctatattactgtactgtgacgntacgctctcgcagagcgacacagcgcgtcngcagacacancnacagtacgattacacacaagaanacgngcgagacgacnatagagncatanccacaccgctactctacactacgcgtacgatagctgtcacactacgggcagacgcgacncactatcacgcgacgatcgcgnancatgttcnactagcacgcgcancnatgagcgtgattctacaatatacttagctgtactgacgcaggntgcgatcgtcgatggtagtgacgatgagtgtgtagtgtgagtngtatggacgcgaatctcatgntgcatcagactgcagcagntcntcgacgcacgacgggagtcgaancggtcatcacgcgtcgctntgctgacaggcagtcgnactcgacgacgcatcaactgcataatatgtcaactagagctatgcatcnatgacantagatntctgatatactanatntgagtcangtacgactgatgtagactgcagctcnacggcnagacagtatagctcncgtgagcangccacgcagcgtngatcnatgagcacacgtatattactcagcgntaggcttgacagcgttgaatgcttgattanataggancgagngatanatnagatggcgagtgagagatgantcttcatatactntcaacagcgtagtgatnaccactgtcgacagtatnagtcctcatg

SEQ ID NO: 20192 - DNA, 245 bp, Homo sapiens
  misc_feature (1)...(245): n = A,T,C or G
ctgtgacgttctgcaggagtggggggaggtggtggggggggagagggggaaggctaggggtggtgggggtaccatacatccannagttcatcaaaacaactaagccaagacatgctaataaattttcaacactaggggggcgggggggaagaggatgaaattgtacgaagtaaaaagtttctgcttcaaagttccccttcttgttaaagaataaatcataagtcttagaaataaaaaaaaaaaaa

SEQ ID NO: 20193 - DNA, 377 bp, Homo sapiens
cctagagttgacccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagtcgtttatttttgactggctttgttcttggtgttgaaaattaaaataaagcaaatctgaaaaaaaaaaaaa

SEQ ID NO: 20194 - DNA, 173 bp, Homo sapiens
cctggtcgatcagactccgcttgcaacctgtccaggtatggaactgtgcctgtcctgcgcacagaaacagagaagtctggcctaggaggtggaggatgcagcgcaccaagatcgcaccactgtactccaggatgggcaccagagtgagaccttggctcataaaaaaaaaaaaa

SEQ ID NO: 20195 - DNA, 1050 bp, Homo sapiens
  misc_feature (1)...(1050): n = A,T,C or G
cacggtgcgggtaatgacgtcgagggattgggagaaatgcagaggtgtgaggaaagaacggagatagtgacgcggggagtagcgaccaattgcgtttggttctcgcaattatggtgccctctttgacgacaggtatattggtggtacttatgcgtgtgtgtggcagtatgtggaattttccgtgattatagtggtagtcaatggcctgggtcattcggctccgggtgcgatacgaatattaagttgtttagagattattaatattatatattggagaaatagaacttgttttttgtttcggttagaattttgttgtggaaatataagtttagtcatgtagttccggtgcaccaagcaattgatcgccctttcatagaatttcgtagttcttggaccataagacacgttttatgtacaacaggtgtcgttaatcttaatgttaagaggagatgagaatttactcattaggcatcgacaaatgagtgtatatgcagattgatgtttcgtggaggcggaggaacttagacacaataattcattctaaattaagtattgttgcgagtctttcctacagggatgatgctgtccgaggatattcatttgtagattatagacggatatatgcagttgtgtatcatgtgggaatatatggtacaggggtcgatatttagatgaaagatctaaagtcctgcgaatagtggatgatttgtctctcatgtcttgtatattagatctggacataatgaagatatcaaattatgggaagagtgaatatcatttccaacaagtcgatatctgtagatgcgcgtttcactgccatgcttatttgagtatccgtttagataggcatatgtacatgaaataatgaaataagtgctccgtcaggtctagaataaataacaatacgaaagatagatgtgtctctccccttgtgtcttaaaacgtcgtgtgtgtagctgtgtnactgcgctcgacgcatttagctctctgtcttgtgacggtgttcgaagtgtacgtgttgagagtataatatgtagagtatggtgtaga

SEQ ID NO: 20196 - DNA, 772 bp, Homo sapiens
atagaaggtgagatagggggcagtgtcatcgttaaagtatagatacaaaaaaagtgttagttagcagtagttccgcgcttattttcatgaacgtaaggaaattaaattgataggacaagcaggacaacaacaaaataacgtagacgtagtataatacaatggttgctacatgacatgcagcagggggagagacacaataagagagcagagaggaaggcgggagagcacagcaggcagatagcgtgaaggtaggcgttgacgggggcgcgtttgaagatgtagttagggagtgcatgaaacgtgatgggatcggataagggattataaaagaataaggggaaagagaagcaaatgcggatcgggatttaattagattatgaaagggattaaagaattttgtgtgaatctatcgcatttattgcaattcaaccactgtcgcgagacggcaggggggcgtggggggagtgggcgggggtgtggtgaggagagggagagggagatcaagcattatagataaggggtaagaacagaaatataaggatttaaaaatacgaagccaaattaaagtaatttaaccaaagtaatatttaactatatattaaaaacacaaattaaaatttttcaattgttatgaagatttggggtggggtatagcatacacatgaatttgtatcactacccttgcagcatatgcccttgatctttgataccagtaaattttggtaatagaataggcagaatgcctactccatctcaaaaaaaaaaaaaaaaa

SEQ ID NO: 20197 - DNA, 539 bp, Homo sapiens
cggaagagacaacggaattaggagtaggggacacgaccgcgctttaggtgagccacacattctttcctgttgcccttcccccctctgtcatgtgaggatgttgttgcaagaagatgcttttgggggagcggaccctcaaagaagctgccagtgctttgatcttggacttgctcgcctccagaactgtgagaaaaaaaaaattctattatttataaattacccagtctgtgttattttgctcttgcagtacaaaccaggcagaccaacctacctgtgccggggtgggccgcaaaaaaatgtagccttcacagcagtgttcgcagagccagcccacattcatggattcatagaagtctaagtcctggcaaactgacagaagagctttggcattgggagagtggaatctaaattttagatgagatagctaacgatacctcaattaaaatgtgacattgtacgcgaagatttcatggggtaagacttcagaagcatagacgacaaaaaaaagaaaaaaaaaaatgggctcgttggcctcaccc

SEQ ID NO: 20198 - DNA, 1114 bp, Homo sapiens
  misc_feature (1)...(1114): n = A,T,C or G
gcacgatatatgatatgaggtagtggtgagaagtcgtatgaggcatgacattatacacacatctatcataatggatactagatagcactgttgctgtaaggcgtcgggatatcggcgcgcatcgcggtanatattatatcggatgaaaatatactaacggcggacggtgcgtgatctctctgatgcgttgcngtcactaagccggtatcgactcacatataccgtatagcttaattctaactaatgcggtacgagtgtctcaagtcaggaggtacattattacaatcaatcactacagatacgcgtaaggagaacgtaccctatgatcatagngacgccgagcgacgctcgtcagtcattcgccagaaataactatatgtgaatagatctccggggtgaatgcgtcggataccctggaaggacgcgcgtccatgcgaaatctctgatatataggtcactgacgggattgtatggggattataaaaaggtatcttgttattgtggatggcgataacccacgaccggaggatgtgcgtaatgcggggattatattgggtcgctgtgtgtccgttgtaatatgcagtcgcggagacgatatgctgaactaatgaggagagcgtgctgatcctaacgatcgaccaaaacgcccgccaccggttatagatacgtaggatgtgtctatatatacggattggcgggtacactaatgcaggggacaaacacatgcgcgagaagcgtgaattgtgggttcatcgatcgaaggatcgttagcgctgtcgtcacacaagtggttatgcatgaacacaagaatcacattcagggagattcaattaaagtctaacgtccatggctacgtgtacgggacatagcttatggcatgtggcaagacgtggaacttctcgcattttagagtgcagatatggtataggcatacgctcatattaataatgtgactattgtaggcataagacttcgatggctaagacttcagaagcttagtcttctaaaaaataaaaaaaaaaatggcctcgttggctaaaagcggtggagtgttgcgagccaagattcatctatctgattttccacactccaacactctacatcttacagatac

SEQ ID NO: 20199 - DNA, 261 bp, Homo sapiens
  misc_feature (1)...(261): n = A,T,C or G
aaaagtaaaacctcancnnnccgttgcggnnnnntgtgccgcctgcgcgnacacatgggccacaaattgtttgctcattgcgaccactcaacatgtcctgcaatgtcaatctgctgttctggcacagcgagcccgcgcctcctgagttgtttccatctccctccagtcattcaggaccacctatgagatttgggatatggcgaaaactgccacccagtgcctccttttcctaatctgctgaataaagttaataagactaaa

SEQ ID NO: 20200 - DNA, 1297 bp, Homo sapiens
  misc_feature (1)...(1297): n = A,T,C or G
caaaataatccagttccggttggcccaaccatgttcagggacaacaaacaactgtatttaaaccatctaaccacgccatcgctgaatgcttgcggacacggggatgcatgtgtctaggcatgtggagtcatctgtcacacatccatcggatgagaggacatgaactcacgcactcacgtacacctcgacgcgctcctgtaatggtactcaacgcctagtatacgccagcagctccactgttgttgtttcttctccgctgaaaccaccaagagcactgtccgttccactaaacaaccagcacccgcccccaagttttatcttaagacacgaaacccgcccacacccgtcacaccactagccaccagattaaagattcaaaaactgtacaacaaacacattctcatgcgccagcccaggagttctccgcacctcgtgcatcacgctaataatcacccccatctctaactccaaccgtaatcgttgtccgtgtcccaccacgnacctcccacctccacccacctagtatcacacccgctcgtttccaacataaccttcctcccccacgccccgctgctcgttgtcggtttcgagcttcttcgcgcccgtcgccgccccctcacccgcctggccgcctcgtccgactccccgcgtatgctatttagcctatacagacccgccacagccgatgccgcatatcgtaatgacgcacccataaccgcactcccacgcctgcgtcttctcttcctcaatccacgcctcttcttctatatacctcccgcacccttctcctctcgccgctactcacgagtgcgccacgcgtcccctctctgcgcgcgcctcttcgcgctctgacggtagtcggcgcgccatncgcatgatctattctcacgtcgccaccgcagcgtcaatgagcatgatcgaatctacgcaactcgagaacaccacancactgtacatacgcaagccgcgcccgctgacttcgcgtatcgcagactccgacccatagcgccgcatgtgcctgatcctgcgcgcgccgcggcgctntcgagagacgcctgctcgtagacaggcgcgtccacgtcatccgacgcacacgagagagcagagnatcaactcntctatagacttcgcatacgcgtatacncgcacccactctcaccccgcganactgtgcgctcgatctcgtggactctgcccgcgcgctgctgatgcatccagagttgactattctcacnnancgaccactcacagctcgancctctcgccagcagatgagcgtagtgacgnantgacgtat

SEQ ID NO: 20201 - DNA, 1472 bp, Homo sapiens
  misc_feature (1)...(1472): n = A,T,C or G
acnnaagctcacaccatctgtagcaccatatcgcatgagtgacacactcaganaannngnagtagaagtagagnangngngnaagatctgctgacnctgangacgcantcgtgtactgacggccgtggagcgctcgagcagcatgtggtggcntctgtgttatcancatagactcattgatanngnncacgtgatagtcgagctntgctcgtctcagtcctgtagtgcncatacntgtctctgcngactcgtctgcagtggagtnggtggctcgagtgatcanacgcatntgcggatgcacgtcatatatcggacagctatacatggtatcatacatagagcgacatatactcgagacngangctagcagctcgtngnncagtctatcagcagangacaagacgtangngcgcaccacgcgtanatctgctntaggacactacanctagagactacgcagatggggacacacgtgtggagcgctcgtcgcgnagatactacgagacatgcacactagtactactgatgcgctctntacgaactacatactcganaccgtatatcgagagnctcatacgagagcacaccatgtgngcgagcacagagacgccactctgtcgactgacgaagcacaagactatagacactctacgtgcanacctctctattgnacgtctcgacgcactcatatcgangaataatgatcagccagctacaggcgaacgacagcgagactagcagtggangtgcgcgtgananacacgagtaggacatcatgcgancactactacantcgtctgtgncgctgcggagnacacagtnaaccacgacatggncacagctcacccgcagatgtgtgnnacctcgtatagagtggcgctctcgtacctctcagtcgcngcacacccccgcgcnagnnccgtcgctcacctgtctgcctgcgcgctgnggngcacgctggcgactgagtgccacataggtggacatcgtcggtngcgncaggactatgagatnctatataagaacactacgaggtgcatcttgtgtggacggagagactcggagtgnggacgtgcacaccgacagataggntacacacacgcgtccgtcactctcagtacgtcgtatcgcacacaagtacagaacgcgctgtcgangngcgcggattgtactatgtacatatcgtagacaatccgggggtgctgtggcaccgggacaataacaagtgagcagtctcagtgtagtgntgtggcaaccgtggcccatgggctaggtagcagactgtagcgacgagcgagaccgctcggtgcacgatgggggaagactggctatgaagcatatctcgngatgagcgatgtgactgggcaaaagcagcggcttgcagtgtgtntngccctggtgaggcgtgtctgtatgtgggacgagtgtggcacgagggcgtccgcaccttgtggtgtcgcgactctcacgat

SEQ ID NO: 20202 - DNA, 791 bp, Homo sapiens
cgtgagggggtgaggattggttgtttgtgtgacttgtgttatgttgatttgttgtgtagcgatggaattttgttcgtgttcttatttatcgctgtttgttatttggatgaatagaggttagggtggatgcggtatgattaaataagtggttctaggtgttaatgtgcacaatctattatagaatttgagtactgtgattattaggtgaggtgggggcagtgtgggggttgtgtgttggtgtattggtgaaatttgtctataaatatgatatgattagtggggggagtggttgggggggagatgtacgacgatgaagaggtgatatacatagggagtaacgagaggatgtagagattgtgaagcaatggattagatgatggcagtaattggggtgggggttgttattttccagataggatagtgaagttttgtatttggtgagacagttgatagttttatttattgtattattgagagaagatagtagtgatatataaatgctttagtcaaagtagtgttagtagtttattatataagtaagtatggatgattgagagtcatatatatagtggtggggttgtaaataatgggtagatagagaggaggaagatggtgtgaggtagtgtggtgaatcgtgatagtatatttggagggaaataggtatgcagaaaatagagatagatgtgattgctttagggagaattgtgtggagttttattgagtttgtgtagggggtgtagtgggaaggtttaggaaagaataggcattaaaagaaaaagattggaggaatg

SEQ ID NO: 20203 - DNA, 1493 bp, Homo sapiens
  misc_feature (1)...(1493): n = A,T,C or G
gtttcatgnggcgaactaaccctgcggacagggttggttgtgngatggagctnagcatgctacaagcgaatgacagcatccatcacataactcttcttttcttggctgtctcacaccaccacncgcattgatnctcattgtagtnngtagtnttactagaacaagctcatgccgatgtgccagtgaattataatattaggtaatatgtgaacaattttttcagtacttcctaaccataccttttgactacattcccaccatcgtcgatatntatttaatgtatatagctgtgccttaaatctcccgtttcctcctcgttcnngtttgcngnttggatggccttgatgaatcacacatatattaagtcctttcatccactcgattgttacctcttgggttgcttttctccttataatgttccgagtttattcttcgtgcttgcctgaatattgcatctctctcacctcgtctatcttcccatcgcgcacaatgcgcactctaactagtctacttcatccccatctcggtgnttccagtgtctatacttctcatgagacatcgctgtttgtgacattttgcntgctaggaacaatattactataccagtattggcgtcttcggagccccttttaaactattattccgcgattctatattgacataaatgtaaacgactacatagaggcgctgcccggtagtgccactgctaacaccgtcggcacgtgctacttccgccccgcgtcgccntccacctcatcacaactctggacggcgatacccacactctccacacgatgctctctctacatcttnatcgtaantgttcaccacacgtcatctctcgccacctctcgcgntcgccgctctcgtactcagtcacctccgctcgccagtcatcttncgtctacagaggtctgtacgctgcacgctatacgattcgtatcgcaccgcatcnntccctgttatcgctctcaccacacncaantagctatacgaatactcaacacgtcacgcacacagcacgccgaccctagtcattcattctcntacgtncctcacgctagaatgntactacntnattgagctngcntgctcgcgcatcacgcgtctgcgcctcctgtcgccngccacgcgtgagntnnngcgctncaacctactatcaccgcgctgcgctgtactcgcgcgcantnacggatccagctcncacgcgctcgtcactgtctacatgatatctgcgtcgccncttcgancntctgcctcactcctatgntcgtctncgtacgtcgcngccnctcgcactctactgcagctgcgntgcgttccgtcgtcagntnctctgatacgntnctncgncatctacgtntctcncntcgtatagcgccctctcagcatncagtcgcgntctcgcatcgacacntgctgtgntnatgagcgcacccgtcgtgcgtagatccntagtgactgacatcgatccagcctgtctccgtcacacg

SEQ ID NO: 20204 - DNA, 855 bp, Homo sapiens
  misc_feature (1)...(855): n = A,T,C or G
aggccgggcggtcttcactgatgcgaagaaaacacgggcgggactcaccggggagaagagtgtgttgattgttgtcagtcgagatatgtcagttaatatgcggtgtggtggatgtgtgatgtggcaagatgtggggcgaggggggggcggtcggaagtgtcgatcctgttgggttgtctgaaggatcgaagacgaaagggttggaggaatagaaaaagagtgtagtaggtcatgatcgtactacctacgtattatgaccaaggcgaacagaacgaaaaaaattaaaataaagtgtgtggaataatcttcatcacttcacgtgagatacagaatgcaataacaataacccccagatgcacaaaccgccacagaacccgaagatagtcaatagacaagtaaagcagcatggtgatgtgaactgaatgagacgtcggaggtaggctctgtcaggtggcagtaggctgtggggggggacgcaggtgaagacggtgatctttgcaactacgcgtaactcaaggaaactgatataaaatagataggacatgaataaatagaagaaagatccattctgaataaatatatattatcatatacattaatgaaaaaagttttgttcataaatcacgagtagaattataaagtgtgtagaaaatgaaaatttgcaaactatttaaaccctggaatcgctgactgttcagaaactacacagatggatgatgggtggtggtgaacaaaagaaagggattatggatgaatctgcattgctctaggtgctccccatgacacccttttccggggaaagctagattttgtctttttcttcttccctcttctttnttctttcttcctttattt

SEQ ID NO: 20205 - DNA, 839 bp, Homo sapiens
tgtttgaaccatctcccaagccatgctgaatgctgtggaccgggatgcagtgtcaggcatgggagtcattgtccacatcgtcgagaaggacaaaatcaccaccaggacactgaaggcccgaatggactaaccctgaccctagagcccacttttttttctttttttgaaataaaataccctgtctttcaaaaaaacaaaaaaaaaaaacaaaaccaaacaacaaacacacaacacaacaccaaacacacaaccaaaacacaaaaaaacaaaaaaaaccggcgccaacagccccccccgtctgaccttaacccgtctcccactttatacaggggccactactccaaccccctccccgaccctcccctgccaccccacccccgtccgctacagtcacccaccgccctcaggcggataaccccgacacccccaacccccgctccccgaccgaaggaacgaatgatccccatccccttcaccgcccgaactcataaaccgctggcctccctccacccatttcacacacccccccacatcagcccaaccaaacatgcctcttacattgcgtcaaaacccatccccgaaccagcgccatataactacccacccaaccgcccccagatttttgccctcctcacacctgattgatacgcacactccccctccgaaccccatccgaacctcccccccatctgccccccctgttgatgataacacccatatcccgtacatcctcacccacttccacacagtccctcctcgatctaaacgaatgctacctccactacccctcatctatacgttacgctccccccattctccacgtactattcccaccaacc

SEQ ID NO: 20206 - DNA, 300 bp, Homo sapiens
  misc_feature (1)...(300): n = A,T,C or G
tcgctatggcnntaccnnctcggcagnacggctcggcatggnggatccagctagaacaatgcagattcatccataatcccctcctgctgttcaccacacccatgatccatctgtgtagtttctgaacagtcagcgattccaggttttaaatagtttgtaaatgttcagtttctacacactctatcatccactcgcgatctcttaatcaaagcgctccaatccctttctctgccaagttttcctcctctgacacccatattcactcttaccagcctctccctggctctcagcccgcccccc

SEQ ID NO: 20207 - DNA, 222 bp, Homo sapiens
  misc_feature (1)...(222): n = A,T,C or G
cattgagtgatagcacccggggctagaagannacacgccaccgcagaaagcngnggaccgggangcaccttcaggggcgggaaaaactgtcccttcancgagaaggacaaaancaccaccaggacacngaaggcccgaagggacnaaccctgatcccagagcccacttttttttctttttttgaaataaaatagcctgtctttcactccaaaaaaaaaaaaa

SEQ ID NO: 20208 - DNA, 1564 bp, Homo sapiens
  misc_feature (1)...(1564): n = A,T,C or G
actcgcggccatcgcngctctctcacaagttgagtgttgccgaacgtangtaacgttanacttgtggtggtatcctcatcgtcttattcctcgcgtntgntcacactcactcatcgctatgtcgacatctgntanatcncatcctntctcgcgtgcacacacacatctctatcgtntatagatacgtgacgcgccagctcacgccatntacgcgtgcgactggctgactagtgctgatcggtcatgccgttcatcgntgcgacagagtggggacgatactacgcagatctcacgacgacagcgggcggcgacgacatgggcagctgcgctcgcgcgtggcatacagacgccatgctacgacgacctgccgcgnctgatactancacacacttctgcagcatcacatctaacagatcatattcatagcatctaacaacacccttatcatctccctcgttctatcgtctgtctgtgcacgtacactctctactgtctcatcgcttactagatncacactcttgacacgctcncncctgtactccgactacgcctctacactaccacacacatatctactaatcaccctccgcaaaggagtcatcnatctcgccttcacacatnacatctcctacatagtacgacagctatctgttacatctagaccgtgcatactctacatcatcacctcnantctctctccgctctcctgctcgccactcatcgtatatgcgccaccgcgtnantatctcgatatcgctnctatgtgtcatatagaatatattacgtcacgcatccgaataatgtatcaancgcagcgtncagcgcagagagcgtcaggcgcatgatagtgctgcgtagcacgcgcacaggcggcgtctgagtctgtatggtagatataggagacccttctgtcgttgtaagtcgtgctctagtagatagttctacgacgccgtcgctccctcgcctggcctcgctcatgcgcctggactcctctccgccngtgcttctancgtctatccagtactcccctgcacttactcttccgttacgtgatngaacaancaaaatcatgactataacnagacatancacagcgtgcatagaacagaacgtaccgcgtcgttgttgattgcgagaacaatangacttgcattctcgctcatcccatccgtgacgccgctacccttcgaccgccctctctctcctttcccctcagctccctggtccggccttcctncccccctctcccccaccttcccgtgacataacaccgctcgtccaccgacctgacctcggcgagctaggcgatgggattttgtcagtggcacagccagagtcaaaaaaatgtggcgcaatcacaggatgtgngcgtgcatancgggtagtcgcgtgagagggagggcaatagtgatctgctaaaacagcaacntnntngtatttnnntggtcntncannnaataaagcgnncgtttanntnnannnnttcannttnnnactcnnactcctcnttcccctttnttnnntnnnnttnntnnttnnnctcctnttnnnnntatcaattccc

SEQ ID NO: 20209 - DNA, 942 bp, Homo sapiens
gggtggcatggggagcagctagaacaatgcagattcatccataatccctttctgctgtctacgaccacccatgatccatctgtgtagtttctgaacagccagagatggcaggtcttaaatagctcggacatgttcagtttctacacactttatcatgcactcgcgattcgctacgtaaagcggcgttaatggctcgtgtctgatgcacgtggcgacgcgtcgtatcgcaggtttcggttagctcaagcctaggtcactggttcgagtcccgaggggctttctcgctttcgagccacggcacaggcgcggcgcagtccgagcgcgaaagcggcggcgcgcgcccggcaacgctgcatgcgtgacgtccggcgcgggccccgccgcacccccgccacgccgacaccgcgcgcgctagcgagcccggtcctggcagcgtggggcgagcaggcagcgtgccgcccatggcgccggcgtcctgcgtggggtgcggctgcgcacatactaggcgcgcgtctatacccgcacgtgccgcaaagagtatgggccgccgagtcgttgagttgcggaccccgcgcagcgaacgccccgagcgccagcgacacctgccacagggcgaccgccgagcggcctggagtagtgcggctgttcgtatgtggttgacgccttggcctctatgcagtgcgcgccgttcgccggtcgcgcggcggtcgaatgcgcgccgcggccgctggtagggtgggccggactcgcagggcggagacggggggcgcggggttgcggcgcgcggagtcccgccgccgccggtgcgccgcgcggggtgccatgctgtcgtgcgatcggtatggatcttgtgggtgatcgtgcgatgcgcaggtcgcgacgccatcatgtgcgcgcgcttacgagtgctgctatagttgctggaataggaccaacgaagag

SEQ ID NO: 20210 - DNA, 1005 bp, Homo sapiens
  misc_feature (1)...(1005): n = A,T,C or G
cttcaggtatcaccagatgctgatcctatggaattaacatagaggtctcctcaaaaaagaagaagaatcacactggcctgagatgatccacacaaaatggagggagaagacaacagagcaagaccttctaagttatgaaaggtactactatatatcagtcagaacttgtcactctattatcgaaacacatcaaataaccctataatttgagacattgttgaaatactgtttcaggttttacactcttgcatgctagctncatttatcccttaatattaattttttgatggatctnacctcnccatgaataattaaattatggaaagatggttagtattgttacaaataccattagatcttcccactaacttcataaaaagatgccctagtgatcaccccatatctcaggtccaattctagacccttgcctttgattaggaacacccttggtacataattcttacttatggctcttataaaaataatatatataatttgcctgtaatggtcactttacaaatgtattcttcttaacgtcgctttatcttttggccctcacgcctttacaagggaactctccattactacgtgactatgcctgtatcaaggaatttctgtctagcggtatggtatttcactcaaacagagcgattaactttataccaccgaatagcgtatatcacttcttttaactacgtgtttaaccaaagtcccataggtggccacttatcaccataaaatgaccactgctttttgaagttttttcatatggcctcgccccccctaactatagtctccaaacttgacccctgattccctatttaatcggacgccatgttcttgtaacaaacctcggntctttcccaataggctcctctgtgctcttccttgtanaccccttcccttaccctttcccaacacccttatcctcttggaaatccagacctctctctatcacgacttaatgctctcctcgcgtgaggtgtgnaccccgctctccttgtt

SEQ ID NO: 20211 - DNA, 849 bp, Homo sapiens
  misc_feature (1)...(849): n = A,T,C or G
gggggtgggttgaggcaaggtcggagtgggcgggggtgggggggtgagggggggaggggccgagatggtgggggcggcgcgtgagaactaatagagtcgtgggtgagtggttgggatggggggaaaggaggggagagggggtgtgaaatcgagagagggggaggaagtgagagggtaggatgagtggggtgaatgaggggaagaggggtaggtgaagatgggaggcagtgcgagggtttggtaggtagtagagtgattgagtaccgtagtagttcgaatgcacgagccgctctctgatggagtgaaattggagtaggtaatgggtagatggtggaagggatagttgctgttgaggctcatggaaggatatatctgattgggtagggggtggggtgatgggggggggcgggagagagagggggtgtggggaggggagggtgggtgttttggttatgtgattatgttgcagcttgcagacttgtattggatggctgggtgggggagtggggggggcggatcctagatattatgaagtgaggtttaggttggggaagagggggttggcagaaggatggagagagggtaggcgggtgggtgggcgaaatgccctttgcgtgcaaatgcggtcatgccttgctcataatgtgaatgtggcagcagacgcgttggagggaccgctgcagtagcatcttgaggttttaacatttctttccagagtatctgtatcagaaaccttggtaagttgccattgtgattcactaccaacagtagattggcggagttggactaggggtagaataggggatgcaanntctaaagtttatttatttaaatntanttttaattttc

SEQ ID NO: 20212 - DNA, 933 bp, Homo sapiens
  misc_feature (1)...(933): n = A,T,C or G
ttaggtacaccttgacaatatactgtgggtagagaataacagtggaatttaccaaagtatttagatcacaacatgctatggaaagaaatgttagaatatggagatgcaacatgacagacccgtacattgtggttgttaacggactaccattatcagcacgaactgtactttatattgaagagaaacagaggattatcctatttatgcacacatgacgaaatactgaaaaaggtttaccgcatcatgccagccctactcaatctaatctctttctgatggaatatacatccatgataagataccagcaggacagatgctggcattggccacagaaattcataatatngtactcatcncacttagtaatagtatgactaatgaacacccattctaggtcaattatgacctttttttattacacacaacttggtcatttccttattaggcttattaaaatcgatatatatttcatagaaagttattataaaagaatttctaaacttgcttatccttggcctaccccattaagagggaagctccatacaaggtgattattcaggattcaaggatcatcgccactgattggcatttagggcacagacactactattaaaaaatgagaggctcactctattgtgtaactggcgtgaaccagcactcactagggaagactactagagaactttcaaacgtttttgcatttcatagaggaggctacacagatgtatttcctatcccaccaacctgcgtgacagtaaagggggggaactgcttgacgcaaccccgccgacttttagaccgcaattcagcacatgttatgacacggaccgagtctgatggttccgaaacaaccatatttcaagactgtcgacagtgtctcagcaaagaagatctggctccctccctatggagatacatcggcccacgtcattg

SEQ ID NO: 20213 - DNA, 465 bp, Homo sapiens
  misc_feature (1)...(465): n = A,T,C or G
aggattctgtcgatatcttttgtanatcttctgttaaattttttgggttttattgctttctangctaatggttatagggctagattggtgatgggagtaggtgtaatctcagctgaatctatatataactaagttttatcagtatgnggactctttctttcatggttttgaatgggtatattggtgaggctagctgagagtgggatcggggctttctcgcctcgtctttatgctagagaacttttcttgagggcgttagtttttttcattcgtggttttgttatttatggtctaatgttggtcctccgatagtatcgaaagtttcggtaggatgtatcctnngttgatcgtgagggggcaggtggcgagaagatggtcctcggataatgaaagatatttagtaacgccgccgggggtcgcctttttccggcttatgtcctaaataatggaatttagctcgcatcc

SEQ ID NO: 20214 - DNA, 943 bp, Homo sapiens
gacaacgcccgaaaaacaagaggaaagaagtttcaggtacccactctgtgcctagctggtctcacactcctgacctcaagtgatccatctgcctcagcctcccaaaagtggggggaggcaggtgtgagccaccacacacaacctaaagcattctgtctgatctcttcaatgttgcaaaacatctctgtgaatatgattcttgtaattagtcaaaaggacgagtaatatagagctaagtaatgaatgccatgttttgggtgccaaatggaggggagtgattttaaaaagagggttttttgttttaaaataaaaccatttccctgagaaagcctcagacaggctttctcactggatcatcaattcgccaacgcccgcttgcgtgcgccgaggctctagcattccgaagatccgacggaaagcgcgtcaaccgataacctccgcggggcccttcacgccccaggggggaacttttacgccacctttctttgaggtggggtgactttgagcacatcttcgacatagaatccgtcggatctgaacttcgaatgcccaaacgcgtccctctcctcccgagtcgtgtacctccctctcccccagaccgggggttaacggtcagacaaatttctgagcaaagggcctcagaaggcccgataacattaaaggcccgcgcggcggggcttacaagaagtcacccgccccggcagacttcccagattgaggccacacaaacaaggccgaacaccccacagggcccacgatccgccgcgtgtgctccatgaaatgaccagttagactactctctaatacatcctaggcgccacgatacttttcaacctcttcgtccgagaaggggagatgctcaatacacaagatggactacatactgaggacccgcctccctccacactgggccgcggacacaccactatatcagccagcccac

SEQ ID NO: 20215 - DNA, 897 bp, Homo sapiens
cttaggtagcagaggtatcctgttggccagcgagcattcccgtctgtgaatactgcctcggacaggagcatagaacggcaactcctggaagccagcacctggagaagctgggattggactctggctggctctcattccctgatgtgtctaacattgtattcgatattgccctcgctctcagatgaccacctggccgcgtgtgatgccttgtgatgaagacccaacctttgtagacaacgctgacgagcctacgttgattagaatcatgtggctggggagacagtggttgagaccctccagcgtccagctttggttgttgaacataccatatgcctaggatcactgcgattatcacacatgtatttgcctatatcgctgtggctttgtttgactcttacttcgcaggtgctatccttaagatagcttataatatcatgtatgatttaaatgctattgtcatatttacctatcattaagggatggatctgactagtttattgcatcatagaactattgcataaccactgattataaatactgactgcgtcatgcaggcctcaatggagtagatatagcgaccgattacttttttgggagttaagcaatgagacaagtaactgatggcctcgtttgggtcagtcggggagctctagcggcgttacctctctgagagggggaattctggtactcactcaatgagtggatacgctagaaagtactgtgaggaagacgcatcaatggctaaaggcggaatagggcatcccctgatctgtgtcttcggctgaacacttgtgacatacgacatcgacggctagaccgtgaggggcccgtgtggctttttcatccgtccgtcccctgggagctttcaaaggctctcttttccagcttggcgaaacg

SEQ ID NO: 20216 - DNA, 1469 bp, Homo sapiens
  misc_feature (1)...(1469): n = A,T,C or G
ctgcgcggtcgcagctctgcgttactcctaatcgtattcattatgtgagantgtgcctatacgacataccgcgccgcagtgagacgtcaggccgagagtgttgattaggtgagtgtgtgtgcatatatcattcattctccgcacgtcacactacgtgcaactctgcgcatgtactaccgtgtcgcgttgtcgacgtantctcgagtngcgctcgtatgnggcgcgcctatccgtgtccatantgtagcatacgtgcaccatgctgtcatactatatganagngatacagcgacagcatgtatacacgagaactacatgcantnataaaatctactcatctctcntttcagcgcgacgccagacntagaggacgaacagctggngatgcgacggacggactgtgtgagcagangccgcgagcgagatagcagtcgcgcagcgacgacttgtccattagtcgtagtgatggagtgcggcagccacgcctcgcgtcctcgtctcgtgcccacgattgtcttagtgtgtctctcgtcgattcaatgagtatgtagcgctcgtgggtgttcgtgtggctgacaggtgaaggagagtcgagagggcagacgttgcgtagagtgaagtgctaagaggggatgcagtgaggcttatctattaccacgcacatcgctgtgttgaaactcgaagcggtatctgtcatatatgttatctctcgtcgacgacgcgctagaccggcagcggagttgtgatgtaagaaattatttcggggttcttgtccattatcgtgggctcgtgttctgttgaagacgtccacgtgacctgctcatagcctctcctgattcggttcgtcactttgcatgtgctccccggcgcgccctgcctcccctctccccctgcgcgccctccgtgagtgacccccgggcgcaatgccacccctcgtgcgaatgtgcgtacttgcgcattcgctgtcgtatgagctacttcgtgggacgcgtgtgccattgttgtggtggcgcctcacnttcatacgcactctcgctcgctcatacgcagcgtagcacagcttcacacccaggtatctgtggtacaaaactgcactaccgtgttttatatttgtgaatagatggcactgcgtgcctanctcctacatgcatgntctatgtatcacatctagtctactctcgcgctgcatcgacggactcatcgcctcgacgacatgatagtcacgtcgcgaactcgctaggtcagatgcgctgtactgtgcggcgtggcagtngcagcagtaagatangagaggtatatcgagcgaggnggggctctctcctagtgcgtcgtctgaacagtcctcggcgagcgntcctgtgtttgcgcccacgtcaggcaagcgactnacgcttgtagcgcgctggctgttagtgctagctacagtcgcggtaacagagacagctgcgcgcaccttctcgtctctcttc

SEQ ID NO: 20217 - DNA, 1129 bp, Homo sapiens
  misc_feature (1)...(1129): n = A,T,C or G
tgtagatacaagagtgagaagagtgggtggtatccggagcgttgagcatattactatagagcagtnctattgtcgacaacgtcggngncaacatgtaacaatatataatatggcgggggagggtgggatgagggaggaaataggggggcggtcagtaagaggacctataagtagatgtggctatacgcggatggatctaggngcactgggagtgggnntgcctagagcgtagacagtgtgggtcaagtggcggcgggaggtgtttggtgggtatgagatttacgattcgacatatnnnacgtgaataatggcgggacgtgggagggcggagagagatgactgaatacgactactgttctgcgtaactagtatatttcctatttacattatagcactggnattagatatagtcatctgcacatggggatgatgngtgaaacaggcggtatgaggngagtgggtggttcgcttgttcgcgctgaacgtgagattagtcaaatgaaaaacaatttaagggaacaatgcgggagaagggaacggagggtgttggggggggcgttgatgtatgagaggtgatagagttggaggtagagcattgagcagtaggatgagagaggaacaataaacttactgtaattggaggggtgtggagggatatcgggtatatagctcgatgtgacaggtgtgattaagnagtcgtcatgcagcggtcgtgggggagcatgagagcagaaaacagagagaattagaaggatatacatagtgagcaaagactattangtagctagttgactaatagcatatgggttacataagnaacgtactttgaataaanagcagcatgaactgaatgtangcatgctcgttcatgtggnttaatatacagcatacctcatatncntactgcgatgtntgagactattgagacaagtatggcgcacatggtggggagtagtggggacatgaggaagagagtgntacttacataacacggaacagtgcatggtatgttgttagtattagaactagtatatgtagactctgtttaatacctcnntacgtattacatctttcagtctgctcattgtaactgtgaactaatgataatgacacttgagaacaatataca

SEQ ID NO: 20218 - DNA, 872 bp, Homo sapiens
  misc_feature (1)...(872): n = A,T,C or G
ttagatatgtttgtcatgtgttttgggnctaacgtgttgtctctctgtggnnnaataacataggtgtctggagagaggagacagagnggtaggagtgtggagggaacttagngagtactgttatggagagggacggtgcaagtcgttacctaggtgttggtgaggggagtagaagttgggtggtggatggagtgggagactattaaggataagaatatggagtaggacgagtggtgggtcgggcatacattaaaagagaggggcgggcggttgatggtgagtgattgtcatgggcacttgttggtgaaatttaagggagagatagttgtaggttagcgtttaagaacagtaagatcgggcgacgtagaatgggngagaaaagaggataagagaggggaagtgagaggaggggggagagtaagaaaagaaaattaaaaaaaatttttgtgtnccctttctatttacttctttttttcttggttggtnataagaaaagtaggaaggcacgagagtagaaactaatgctgtttaaatgaatataaaacgttgtgaagagtatagaaaaggacaggtggaaagcgatgagagagggagcgaggagggaaagagagaaggcgtgacaagcaacatggggttaatttgataaacagcacaagagacaaggaagtgctggagacataaggtggtggaaggccagccagtgccaatcccttccttatctgttacttggctaccaggggattccgcctgatctttttcaatttgtcattatcttattcggtagttctgggttggcaagcatggtctacggtaatagaaggattttcttcctatttttaacacctcnnacatcctccctncaattaaacccc

SEQ ID NO: 20219 - DNA, 436 bp, Homo sapiens
  misc_feature (1)...(436): n = A,T,C or G
gcacgcctggtttgtggggggggggggggtcagggaacattattctgaagaagagaaactaccagtcagacctccagataaatgaagtgaccagaggagatgggagggggggagtgcttctgtcnttancccggtgcantgctgtgtgtatctanttccagctacttgagaggctgaggcangaggattgcttgagtccaaaaagtggcagttgcagtgagtggagatcgcgccactgctctccancctgggtggcagagggggggggctntctcaaaaaataaacaaaaacaaaatgcttctgtgagttaacaatctttattagagggggtttagtctttctttctcagctcgatgttaaggtgggtgacaaatggaaataaacgtctttattatcctttttttctgaaaaaaaaaaagggggcttcttggccta

SEQ ID NO: 20220 - DNA, 1211 bp, Homo sapiens
  misc_feature (1)...(1211): n = A,T,C or G
acttaacatcttattaactattactcntcttacaatattctatctactctaaaacgcctacatctttgagnattaactgtataacaactactgtcatccacttgcctgtaggtgngtgtataacgtatattgagtcgtcaatgttagactgctacgatgtacgtcnagcgatccgagtgcgcggtcgagacttantaactaagaacacgatcatatgagaaaatattcttataattataatatatatcttaatgtcttgtgctaatactttatatcggcatactagcatctttctctcttatctaattaaaccttgaggtgcatccccaccgagaacagtatagtataaacgagggtangtcgctaatacatcgctgatacccactttgttgctagatagtgtcgagtgtgcattttacctgattgaagtaaccgacagtcttagccgcctataacttatattaagcgaacctgtctacgtggcgcagcactaatatatgaaattacacattngatggtataaaacataagaccacagataaagtaagttgagagagaagaaggacgaaaaatgaaaaaaactcaatacctactcccctcttcccctccatcctataaactagaaggaacgctgggcgtggtgcatgggagggaatgctgttagctcattttaatttatatcttctataggcgcgcgggcggcagtgtgctgattggggtggactagctttacacaaaggtatgatgatatctagtaatgttcatattttctcttttncagtcattctattttgtattcatagtagaacgggggtaggaacttgagttgtttgttngtttatactaatttgtgttttatagagttttattaaaaatgaaaatattataatgtttagtttcatatntgagcactttaaactgataacaagagcactagaacaacggcaatatatccataagtagtcactcaactcacaaattctaatcattaactaagtataaaaagtaataataaataatagtgtatatttatatactatataataattataaaatagaaatataactttaataattaaaaaaatgaaataaggaaaaatnaatatacaaaatatttaaataaaaaagaaaaataacaaaaaataacaaacatnaaataaaaaanatattntacatatatnntaaaacaaattttnnnttaaaaaantttt

SEQ ID NO: 20221 - DNA, 829 bp, Homo sapiens
  misc_feature (1)...(829): n = A,T,C or G
gtgctaatgcttgttcatagaagatggaaattgaagtgtgagtgaaggagtnntgatagggggtgtaagtgaganaatgcaggtgcggggtatcatatcggggttgggggggggagggatgtgtatagatggcggggagggcgaaggaggttttgtttgtaatggatgtggaggggggaggggcggaggggggggtggagcaagggaggagggatcggatgaggaaggtcggcggcgggggggggtgagagatgagtaggtggctgggaggtcataggggagaaggactggagcgggtcagtggaggagggagggaggaggggggatgagaatagtatcagggggaagcgggaggagttgggggaggaagggtgttcgagtgatattggcggtaggggggcggcatgggttggcttactatcgatagcagtgggttcaggggggccgaaaggagaaaggaccggggcgatagcgcatgggggcggaagataaacaccataacgtgggcgacttaattgtggtcgttgtgaggaataagcggaaggcacagaagcaaacgaagaatcgtacaataaaacacacagggtctggttctgccacccagactgtagagcagtggttcgatctccactcactgcaactgccactttctggactcaagcaatcctcctgcctcagcctctcaagtagctggaactagatacacacagcactgcacccggctaacgacagaagcattcttatgatacgatctcatctcggctcacttcatcttagtcctggaggtctgactgtctagtttcatctcttgcagaattaatgtttccag

SEQ ID NO: 20222 - DNA, 780 bp, Homo sapiens
acctttctactgaataagcttatggaggatctaataatcctgtgattctatgagaaatagtggataatcagcctttgaaatagcagtgcctcactcaaagcacctagaatgacccagttgactgcggtgcctagctggatggccaaagcgtaggacatcagatcctgcgttgtggccactgaccttttgtgtgcttgcacattcttttgttcgtctatgttgtagaaacactccacattgcccgatccttgatactttaaacttttgaatgggatttgctaaaaactgtctagcttatcttttatgccaaatactgatgttccagtgttaatgtgtgctattgatgattgcataacttacatataagcgcatcaaaatgagaagtaccataatgtgctttctttctgcggacatgatgataggtttaaaagagggaaaagtacagacttggatagattctttctctccaagctaggcactgcattggctcatcggaatgttgaatcatgatataacgttaaaatctttagaaactcctgatgacgattacgtaggactgtaagaatttactaataccatatgcaatcaaaatgctaagagaactccagctgtttctctgtatatggacaattaactggaatctgggactaaaatcggcctttttgggacatgtgcaaattgatggccttttcagtggctcaatgtacaactcggaaggttgcgggcgcaccgggggggatttccagctttcttacttatattaatggcgtattcctcacg

SEQ ID NO: 20223 - DNA, 1210 bp, Homo sapiens
  misc_feature (1)...(1210): n = A,T,C or G
agnatctngagtatnttgaggngagatgaccccngttnatgaaagtntgtntcgnnagatggaaatannggancncttnttatcatanangagacgtggnagaaanagtcagncntngnaanaagcaggananatgtgtgaaaagngcattntggtgngnggagangtttgttatnnacaggtttnganaagcgaaaaatgtganggaaagagtnatganaagagagcgttntagngacnaagngggggtgtatgcnncgncaagagtatttttttgatacncgcgctntagtttgtatagagaaagagatatggngtgtnantttttataaaaaanggagtgtnnngatntatgcccnagaganatgcganagggngagacncaaggaaanagcccntgtttntatagnagatnctgagataggggtgagaacggtgggcccacaaatatnnanaaaaantggggagatnntnttgaagatggttagnccaaganaccccanggtgangccgagccagaagagctcccannatgtggagtgaggagaccccccnananaaaaagagatgttcncncanaaangcnnangttttgtacagagaggncccccagaagagtttncccgnnccaangangaaaaagaggnttgcaaggggntncgngtatntnntntagagtgnggttcnaagactgagccnaaggtgtntgnaatgtgngaggcgaggnnttttnntaaaaattccccnnggnnaaaananccnattgagcngantnggggaaagtnattgnnttcgaggcnagaatnngantngagattgccnncccaaaaaaattgcaaatggcntngcaagctnacaagtgggtcgaacaagaaaagggcnccaattatttcgtnaacgancaacancnngaccggacgttgcacanacnnacncntcaaaagttgaacgaatttgggcttcaaagttttgcctcatntnccatattcacctntcctctcgccaaccganctatcanttcttcaagcntctcgacnactttttgcagggnaaaacgcttccacaacctgcanaatgcagaaaatgctttccnagagttcgtcaaatccccaatcgcagatttttatgctacaggaatanacnaacttatttctcantggcaaaaatgtgnngattgtaatagttcctnttttnattnataaatcatgat

SEQ ID NO: 20224 - DNA, 1070 bp, Homo sapiens
  misc_feature (1)...(1070): n = A,T,C or G
cattcacttccctaacccctccacgccccaccccttcaaatatcaccgcattgattctcagaagcaaatgtcagacagacgcgagaatgacatgtctccaagcaacaatgtgcgctcctattcctgttccaccaattactagaaaacaatgccatgaggtcgcagtccctgtcattaaccattctacaggctatttttctctctctccccgtatcaatcgctcgagtataatgcctattttctctcaagtcctcgacgatttcaaattctatcttcgcactcctttctgtgttcattgttctcgctctctcatctacctaccatcacttactcaattctactgccatgattcatatcctctccccatccgactaacctcttataacatcccctcccacctcctaccctccttcacttgtactcctcgttctcttccaccattctattccctattacactctattcatattactccttatactgacttcccctattctatcttcttccttcccaatatctaacctcatattacgcaatttacgtctccaacaccttctctaccagcacaccaccgctactnctctatatttctcccacactacatcccctttatcttcttctccctcacttaccttcacatcgttgctaacgatacttactgattccccaaccatccccatcaaccaccatcacacctcctcgcctaccttcctaaacttaatacgacttcctttccctaattcaacctacantctacaaataccattcaatctactcgacctctgaaccaatgatctccgactatctacacctcctctccctatcaaaccttctcccgctcattccattcataaatatacaccttctttctataatacttaacctgttatgtaattctgacccgtcatactatatcccctcaattacaccctttactccactctctctatcactcctcctccactaccgcaccattcaatccaatcatacacgctcatctgttacttaccttatccacatctcttaatactccacacccctaccttatcttctcttcccctctcctctcg

SEQ ID NO: 20225 - DNA, 1805 bp, Homo sapiens
  misc_feature (1)...(1805): n = A,T,C or G
cgcgctgtntcagttcgatncntctnantaataggtgncgcgcatgtgatcgnacgtaacttactgcncagataccgnctgnagctcnagcanaaactactctcactnctcattatctctgtgctattaggacgtactgcagtgctcacagtatgcatancacacatntgcgtatgatagtagcacacgagtatacgctgtcagacgtagtcgacantncncgtcgcgatgtgtggcggactgatantatgatgcgtagatgtgtcatatataatacgatcgactagagcanttctgacgnaagcacaacngtnanaccgacgcacacgatatcgaatgacacatgtggcgtgagcgtgatgangacaccagctcgcantgtagagcactgtgtacgctctnataatatcgtgtgtcgntcgtttgtgcgnatagctagtcgtcgtatctctatacgnanatacacatnatatagcatgcgangatcgatctagtagtcggtagatacatagcgtgtnggagcacgtgangtanagtcancagantagtgctcacatagatatggacgctgacaagactnatagtgtctacactgtctacaaatattgtgcacgagacantatatgnataggatagatgncgtgctatgtgntgacactacacngacgagtactgcgcgngagtagttgcatatatnacgtctgccactantgactctngactgcgatgcatgtcgacnatgtcnatcaacatcangtcaccgtcagtagatncatngtgcagtcgatgtatctgtacgtctcgcagttgtctgcgtacactgtgcgtacgctgnagatgactctcgagaagcgcgtagtgtcggacgtgtgtgatcagatgcgtgtnacgtgaagtnagagagacgtgtgtacgacgtaacacatcatagtatatcatcagagagtcgcggattaatatatgtanagatatactgcggagggctgaggagaggagatagtgcacgncgtctnatgacatgaattgtgcgtacgtgctgcatactgtgagatatagtcgagtcatgaccatcacaatcgtatacgttgtgacgtaagatatattactcgcggtgcgtgtgatgcgatnagtcatgatcagcggagattgatacgcagacgcgctgtctgaccttatagtactacgagctttgacagtatatgtcactgctttgtcatgactagagtgncttgtganacgctagcgtacgcacctacttctctccgcactccgaccgacatatattatactatgttgacgtgagttgctccgtagtttgtacgttcgattgcatctattnttagtatatacacagagtcgnatacgacgatgtgcacgactactccgccatctgccacagcgatctatanatatggtccgtgtgcgcggagcaggctgtgtagccagagtatatggagacgacgctctgcncagagngggcatgacgcggtatagtaagctccatgtcngatcgcgcaatatacgccgacactcagtgctgtatagtgattgtattntcgtgctcctctcctcacactcccgcagtagntagaatttaaagtattggcgacagcgaatagaaccgttgtntgacacagagaaaagatcaataatacatgataggtcgtgatttacttgcgtcatgattgcaaccaatgatgtgataacgtttacttgtttatgcgtcaacggcacggatactaggncttcgcatcctctgttcgctcgcgcgagcgctgcgcaggctccacaagcgtacgtagacc

SEQ ID NO: 20226 - DNA, 808 bp, Homo sapiens
cgtccagtaatcccctccctataagggggccaggaaggttaaaaaaattgaaataaatgttggcaaaagcaggttcttttttaccaagggttctaatccagggttataaaaaaagttgcagaagtctcatttaaattaagggacgcctcccgagaaccaattgaagggcttggtctttcctgggtgtcccctttcataaataataattcaacctttgatccaaacaaaatagcccaatttttctggatgcaagttggcccagtgttaagagtaatgtgttcacaccatttgaaatccatccactccccccgtccccatgttgtaggttttattggactcccattgaggaaaaggaccctttgtcaatgtagttcccagctgagaaaaaagattgatgaagctaaagatgaaagactctgtgaaaataatgctgagtttaacaaaaactgtagcaagagccatagtgggatagattgttcatatgtagaatgttgtagaacacaggagcatgcacattcagaaaacccaagccccacatggattttggaacagacagccagtttagttaaacagctgggcctatcagtagatgtattacggcacctcccccaactataaaattaccttcccttttctaatgaaaataatgttcagaacatttggtttcctaacaatcgaaatttgtactggtttctgcatcaaacacctcaactgtagggttaccctttatggaagtttgaaattaacactattgtcttccaaacccacactattaaatgtaatataagccttaaaaaaaaaaaaaaaa

SEQ ID NO: 20227 - DNA, 1267 bp, Homo sapiens
  misc_feature (1)...(1267): n = A,T,C or G
cactcctgtagagacgtcggaatcttgctgacacttcacggacgactacaacgtagcgcgtcccgccgtcgattgcgcgggccgattggtggggacgccgctgggggagtgcctctgcagttgactatccagagactccgcagagcgccggatgggtcgcctcaccgtagctatgagtatactgatccttgttgngactctcggtgggatatacaagtagantggctgtcaggactcccctctacaggggntcggcggcacacgtgagagcgtcactgttgatgtgctgagatacgtcactatgatatatgnggctagcttcgntatngtgtcgcgggngcgccgctgatgtttcagtctaactttgatagctggaggagggaggaaattagggtgacgaaccgcctgtaagggagtattaactgataanaactctctatcagagttggctgttgntctatacgaggatctcgtggggaaatacacncccaggatcgcgatgtaggcaaatgatatgtggggatggtagggagaacatggacagaccgcaactaacaatacagatcacagccgtactataaaataagctgcggtatatattattaaccgtgttcagtcggtacgcaggcgactcgaagacggctttgnnctgtctcccacctcaacacacaactataactcgaccagagattaacgctgtcgccgcttaaaatttggannctcttgtacctcactcgtttgaaatactggcctacactattnnnntctcttacgtcagtgaggttttgtgaggtgagacatttatatcacggcatgtatctaaagcatgtacaactatatatntatctctcaatnatcttttatataaataaccccatatactatcacactcnnnncctacacatatctcttctcatctgcactgcgggggcgatgcctccgatggactacatcaattgatcccctgagacgaccgtgggcgggaggagggcgccggggagagccacattccgcttgcgccttccgcgtttggcctttccttctttctcctctcttnccctctttttntcttnnntctttcctcgtgtnntcctctgccctcnccttncnnngcnnccctttnnntctcctcctcgctnnnctcccttcttncctctccttnnnnnnccctcncccctnnctcttctttcctncatncctnnatctactaannnnnacaccactanaactacctcaatcaaccactnacccatnccattttcctcca

SEQ ID NO: 20228 - DNA, 915 bp, Homo sapiens
  misc_feature (1)...(915): n = A,T,C or G
tcacaatccgtattacactcaaagacataagtcagtgtcacacnacccaaatgccttggtaaatttgttgtgcataacatatattgaagataccatagccacagcctgacatacgactacgtcccataatcacaactggaaggaaagtcatgacctaattggacaaaacaattcttaaagcttatatcagctgaaaacaaacttctgtcatgtcgctgcctttatccatcattaaaagatcgttaggattcaaaggtgctactctaataaaatacttcatgagcgcaattctgctttggtgatgaatctttcaaggcaatctcaacttacttctttaataaacatttaatatcaatggatctgagattaaaaggtctggggctgttttgcctcaagaagtgtgaactaatggcctttttccttatctggaggcaaaatcgttatccccaccacggaaaataacaccactaaccttgatggttgagtggaaagtcacattcacctgaaaggatgaatcccgattctcacacaattttggagaaaataccgcataagatcatgtgaccaaacgcccattaattggcaacagacctcaagagacccctgtattattaagcttccctcgatagtgatcccatccattgctgaaaacataaaaatgactaccacttatggaaagcggtggcataccctcccagattttacaactcacatgttacgctccaaaacccttattcacttttctctaatatcccaccgctacactgaccttcacctttatttattggaacaattggatctttatataacaatcgttccttttcctgtagactttacaccctcaatctgtatatgattaaaccccatgccaaaaagacaaacgtgcttaagttgtctgtgagcctctgtgtcaat

SEQ ID NO: 20229 - DNA, 1749 bp, Homo sapiens
  misc_feature (1)...(1749): n = A,T,C or G
cgtgtgtgtncnttgtctgatcgtcgtgacccgtgtgctgcggctatctctcgcgtcttctggcgtcggcgtcttatctcgctgtctcgatagcgnttcngatgtgcgcgcgcgttgcgcgtgggctagcggtcagcagttagatatagctttcatgctcgcgcgcgcgcgagcgcggtatggagcgtgcgtgctaagtgtcgcgcggactcgcgcgtgcgctnctgagcgcncntgacatgtatcgacgcgtggctgagagtgtgactgagcgcatcagncgtgcgacgtacgtcgtgtatcatcacgnctcactgtctcgcgngtcntacgatcgtgcggcgttctctctctctgcgcgcgcgtcgacgtcgacgcgcgcgtatctgcatatctatgactctntgcgtgtttcgttcagtgctctctccntgtcgtggtgaggtgcgcgctgtctactgtntancgtgcattactcacgcttctgcatgcactgcatctgctcgcgtcgntnatccatgcgaacgctctcctgacacgctgcatgactacgtgcgtgttgcgatgctccgcgtgcgtcgcgctactacatgtcattacgtctcgcctcgcgtttgttccagttctagtctatccttcctcctcactctcctgcgctgcgcctggcgcgcgctgcagtgcgtctccgccagtcgtccgcgctggtgcggtgcggctgtgtcctgccggtcgccgttgccctgctcgcgcctacacgccgcccattgttcgtcgtacttcaaatatattatacaactcactcgtctgtcatactctatcctgctttagcgactgtgtctcttctccgtctccccgtgcgccgcgcgctgcgcgcgccgcctncgtcgcgcgctctctcgctcgtcccctactctacgtcttgacgtgctctctcggcggtcgcggacgcggtcgcctcgcctccctcgcgctgcatagttcctgctctgatattgtccgcgtcacgtatagtcncgctcgatctgactcgcgcgggctgcaacatcttcgncacctgacctgctccagccgactgcgctttgggttcttcccccgtcctgtcacgcggtccgcccgcgcggccgccgctccgnctagtccatcgactcctccctctcctccttacgctgtcnccgtctatgacacacacactcncttgtgttgctgagcgtttcattctgctggcctctctctcttctgctcgcgcgtccgtctgcgttacggtcgctggtcgtcttccatccgtgcgcgctctgcgctggcncgtctcctgcggctcggctctgttgtgtgtaccgcgtacgcgcggncggctgccgcgacgcgcgcgcgttcgtntnttgtgtctcattctccatcttctggtgctccttcgtatntncctatctctttcatcttatttcaaaaaactctctttatcacatctcctccgccctcccatacacctcacacctcctactccnacaactcacntcatctgcctgggagttcatcttanattttctcctcttacaaaaacttactcttcttctnatttatctantagatcatntntntcatctacataaaaatatatcatatctactctccntctantcntctcttccatactctctctactctactcactccactntcacactcttactcattcttctacnctcctcatcttatntcnatcccttcaccnctcactcatctcttcctctt

SEQ ID NO: 20230 - DNA, 1191 bp, Homo sapiens
  misc_feature (1)...(1191): n = A,T,C or G
ataatcttcttatagatatggtanttggtataatatctgtaggtaaggaatgagttggagtatatgtgatgagtgggaggtgataantggctgagagcagtattgagagaaggttatggtaaaagtgacgagagctagtagtgtgtatggtggtggtctgttaaatgagcatgttcatgtgaatataaagttgtaaaactgagggcagtaactangggacacatcgtgtanattacatgctggtgtacgagctcgctgattgtgagaggaactagtacaatagaataagatgggaacgagtagttctctattcgttagataatggagaggttaagatgataatatctcaatatgaaagtaagagaatattgacgtggaaaacagacatagtgcggagggactgaaataagagtgagaccgtggacagtcttcatactattatagaagtaatgtaatagagggagaaggagaactagtgggagttcgtgtgtattcttgaaatagataatataataacaagtggaacaaaaaacaaataaactcactatgatgattgtatgttgttggactatgtttttgaatgtataggngattaatacattttttataagaaaaaataaataataacaacactaattaagattaagagagaggaggttatgatgtgattttgcagaagagtggtaatgatgatnnncgctaactcactcttattttatagaggtgtagaaatatatatnaaaatacaaatataaattattttttttttttatttattataattatatatataatatatcacattattactaaacncctnnncatttattatacctgcttccgctgtgcgtgcagggngaaaagcgaacacctatactacatctgtgtnctcatctcctgggctataaagagaagaggactatcaataaagncaatactcacgaagcgccgnccacacaactacangacctaaacttatnnatattaactnatatttaatntattnnnnctatttctttatnnnnnctctctttctntnatnnnncnncactttnntcttgttactttttnnaacttatacatnncataatttnantnccaaannnctttaaacataaacattcatatantaaataaaattaaaaactatttnctttatcatatctacctctctccatncatttttaatct

SEQ ID NO: 20231 - DNA, 845 bp, Homo sapiens
acggttttgatgatgatggctcagaatttcatggacatatatttctaggagtaacacctggagagcttttcaaaacaaggaccatcttcgccccttcatggagctggtgacttgtggtctttgcaaaaacccatatcttagagttaaacagaacggtcgaacacatcagagtggccttagagattatctctactgagaaaaaggatattcttaatccaaagatagctacagttcaattttatcccatggaaattctctatcttacacaatcacccatgcgccattcaactaaataacccaatctcaccaaactcggctaatcacacccctactaccatataataaaatctcccccccagatatataaccataccacacactactaccatcccgcgtccacttccttcccccttacaaataacacagctaaccacactcatcatgctccctcccgtcagccgcattgccctctctcctttcacttctcccagtttactcaatctcatatcagccttctaccctccctctcctcttctccatttatttccgcttccacgctcctagcaccacccaacttttctattaccatacacacccccccaacctaatccccccccctttccccatctctcccgccctcacctcctcactccacctttcttctttttcctttctatcggtctgtcacccccattcctaactttgcgctcattttacaaccttgaataaacccttacattaatccttcgtcgtctcctttccccacaatacctacttcgccaacgtttctcccctcccaacatacaaccactccaccctatctccctaaccctccttctctcccg

SEQ ID NO: 20232 - DNA, 1754 bp, Homo sapiens
  misc_feature (1)...(1754): n = A,T,C or G
ctngatanacataggtaggatntagacagatcgcacgagatagaatcgcacacatcgancgnacgacatacatgnatatcagagcacgacatgtgtagcgagatcngngangacgnggagctgcagaatgtantgtactgaggtgagcgttgatagngtangatctatacgtcatgtgngcgcactaccacatcacaatacatatacatcatcatgattgtancgctngctgcgccggagtnantacncgccgnantaacgcgacgcgctacgcgactctgcgntacgtagatatantngtgtctagtcagaacgcgatacgtcgtgcntggcacgctatagagaaatatgtagagtagtatgacgangctacggagtagntgtagtgctngacgtgaatagancaagtcacgatgattntngatgtagtcgcgatgacgtacgactctcatcacgtcgcngcagtcacagtacaacgtgacgctccgcagtacgtgtcgagtngcgagntgaagtggacggacacganatnatgtctactcatntgtagtctcatctcggatgctacgaaagtngtgtgtagatacgtgtgtgntgngtngacgntagtcgacgtgcgangngtgcgatgtganatgacgcgtntatagagntaccacgctgttgcgtgcggagtccgcactcgcgtcactcgtncgttcgtactgagtacgcatgtcagtgagagagcgatcgatgnacgtagagtgtgcgagagcacganagatacatcagtcgatcgccgcacgacatatacagcacgagatgcttgtagacgtggagatgcgtgcacgaggatcgcatgnggcgatgagtgcgaatgtgcgcgtgaaacgagacagtgagtggcgtgagtgcggcgagggggacatgtcgttgtgcttctgtgtatctcgagaacgcacgacagtgagtgagctgatcatggcgactcgtcaccatagctcgcgcgctctatatttctagatcagattgatgatgtcagctnaagagcgttgtgctaccacacatgtagatgagattatgcaaaatagaaataagnagtataagcgaatctgccatgaaccttcttaatttnnnagctatactactcactttagtctcatgacatggatgctctctgtattgcgaaactggcactgacagactgggngagaggcttggatgcggtcagaagattatagtcgacactcactggagctgcgagcatgtaancgcacgtagcacatacaagaaacaacatttgggcgcttactgagataatgtaagggtaggtgtgatgngagctctgtggacaatggcacacagtataagagaactatgcatcacagctatgtgaanaacactcgttcgtctataacagcagtacgtcagagtggcattatgattcataattggtgaagtgggagtgagttgtgggcatagacgatagtgagatactattacaagatggagtgcaactacatgtattatanagtctatgacttaagatgtgatactgaaggatatggngacggggcgatcanaacacgtcacatactgtctagtaagagtgcgcgttcgtattatgcacattgtgacagatattactgaacgctacgacgaagnatattagcgagaaccacaacgnaggtgcgtagactnacaggatatcaganacagtgaaagtgatcagtgcaacatactcactcactctctcggttgcagcacatctt

SEQ ID NO: 20233 - DNA, 1892 bp, Homo sapiens
  misc_feature (1)...(1892): n = A,T,C or G
cgtctaagactgatgaatactganctgagagtactcagtcattcatcgnctttagctacatcgantcgagntgtaacttcgaagngtganctcagtttatncnatctgcgatgtgcncgtcgncagcgntctgactaanagtctgangancggtcatagtcnagtntcgctagctgagnggctgatcngaggnntgntnctcgtagtgcagtngtctatcagtatgatggtngtgtcgtcgcgtcgacgatgngacgtcagnngtnctngtcgtcnactcnntgtcgtcgtcgtncgngngantcncgagacacggcgcttancggacganacaacgctgcgctcgctgctactgcctcgatacanncnngctntcatactacactgcaatgctatcgatgctgctactcagtanaagtancnctagngtgctacgtgcactacatgacgctgctgcacngnccatgcacacatatagatnagcgcgacncagatcacgcactgacnatgatcgatagacagtactatatancgcgtcgagantcagtaccgcgatgacacagcgacgacgacatctgtgagtgaagacatatacgtacatgcatatntnctgcgacacatcacgantntatatgtgacccgatctatcatctagtcagcgcgagcgctgacngtgggacaagcagactatagtctctgatgatagtgacgcgcgctgtgtgtgagtgagtnagcatcatgncgtatgtgactatagntagtancgacgctacgcagtatagtgctngnattatgtctcgcatcatgtactnatacacntgtatggactagcgctctcgatctagcntctgcatcgncctcacgtagagtgtngggantgaggcacnggtcgacacaaatctctcgcatctgtatgtcgttgcaatctatatntgatatgttgagctgcatgtctcgctttctcgtcangtagcttctattcactctaactatgatagattaagcgtcgtcaatgtgcgtgtaggtagtngagtcgtgagtgacatgctgacgtcagagtgacgcatcatgtntatctatgtgcatcgtcgatcactgntancagctagcgcaganctgaagagtcgcgatgtnaatgtgctctgagcgaggacgacgntctncgcantnatacnctacgcatgactgctgcgtcatgtgagtgatctgctcgctgacaactggtagtcgtatgatngagatcatatgtgtctntacgaacacgtcattctactaagtagtatatcacacntgagtgagatatcgagtgtgtctgacacgtcgaagaacgtcgagaaggtcgtngtatagcagtgctcagcacaggcgaccgacactggtagtgagcgcaattcgaagcnggtgtcgcgtgcgcgccgatcgtcgcacgacagcaantncgtganagataaactactattctgagtgcgagatacacgcaaggtttagtgcggagagcgttctgccgctgagtctgttcttctctcatcactgatcgcagagtggtcataatacgtcggtctcggcacactgacagtgagtccgcgcgatggccacggtagcgcgacagataaacagtatcgtggattacatacatcatgtgctttgtcgcncgcgcaccgtggctctactgcgcatcngcgggcgctctcggtcgaatgcacacggaacatataggacgaatcgagtaaagatgnacagggggagcgggttgtagtgggtgccaactaaacngacgctggcacactcgctggtgactcgcttcataatatgtgttctctgtctctgcgccattatcttacttctactcgcttctctnatacctactatctctctatctacctcctcgctct

SEQ ID NO: 20234 - DNA, 1378 bp, Homo sapiens
  misc_feature (1)...(1378): n = A,T,C or G
aggtgcgtagtggcgaacgatgnacactgcacgcgacgcgctgagaggcacgtgcgtgcgacatcacgacacgcatacgttgcggcgcgctggtgagcgggtcgtcttacagcgtctaaggcgcggcggacaagcagaagtacgtgaaacacagacctcgtaggcgtcgaacacactcgcagagatagacgcacacgtcctgtgcgagtgcaccctacgactaaccacatacgtatcacctacttcgctctgcctattcgttacgtgacgacatgaggcccagggacagctgtctacgtgagcggctgaccacagacgcgggnggtcantagtctaagtgctgaatagatcagcaaacgtgcactacatacacgtacgagtacacactctcacacaagtccgatatgcgcgaggttctgcgacgacactgctcgatccacagacgagccaggtacatattagcagagagtagcgactatactagtgggacgccaccgcatactaggtcgctatcgtggtgtcacttatangtgtctgcacgcgatgtactcggttagtacgatgtgtctgggctgctctccgtcatcgttcagcgactcactataccgaatcatcaccgcgcgnagacgcagaggaganancgttgtgcatgtagcgagcacgcatcaccgcacatccatcgcaacgactcgtcacacagtgcgtacacgcctcatcgcactgcgcgtgacaccgtatctgacggcacncgatctacgcagacacacgatcgngcagcactccgaccaccacttatatctctccgatccatccgctcgccgaagctcgtgtcccagacttcagatagatagagggtgccgcgctacacctcgcgcgcggcagctgctcggccctaatcgagatagagtgctccaccgccccaccgaaccacacagaaaaactatccaggctcgcactctattgtgcaacgtcaataccaacgatgggatcccagagaccgaaaccccactctgatagagaatagagataattacatgtaagtcccccctacacacatcctcattcgactcacctgactcaccaatctcggtgccgcgtcgcgcaccctctctaatctactcccacgcgtgcctcgcggcgcatgctgtatcgagcaacgacgcgtaagtggagcagatatcacgcctcgctacgcgcagctcagcgcagacgctgagcattctaaatcattcccacggaacaatgtatgacgacgtgaaggatacggcctgtaccgtgttaacacatcgcccaggtctgccgattcctatctaatcgcacctcgaaacggcgtgactctagatgggttgtgtcaaactcccacatgcgcgcgcatgta

SEQ ID NO: 20235 - DNA, 1056 bp, Homo sapiens
  misc_feature (1)...(1056): n = A,T,C or G
cttatctgattcttctttagttatcttctttgttgctttggtgcggttgtgtggtggtccgcttgtctgcgtgtcttttgtacgtgtttgttgtttgatattggtctggtgaggtctgatgcgtcgttctatacgttgatgtaatttactaactggctggggtgctaatgtgaagacaggtgaggtgttgtcgaagtggactatcatctcttacgttatgatgtgtacagggtgctttcctgtgctactgtacccgtgtgcgcgtctatgtcgttggtgtgaagcgtctgctgtggtgattgttgcggttggagagtgtgcctgacgttcgcggacgagctcggtgatgtggtagggttgagcggtctatagtcgtgcggcagtggggtttccttataacgattttatggtgtncagccggccgatctgttgctggcgtctgtggcctggtgggtcggtgcttggtaggtgtatctattccgactgtgttgtccgcgtttattttctttgtctagtcttttctgtcgcttgctcttatctcgctcttctttcgtccgctctctgccctgcccctcttgcttgtctcttcctctctctctttattcgtctttctactttctctcggtgggagggcttatgagtggtttgtgtggcgtgtcctttctgtggcgacgtcgcgctcctcatcctcgcgcatacttttcgctaaaaaaagaattcctttctctcttcttctcctccgtccctcctcctcgtctctcctcccctccccttccctctccttggctctcctcccctgcccccttgcctttgcctcctgttttcgngcttcgttcgcccggcccctcccctcgcctctcgcgttcggctttctgtggtgcctcntctcggcctctccccccctctctgaaacnctcttccttttgtgttttctcccttctcgctctgttgcccccncnccaagcttctggtttttgttnccccattagcttcttttttttcttttctnttaaaagttnctncaccnnnnnnaaataaaaaaatatcttaacacca

SEQ ID NO: 20236 - DNA, 271 bp, Homo sapiens
  misc_feature (1)...(271): n = A,T,C or G
ggcccattctggacctcgcccagggtgagctggttcctccccccctgctgagatccctagcagctatccagagccctgaaaaaaatagccaatagtgttcacactggtagntccaaacagctcacagctaaggaagctgcgctcaatggcctgcccgccacctgaggcgccgacgtgcctccatcctccacagattctacgcccccccgcccaccattgccctcccaccgccgccccacttcctctccccccctcctcttccctcctatct

SEQ ID NO: 20237 - DNA, 2253 bp, Homo sapiens
  misc_feature (1)...(2253): n = A,T,C or G
agacgcacagagctgtatatangatgacgtgtgctgtcaaatgatcatncccgtatgactatacatagcatgcaanaagctacacatcatacgatcantctncgatantttgtgccgnctgagcgtgtgantngcatcngcnangcgttgcactgattantcatgctntatcgtcagtgtgactacgactgttgctacntcagactgcagtngtcattcacgattantanagtcatcgtcgagtgangatgatcgctntngtncacctantngcgtgtgtcagcacgtacatgacgtggatgaatgantattatgctagatgtcacacagtagctcacgtgactaagaaggacgtcacagtacacngatatnacgagcgagcgngacatgtnganangtcgatcgncacagtacttagcagtacctcatagtcantaantanagtantcttgncgtgacnncncatgctcgtcagcgacgactcgatcgtgacntccacatactactgacacnacgcaganctgctcgtngccctnattactgtcancatgcanttcatcgantcgtngacgatggtanagcgagtagactgtgagtgagaggatggtgtngcatagntgtcngcagntcgcaagcngtgaggagtagatgtgcggatgtggagtgttnntgtntgcttctctngcccatgaacgcgacacacagcagcgctctacacagcangtatagcacgtacatgncacgatacgtcngcacgcagagtacacagtagncntcgcgttactgatcatgactcantnctncagcgacgtntnacgcangantgcagacctgncgagngantgtagagacagcgatgcgacgcngatactgnagatagctnagncccgtcgacgacttacgcagtggagcagtctncgatctcactgatggtnctgtaacagatcgcatnggannatcggaccgatgttaatacantgacgtcagatgctagcgcaagagcntcgacatagcagctagagactgtacatcantgcangtnggctcgtnatgatncctanacnagcagtcancnacgtcatagccacagacaagagtactcancagntagtactgcgctgtagctctgatcagnatgagattctacgacnanngtcntcatgatcgtgctgctagtcgtctgtctgctatgttgtnttgatnactncntcgcatcngcatggtacgacgntgntctctacntgctgtcacagtcagccgctcttaactatgctgtcgngtcgatcnactcncgacacacgttatgancagcactanagcangatnaactgacgatatgtngagntgcagtattactgatnggatacagnnggncgatncgaatagcnggagtcgatgcagtactncgngtggtcgtaagntanangtcagcagctgcactatcagcagtactatgagtgcagcaangcacgtcgagaangattcgtacngctncgtntcactgcatnncgacnantncaactccgcttcatntcatgnanttagtagtnacnangtgtangacntcnattactggannctatagtancgacataancnctgctgtgnagtgcaaganacngcagcgcactgncgcngcntgctngtngctgantacgtcggncagtgctcggaggtgagtgagtatgtctcgcactcacatcagnatctgtgtgatcnctgatctgtatctgagtgtnatgnctagctgnnatcattctagtcagtcatcagtnattcctcgtgtcatnctgagcgngtgncncgtatncgactgatgactgtctgatatgcntcgctgactgtacgctgtagtcgtcgacntagnangctgctancgcatctatcntatcacatgcagtacgcagnatgctgcgtttgctctatngctctcgntnccagacgtcgnttctatatgtgntgctgcatatcngcgcgcgcgagctgcagcgtaagtcagtcagcgtctgctcgacnctgcgagcacgttgtatctcgtctgagatangtcatgtagcaatgcactagactcggcatctgtcgtgatctctgancactccgtcttagtcacgcatatggacacgtagcgnatgancgatagcactctgcgatatctagtctgtctcagtcgatnaagcctatagcacctgcactaganantagtatcgtgatagtcangacagatatncntcatcanctcatgccattaagtcg

SEQ ID NO: 20238 - DNA, 931 bp, Homo sapiens
  misc_feature (1)...(931): n = A,T,C or G
cattctctagtcgcccgagggtcgcagccggctttcaggggtcctgctgaccggactcaggcttatcccgcctgtgccgaaccacttatanacccgcatgacccacttcctaaagcagagtttctctttgncagactcacaacgatgcagatgcaagcctgaatcagaaactgaaaaccttatacaaacgcctgagacagcacgcttattttatttcttatggcggaacatgctcgtataaacaaacacattaatggtgtccctaacgctgcccacaaacacgatgaggactcgccaacgacacctacctatcgcgcccctgcttatgggccgacggggatgagccagacccgggagtcaggcgttctgcgacggcccatccgttgccggcccggatagtcgcggattccgacgtctctctcacacggcccgcccaggacccacaggacgcccaatgcacagatagtcggggagccggtcggcaaacaggggccagtcgccgcgctcgagtcagcgtcgcaaccgtgcagtgcgccccctcacgtggtgcgtgaccgggcgcccagggtgagctgactcgcagttcccgccgcgccggctcggtccatttgtagttcgtatgaccaccccccgcgttgtggtgttgaggctggcgaacgaggcagcttgtgtcgagtagacgccctcggcccgacccgctcgcggactgacgcacggggtcgtacgcgaaccggaccgcgatgtgcagagggctgaccgtagtgacacaaacggntcgccgcgcgctcgatgctacaagctatccaaggcccatccgagagcggagcgccgaggtcggacctgtacgtagcgcagatcgccctgtgagccggaacgccgtatagaatgcaacggccatcgtgtcggcacgtcacgcccgcgaccgcaccgc

SEQ ID NO: 20239 - DNA, 2207 bp, Homo sapiens
  misc_feature (1)...(2207): n = A,T,C or G
ctcncgtnctcgtcgtcgttgtgatcatcgaatatctacagtagcgctggcagcacctacgccgtagaggcaggancagacgcgcacattggcgcgatgtnacntcgtcnagctgctnctgctnangcgctacgtgtcactcttctatacgcactgacgaaacgtagcgctgcacnggctgtncctacgtncgtctatcagtcacncagcatcgagtntactatgatacgtnctacgagtcgacgtgcgagtgcatngacactaggacggtgatngcgagnagcacgagcgtcgntgctgtgtagnggatgatggacgtcagagtcgnttgncgtnacgtcntgctcactgctcgntgactactgcgcagcngcgtangtcagcgagtacgattacgatctcccagctgtgtgantncagtcgatagatnagtacgcgccgtanagtagcacatcgtgactgtgctacggacgacgactgactagaggagcgactatacagatgacactcgatgcnggcgtanatctgcangagctgagantatgacgatcagccacgcagtacaccntgtagacatcgagagtatacgcatcgtctatgtgactaagtgtctctcgtatactatgtagtgcgagtgtcagaagagtacgagatgacgctgnaggtgtcgcagtgtagtggtcacacgcgcacatgcgcacgatctagtgtgacagtntagctatcagcatgaagcatgtaacagacgtcatacgcagtctagatcganagagacatagacgcagatgtgcganggtgcacgntngcatcggtgctcgcggcgctgaaagctatacgaatcactagcacaacgtcaagcgagacaagtanngtgttctgagacagtacantatgatagagagntgcgagacgacgtcannacgacgagattatcttgcntcgcatgcttccanatcaacgtcactgantnctnagtcncnttatgtantagatcaggatgcatacatnactancntatcnaacgctcacgtactaanacacancacatactatatatgaggnatcatcagtctcactantttccgctnccatactatcatcgtaacgctagtantcgtntcggtactcactgcgcgctagtcgttacgctgtactggtcgtaatngatnaagtggatngncggacnacgtacgtatcgtncttncgnactctcatancattagcagttgnagngcgacgacgtcngntgcgcgtcacaganagcattagtanctctgcgacgttngcgnncgcatctcgntcgttcgtacgtcgacgngtgatgctgcgctgtcagcgtgatttgtggcgtctgtgtgtcgtgtgactgacgtgancgcggctagacgcgactngctgatgagtcacagngcgctagtcacgtgatntangtcatcgcgaagnagggcnagcgtcctagttagctgtgtatcgcatgcagngcgcgaactgcgtcgaagtcgacacangcgnccagtncngactnaactctantgntatcatcagtgtnacgngcaactagtggatatcagcgatctatgntcggtcggtgncgcgctgccgtgcactgcgaatgcgcgactcgctgacagcntnagtctgatanggtgcgcatactatgtcactatangtgtgcgacgtactcacgtgtgctgcgcgagcgctgctgcactagtantacagactactantatncgtgtatgtacgctgcgctnagangnatgatgngcgttatcgangcgcagtanttacnanntctagnatacnatcgacgatgagtngtctgagaatctgatgtgtcgnatcgtgctgttcantctaggtntngcatctcgcgtcttcgcgtacgctgaagacactgcggngctgcatacagatcgtacgtgccgacaatcaccacgctgcgaactgatcacatgatgcagtcgcggcagtgggacgccgtgcagtctcgctcgagacncaggctgtgctctcgcgatcacctcgtctcacatgagtacaggtntgcttggcgtatatgagtgagcgnnctagatatatgatccgagtcgagcgacncaagcacgactatcgtgtgaccgatgctcactgagagagtgtagagcgtacatatatgantatcgttccancactctgccgatcgtcagcggctagcacacagctgc

SEQ ID NO: 20240 - DNA, 879 bp, Homo sapiens
  misc_feature (1)...(879): n = A,T,C or G
gggtaaggtggaggggagtgcctgagacgagggtcaggaggtccgtactgtgggtgggggggtggagggcgaggtctatgcctgggcggggtgacggaaatgagggtgggtggggtgtggtggggggggagaggatgtaagaattaagtgcgcggcgtgatctgtcaaggtggctcggaggtggggggagcgggggggccgtgtggggggttttgcggcggggtggggtgaggggtgcgcgtcgcgcgatatgcgaagaggcgggacatattaatagcctgcacgcatcagagggacgctgtggggctatgggtgggggggggcgtatccagaatgtctcacgcagcgcgggtggggcggaggcgacggctggcggggggggggcggggggcgggacgaccgggaggccggaggagtttacaaattaatacgggatagacggcttaatcatactccgggggcgggcttggcgggggcgcggaggcgggagtgcaaggctcttctcgctatgtcgggggtgctattggtgtattacgttggatttgtctccgacggagacgccatgggtgtgggcggtaatgtggggtgcgttaatggttctattaattacagagaaatacacaaatgactcgcctattgttttagtttggtagtgtgtagtctgggagttcgtcggtggtggtatttaataaggagttgttcggtttcataaaaatcttggctttttattttgatttaatatctgtgattttcattctttagtatttcctccatgagtaggtggatcaatgcttgtgctntagtgccaagctaggnttcttttttttttcttttttcactatttcataccatataatatacctatacatattataatta

SEQ ID NO: 20241 - DNA, 935 bp, Homo sapiens
  misc_feature (1)...(935): n = A,T,C or G
tatataaaaacgtctcaagcaaactatagcacctgcgcgcgtgagnggttgcccatatcctgaaggccttgtgatcagatgtcacgagagcttagcgcgactccattcaaactactacaaacacaagtaccctcgccccagagacaccagcttcagtggcctgtcagtggaagagtacaagctgatcctgaccacagacaccttggaagagcttaaggaaatagataaaggcatgtggaagagactgcatgagaagtttgcccccacaggtactgaggaggatcataaggcctgagctcatgccttacctattgcactacctaggcgtggagtcttggacattgcccctatccatataattcccccagataaccattggaagcaaacactactcacgcccttatacgcccgcactagtggacctctaacgtaatattctcttgcagtgagggacacaccacgatctacaatcattaacttaattgtgttaggtccttttcagactacccctgcaaatacctactacatatgcaagccattcatattatacattacctaaggcgtaaatcatttcccctcgcatttcatactatcgacatatgtacccccccagaacacaacgatatatttattgtctatcgacatatccgaaatctgttacattactaccaccactcccatggatctctatgtttacaatcgcacgacaataacccgataaaaacaaccacgtttcctacacgaatacctctctactcctccctcgatccattccccgaccaacacccaccccccacttacccagctacactattctctcccacttaccgttctcccgccgccctccttcctattatatgatccatatgcccgcacccccgatatgctcaatttcgccgaatatgtcatttacattagtcttctttatacccact

SEQ ID NO: 20242 - DNA, 1255 bp, Homo sapiens
  misc_feature (1)...(1255): n = A,T,C or G
ctnattcatatgctgtgtatgttgcatgtgtcgtcagcgatcttgagtgcgagncagacgagcatatacgagagagcaggaagncggtatgtctcgtggtgcgagcagacgagctatacncncgagcgcgccgcgtgtcagtgcgcagcatgngcgncttgagtcgcgagttacatacatatagagcgtgctggcgtctcgcatatctgcataccagatatctagnctactctaggagcgcgtacgagtgacaagatgctcgagtatatttaggatacgactactggtcggtcgacgacnagtagcgtcagtattagatggagagcacggtcgtcactacgtaacagtagacgaggtaactgggaggccgacgtctagcagatgcgtcgagtacgtacgactgtacgacatagtacaagacacgcatccgcgcgtcggtgggaagatgagtgcgagagttaaggtcaatatgagtatgtctgatgtgtaagtatggacgaataatagaagacagtaacgcaaaatcgagatgagtaaacaatcgtaaagtaatcaatgagtctccgttgtgacgcgtcgacggcacctagacaacgataaagttgatggctccacacgcaggtcacgattaaagtgatgttcagatgtttttttttatcggtattggttgtttcgaccaccgaatcatagcgacatgcggtaagtatggcataatcggcttgcctcagcctggcgctcgggtatgcgtgggggatgcacccgcgagcagtaaggctcatgcccgactgacaaaggagggagtcattactgtatcagtatagacagaaggggactttaaagatgggtggatgagtggagaggagagatacatacatacttggtaggatgatgacgaggcgcgtaacccacttcctagatcgggtgcggaaaaagtgggcatgggatgaactcccagcgaacacgacttggagaggagtaagcgctagatggtaaggcctgancgctcgggggcgagacaactaaaggcaacgcgtagtgggcgtcgcgtgacgctcgacctctgatagcaccaatacagagtggcataaaaggatgaacaggcggagagcgaaatactgtgtcatgtcacacccgcggccgggcggtctcaggctccggtaggtgatcacagagacttgtgatatccagtgtacgtcggcaccgattccagaggtcttctaagaagtattaaggaagacgaacagcactgtcacac

SEQ ID NO: 20243 - DNA, 785 bp, Homo sapiens
atatttccaatgcttaatatccatataattgatttttgccatctgcccctagcctcctagaaatcccttaagaatatcttaaatttgagcttagcaaatctcaaatttggtaaggttccctaggattttttggaatcctggatcatatccccaaatccaataaagaaggtttattgctttgttccaatctgcattctctctttctcaatctgtctcttcccatgccattgtctaggattatagtataccattaggtagaaatgagaagaagtttagatgtttacccttgccttgttcttgattttcagagaaaagcattttatatttattgttaaacataatattagctctagattctttgcttgttttatttaagctcctttttatgtggttaagggaattcttttcttgtcctagtttgaagaaaacttttatctagatgatgttggattttattaggtgatttatttgcatttagagaaatgataactttttctcacttatttggttaatatgatggagtgaattgattttcaaagtgaaattgttattgaatttatgggataaagtctacttggtcaccctccgctatcatttttatgcattggtgaatcctaattgtattttataaaaagtttatacatgcagtatgtacatatatagatacatataaatatacacacatatgaacaaactcatattagactgtagtttacttgtaatatcataatctccccttgccattttaattaataaagacagtactattaaaaaaaaaaaaaaaa

SEQ ID NO: 20244 - DNA, 895 bp, Homo sapiens
atttaaaacacaaagcatcgacttctgaaagacacgcagcaactggcaaacagctagaaaaaaatcagttggagaaaattcagaaagaaacatcccttctccaggagctggaagatttgggattgggtaccttaaagatatacggaaagcaagttgatgaccagaaatcagtgcatacacatctactggtaaacctattggaatacacatgaatattccctgtgtacacacttaatgaaattctataatcttaactatttatacaacattatactacgtgtaaaattatgcaataatgcctatcacattgatacttatatcttgcattggatataatgacaatatgtgatatataaaagagatacctgaattgtctacctaacgctgccagattgaaagatacagcgcctttcttccctgtccagggtgatctctacccggcccattataccacatttccacccatttaccaaccaaagccacctctcacatgattacagccacctcaacctgagcctacttacacttataccccaccaatctcacactctactcacctctaccacctcctctatacaccttccatccctcatcccactccgtctactcttacccgctctcatccatacctccgccgtccattattccccctccctccctcccagtccagctctagccgcccatcacctgccctgccccttctctctcttcgtctcgccctcaccattgacacgccaaactctcccgcgcctcctccccctccctgctcccacatctacctcgcttaccagcctatgcatcccccccccccacccatactgactatccgctcttttctccccacccacacttcacgcccttatattccctttactcccactattctgtctctcaa

SEQ ID NO: 20245 - DNA, 1044 bp, Homo sapiens
aagcttcgtgctgagtgtgtgtaatggcagaggtcggatgctacgttccgtctctcctgcccccagccgatattgtgttcattccggtgctgtggatgttgcacgttcatagctccgtgtggtggcatctaatagtgatctctaatctgtagaatgagtataagggtcgcgtgggtaagcgcaggaccatgttagcggttattgtagatggcaggggattagttctgtaagggttggttatgatattcatgtggcttttgcttcggcgttcgtgtattattttgttgtcgttaagttattgatgtttttgatgttatagtcttcttggatgtcttaggtatctactcctccgtataactttgtaattctgtttggtttgatgttagcgtacgcgatatgaatatcttacgtcagattgttgctgatgagtcgtctcgtggcggcacactttcttagaacacggtgaagagctaccgaccgagcccctatgtgcgagcccgctcctttgtccttattctaattatgtgttgttgcatcgtcccttcctgcaagcgcacaccccggcacgcttggctccgatcgcctataactatctgtgcattgtctcgccttcaacggttagccctacttgcgggaccggcgtggtgcggcgcggggtcggggagggcgaggctgtcgggttgcgggagggcgggtcggggactgtgttgggacgctgattcttgtggtgcttccgactccatgtattctctcttgtttactcttttctttatacagcgtgtacaattttacaagtggcagctacgtaaactattccactctcttagaatgctattggcacctttcatgttgattccgacctgcgaggctcgcatgcttttgtgtatggggagaatgttagtcagtggcgcttttcgctgattaggggtgtcttacctagttgggtgtgtcgtttttatttgtctctacgcttgcgtattggtatttttggctggcaacactgtggtcgataaatggccgtgcatcgtcttctgccttcgtgtc

SEQ ID NO: 20246 - DNA, 376 bp, Homo sapiens
cttaggagctacagggagctggttgctgccctggccatggcggagaagctgggctgcttctggcccaatgcagaggtggacaggttcttcctggcagtgcatggcagcttctggagccttgggacagagcaggcccacaatgccccccttcttccagccaagaagagctcacaggagtccagagtagccgaggcttctggtattaacctggaagcccccctggctggaggccaccgccagcctaggaaggggggagggacgtgaccttgacttacctgtggaaagggtcccagcctagactgcttaccccatagccatattttgtggatgagtgggtttgtgattaaaaggggatgttcttggaaaaaaaaaaaaa

SEQ ID NO: 20247 - DNA, 856 bp, Homo sapiens
  misc_feature (1)...(856): n = A,T,C or G
annnttnnngaaagtgtncattnngggattntngngtaaagnaacccctttnangtnnnannngagnntgtntatgggngcntttatnaaaacttttcgaaaatannnccgtnnaaaattaagcccncatttttganaaagggttnnttccanaattggaggnttttnncnngangnattcctttnnncccnagggaatagaagtttnangnngngnanttaaccccccgntntgangaatannntaagaggctcccntggaantanattgcnangnnnntggccaanggnntgtaaaggggaatttanaatggggcnnanattttnaggtgatttttnactttaaaagcaaaatanntttaggntnggncnnaangngntngagcntgnnaatnccnnncactttngaaggattanagatggcgggtngnttctaaaggntcnngnaggtnctaggccttcnntgggnanacnccagntgaacctagtgttcnanntaaaagaaagaaaantgnnnaggaangaaaagataaaaaaagccgcacgtggtgcgggtgccctgtagtcctggctacttgggaggctnagncaggagaatagcatgaacccgggaggcagagcttgcagtgagctgagatggcgccactgcaccagcctggatgacagagagagactctgtcaccnaaacaaancaaaacaaaacaacnaaaacaaaaacnaaactactctagaaaggggntaattgtttcctgcttcccacaggctggaaggcacatgtgaaactgagcccctttgaccatggaaatgcaggcccnatatactagcatactgtcaagcaacaagatctggaataaat

SEQ ID NO: 20248 - DNA, 898 bp, Homo sapiens
  misc_feature (1)...(898): n = A,T,C or G
tcttaccacaaatttaatatcaccaccaaccacgccccttagagataccaaaatgatgtgatttcaaaaagcaaataaagcaaattcaaaagattttcttatttgagtgcaaaatgggtcataaagcagcagagacaacctgcaacatcaacaatgcatttggcccaggaactgctaacgaacatacagtgcggaggtgtttcaagaagtttgcaaaggacatgagagccttcaagatgagaagagtagtggctggccatctgaagttgacaacgaccaactaagaccaatcatggaagctgatcctcttacgactacacaagaagttgccgaagaactcaatgcccaccattctacagttgcttaggattcgaagcacattggaaaggtgaaaaaactcaattaagtggatgcctcatgatctgaccgaaattcttaacttcactgctttgaactgcactttttttattatccccacattcataaccctcccttgacggattgagactttgatgatcaccgcatttttccaccacctcgtgacattcagtcaccgatcgcaccaaaaaaaatctaccacccctcacaccatcctcttcctccactatccgactcggtaccctaagcatttcgcatactcttatcccttccctttctctcttcctccactcccccctctccctattcctctcttttccattaactcctctatcacctttctccctatattcctctcacctcatataccgcacccaccttctcctgtcttttttattattaacaattaccccctaatacagagcaccatcatactctccccgactccttcatactnttccccgtttcctctctgtttcatatgtgctttattctattgtcctctatatgttatacattg

SEQ ID NO: 20249 - DNA, 829 bp, Homo sapiens
  misc_feature (1)...(829): n = A,T,C or G
tgttgatggaatgagattatgtttttttattnnnaattgatgagnngngggattgataattaacttagatcgnaaactccaccgctgtggccaacgaggccattttttttttttttttcctgttttatggtatctttctctttattgaatttcacaatcagatcaaggattgtcttccatattttattgaattgtctacctgtattatcttgtatttcactgagtttccttaagagcattatttagaatttcttttcgggcatcttataaatatctttcacttcagggtctttgattagagacataatgctctgaaggtgtcatatttccttgctttttatggttcttgggtttctacattaatatctgtgcctctaggcgaagagttacttttgaaaatatgatgaattatttttcatatagaaagactttattttgtctagaggttctatgacgtcaagcggtaataatgctttggttgtaaatccggccacattcacctttaccgacactacacttttatttttctgttgtattttacttatttgtcacccacactcatgaacaatattatccatttatgtatcttacatatccatatggttctgtggaccacctaatctttaaattacctctttatagctgtcaatatcttcttcttattatattttatttcaacatcgcatccccctaaccagcccaacagtccaacaagattcccgatctctatttcctctctttccctataatctgtctgccatcgatttattattattctcccactgtttacaatgatgtcatttatatatgtctaattataatatataag

SEQ ID NO: 20250 - DNA, 914 bp, Homo sapiens
attacgtatcttatccaccaaagagagagggagccctcctccaggactacacagcaatgaatttcccacatcagccacaagaatgaccttccggcatacaagacacttcttaccatgtaatgcaagggtaaaaaaagttcaggtacttcaataggatgttggaaaagaagacttccactctaataggatgaaaaaatgatcatttattcacatcattctgatttcttttaattgccccacaatccactataaagaagattcgctctgaccctaacttttctactttttttccccacttttctctcacataaattaggtgctccattctttctcctcgttactgtcctatctaccccattctccgccgatccccccacaggcggtcccctctccccctgtccctcccctttcatgccttgcctacccttctcccctcctatccagcccctggcttccctcaaacaaaacctcaacaccccacccctcacccttttgccccacaccctagcaatcgtctattagataaactgcactccttttctatcttgccttaaatttccaccaccatcctcgtccacctcgtccctcccacttgtccctttccacattcacttccccctcctccctctcctcctcctcccctccccacctccctgacatctacgtaaaacttctctaccgactacttctgtccatctccaacgctcaccctcttcacttcttcccccccctctgtttaacactcatacatgaccctattataacacgcaggcgcctactacatacccaataccaccccacccccccctctcttccacccactctcaccaactatactcactccgctctacccatctttcttttccctccgcccacgtacatcctcacgtcatccttctctcccactacccgcc

SEQ ID NO: 20251 - DNA, 780 bp, Homo sapiens
ctgaggttgcctaggttgaatattgtcccctaaactcatgtccactcggaacctcatggaaacacaaactttgcagacgtgatcaagtgaagaggacatcatactgtacagaaagggatgtgcaattttgcccatgggactactctctggagaatccccaggaaaatctcacctgcagctgctggcatcctcctgaagactgtctcattgcaagccgctggccactgaacgcagcactgggctggtctctcctgactggcttgccaaattttgttcctggaccaacctgagggccgagctgatatttctcatggcccagtaacaagaagcacatcaactggggacgaagagaggcccactcccgcaagcgtcgccgggccccgccccgacagttctcgccccgctgtttgtgccccccctcgatcgccgcacctgcacccccgctcgcccggcatcccacccgcccccctttccctcctccgttccaatcagccctccctccgcccctctccaaactaccacgcctacccccccctgctccgagcccctcccgaccccaacctcccccccactccccatcccatatcccctctactccccctcccacccccctccgcacccacccccccatccgacgagacacacaccccccaccccctcccccaccctccctccccccgatctccccacacacccccgccacacagtggcatccaccgcccgatctcacgtagtccacctcccgacacgcgccccaccccacgcagcccacgcccctgg

SEQ ID NO: 20252 - DNA, 786 bp, Homo sapiens
  misc_feature (1)...(786): n = A,T,C or G
aagtggatgttcactgcngcataagccttaccagcctgatgtccaactccagcgcaagcgccagcaatccacactttcacaaccaaagggtaggcatagtcagaccacaagagatccgcacagcaaggacacgacgagaacacaaggggcccaccacgtcatgaacgtgaacctaaccttagccggacaggcaccgtccgacgggctggtgcgtgtatctgcggaccggggaggtctggttctcccgggagccaccccaccaacaacactgaggggcaccgaccggacgaacgggaagaacgagcccgaacaatgttacatgcagggaaaaacaactgcgtctggattgacggcgccaaaaatagtgaactggaccaaaactattttaagaaaacactatatggcagaaatcctcataaagctaaaaaactgcggaaactcccaggagacaccagtaaagtaaaggactaaaaaaggaccttccccatccctatgcagaggaaaccacatgacctccacatgaccccagaggaccagaagagtcgaatacctccacaactacctttggaggggcgagcaccgcgccgcacgcccgaaaccgcacgcctcgggaagacgaggtgggaaaagcaatgccggaccccccagccccaccacagaccacgagacccacgagaaccccccgccaccgagaagcgcaccaccggaccaagcccacaatccccatgcccacgcagccgcgcgcccgacacctcgcaccgcagacgccacccaacgacgaaccac

SEQ ID NO: 20253 - DNA, 818 bp, Homo sapiens
  misc_feature (1)...(818): n = A,T,C or G
ggggtggatggtggaaatgattnagggaggggtgnggnngnaataatagaaaagttggggggnacaggggggtgttgnaaggaggncaagggggtggttagggagctgggctgtttttttcttgattccgcacccccggctcccctccccccccccctgtttgaacatggaggagcagcaaggaaagaggatagtctaggtagacgcacgggcgagaagccagccgcgggcactcctcggggcccgccgtcctctggggtggcgggtggttatgccagtgcncatgccagagctgacggagtcagcacgggacgccccacggcgcgcccagtttccggccgctcgcgcctatgactgaaaaggtgagcacgggtccagagagtaattttntttttcctcgagtgtatttcatgactcccataggggggccgcgctccggccccccaggggggaatgggtcggcggccacacaccccgagcatactcaaggtaggccgaccattggtcggcgcgcgcggcgcaggccagagcgtcatcccccgcacctggctcggggctcgtactcttcacacatgacccggggatcgggctncgggaggctcccgctgactcagtatacgtcacgacgcccatcacgcggtgcccccgcatgacggggcgaagcccgtcgcgaatcctgcggtcagggaataagggcgacaggaggggatggggttaggggacatagatagacgcaaacacgcccagaaccaggtcagtcactgcttngacgaggggcctagagggcgggctcgggcggcgcactgggggcgacggag

SEQ ID NO: 20254 - DNA, 287 bp, Homo sapiens
aataaatgggagatggaacaggaagctttatgacacacttgattgaatatgacagacccccaaaattacgggtcagccccctccagcacctatacctgttgcccgccgatcacagccggaatgcatcttaaagattccctggggcctggttccaaccgcccacttcggactttaaggcctttgcatttgtgggtggtctgcctatgataatttggtcatgggctggtctggtcggtttcccatttgtctggccagtctctatgtgtattaatcccttgtccttcatt

SEQ ID NO: 20255 - DNA, 1125 bp, Homo sapiens
  misc_feature (1)...(1125): n = A,T,C or G
aaggaagggnaagnnnnnnnnaaaaaggnnnannaagaaggtnaaggnnagaaaggaannnnnnnnnnnannaaggnaaggnnnnnnaaaanaaaggaaaaggnnnnnanacagnaaaaagaggaannnagagagaaaaagaagaaaggaaaaaagnnnaagagaggaagnaagaaaagnannaagagaaggaagaaagaagagcanaagggagcaaaggntagagtaatttaggaaaaggaattgaataaggggataagagggtaatagagntagagtaagagtagatgatagagagcctaagtgtaagggatagttttggtagagtaggggttgtaggtggtgagtgatagttggagttttattgtaggtatgttnataagtaggaaagggggtgngtgggtgtgagtggaggggcggtgtggggagggggggtaatgagagtntgataggatagagtggattgagtatatatgagtgagccccagaatttcatactaagagatgtattgatctcttgcaggctgataacgcnttcaatcgctagataggagatatcgttctttcaagtagacgacgagtagcgggctctcggaggttgtcgcctgtttaagggagagacagtacgagaaagaattaaggtgagatgagaaggagagaggacaggagcagtcagagagggaatcttgtnaacaatgggttacgagggtgtgggtgaggtggaggagaggatagggagttagttgagtganggtggagtgtgaggtaaaggagtgagaaatggtcaatttgtgagggatggagagagagttagagggtttcgcgtgcaggttatcagacataccgagggaggcagcctcacccgtctccccacagcacccagagtcgtgcccagctacgagaacggccgcgctgtccgacgcaggggccngaggcagcgggtgagcgcgcgcagggtaggaccaccggacgggancgaatctatctccgcgcagcacgccgccccatggcgagtggagcactgttcagtgtgtgtgtaccggcagtgaaggtgggatcnaatagagtacacagcaggtnatcgagacagggaagcggagcgtgggatcngcgcgtggggagcag

SEQ ID NO: 20256 - DNA, 1873 bp, Homo sapiens
  misc_feature (1)...(1873): n = A,T,C or G
atgtgcggacgagtgcactganttcacanantcacgtatgtctagancatcacttagtgtntcacggctcgatcagcgagttcatcaacttatcccagcgtgatgcntagancggtggcgtcgctgatccactgtngnctgctgtcggtacattgtcntntgctntgnctgactcgntatcagcttaacttttactantatactntntatcaatactcatcacgatcgtgcgcgcgccggtcatctangagctacgagccagtnactntncacgcgtgtggtcatataattagtagcaanggtatcatagagtngcatactcgnacgtgtggttgttgagtgtncgagntntgtcncgcactctcgacgacgtatgtatagctgctgagcagactancnanctagagcacgtagtatgacgtcacacgttcgatacactccgtaagccgtgactgacgtcgcagtanaganacatgcgtactcantatcgtanaaacgatacgatatgacatgctattgtgcactcctactagatacagttagagacgtctctctgctcagnctgcgctcatcgctactcgatgagcacgtcggcactcgacttcccgcgacttctcgcgancgntctctcacagtatanactcttgctgtatacttgatcttcgcagatcgcgtctcgtagttggttcgacgagtcacgntatatcgattcctcccactcggtccggtgagcgccagtgcactacgcgcgctatgatcttgctgcatgatgcgctgtaagacgcagactcgtcagtgtgacgactggtatctctattcaaatatacgaangacatacagactcgagaccacgacnacgcttgactcagtcgcacacacacacgaactactgttcnacggcgtcatagcgagttaccatctatatgtacaatcagttactgagtcggtgtgtgcgagtcgcgggacgatagaggacgacacgacttagatgagtaggtcagcgagtcactcagtcgcccatgcgctattgtcnagaagagatcatcatangcgcctgtcctacgacagtgagtagagtggtagatgtgctgtcgcatcgcgtatggacatgngncgttctctatgngcggntcatngcgtagtanacgctagtgcgacttacactcgtcacgtatctcgcacacgcgatctgcgtncactcacactcacgctcttcgacatntatnagtcgnaactnaacgtatgattactaacancatatacataatgacatcactcgagtcactgattnaccgtatcaacnanancatctatcantacgactacgacgagacagcgcacacangccgtacgagaancgatgacagcgtcagtatacnacacacgcantncgactagtcgtctatgtagatatgatatgctgatattgctaagtaatcatgtattcgcgtactataccgagtaggctatggtgtgcgctntatgagatcactctgcngtcccatcatagtcgcgatcaggtgtcgcacctatccagttggctncatcntggctctctagngcgtctnctgacgntgtcgngccacactctcgacgacagctgnagagcgatgtgcagaaactacgnngatcaggcacagcaggaagtagncgcacgaganggtgaggcgtgtgaacgatatgaatataccgttgacatgaacacatcttgcattatatgacagctgatattgtgagcgatacactgatctctggacgtaacgctcgtagcagcgctcgcgcgncacaacacactaagatatgcacagataaagctgactacacnagattatagcgtacatgtcacgatcgatagtagactaactaatatatt

SEQ ID NO: 20257 - DNA, 217 bp, Homo sapiens
cgtttagcatttcttcgtgcgggccaatattgtgtatgaaggccgggacccactcgggggtttttttctttcgggtcttttataaggctgtaatttcgaggttaccggtttgtgttttaggggcattgtgcagacttacttaaatgccccctacgagttttttttggatccatttggataatacaccgggtggttatatcccagggatatttttggc

SEQ ID NO: 20258 - DNA, 1544 bp, Homo sapiens
  misc_feature (1)...(1544): n = A,T,C or G
cccccccccgcttcctcctcgcgcagcgagaattacaataaatcaagggtctagctggcttgctattggttgcttctcagcaaagtcgagtacaaccatctataatctctagcatattctctcggtgtcacaaatctcgccgcccgctagtggtaatgtaccaccagcanatcgttcctcacatctacccgcacgtacctatctgccgcattgctcttctcacaccatcgtacgcacaaagtatttcctctacgccacatacgctcgtaacgttccaatctcacacactctggaccctgtctacactagcaccctccatcctcatctacngctcgatcttaggcgacctctacacncccacctgctctgctacctncctctcaaagtctccacgcactcactcttctacttcttttatgccttcaccatacaccatctctcgcatcatgcccccacntcacgcaccactcctaccntcgnctgctccaatcatccaccttctcacnagtgttccacgttttttntactcactncagtcgatacacctaccgccctccgacccaccatctcgcatgacgctgtatctgcgcactccttgcacccctcgctgccgaactacacacnctatatanacacttatacactcttctctaccanactacacctcatcttccctcacncgcccgttctctctcactctctcatctcttcctcttcccatataccacacatccacctgtaccactgtatgtcatcaacctctacttctcactccacgtantacgctccgcccgcatcctntgtagtataccacatccgcacacntcacatcncgcatcgctaactcatctcgatcctcattcggtgaaacatgttttcgatatctctcactcatactactccgcacaccaccctcacatcacctctcctcactatcactccattcactcctatactcgtcactctgtctctctacctcatcttatacacacncacttctacatgcaacccacatncgctacgctactnctctctacatcactctactcaataatatnatcacatcatagtctcgccatccctaccaccatagtngcgccaccgagagtatacatatcncactacgtcattagctatcactatcatctatactatcctatcatcatacacgtctgtcgcgcacgctctctcgacantactcgagtagtnactatacgcacgaactacctcccancntcaactctctttcgcctgcctactcactcacatcncagnctctcttcttctcgatcgacgctactcanctgtcagtcctgtatctacgcacctctatagcctctccactcactaccacgcgtgatgactgcatactcacncctcttgctatccactcgcgtctctatcatcactccatgcgcgcgctgactcccgctctgtcntgtgctacatcgctncgatcacacgtaatcactacgantactcacacacgcgtcttctgcgcagnatatccnacacgcacgctacacatcacacttcgcaagtcc

SEQ ID NO: 20259 - DNA, 916 bp, Homo sapiens
  misc_feature (1)...(916): n = A,T,C or G
agtgtgaaactttagatggctacaggnagtattttaatcaaattgtaggctttttgtggttgaagatcacattctacatacaacccagggcttagtaaatagagcctacattgatgaactgtgggaaatggtacttgttaataccatgtctagcactgcgtacccactcgtattacacgttatcgatgaaaccttcgcgtcatatcctgacacatccctttttcgtgattttttgttgaccttctttcacgagtagtctctcgactcgcgtcgccaggtgtcttctgcacgtcgcgttgtagctcctttatctttctcgtagggcggcggttgttttttactttgtcctccgctccttcgtacttcttcctcttattttgcttcgccctcctccctcccgtcttgtattacttgttacctctaccctcttagtgttgctgctgacgccctctaccctccgccctcatatctgacccagcgctccatcctcgtccgttcatatgtgaaattttttttttggcgtctcctgcgccccttgcgctctccgatacttgcctttcgtagactatgcaggcgagatctattccgcaccgatctatctatgcattctcggatcctattgcatacagtccctgttctgcactcccccctgttactatcgcccatccgtcagtatcccgttctctgctggttatggtctagccgacgattatatacaactgcacagtctcttctggtctctcgcctgtcgacgtgtcttctgcccccctttgcttatttgcctcggtcgcgcgccctcccctgctggccgcgcttttaatctcttgtggcccctctcgctcctcacatccacgtccgatggtcatactgtttggacgccatcatcactatcgtctcctcgatatcccgtatcatg

SEQ ID NO: 20260 - DNA, 1859 bp, Homo sapiens
  misc_feature (1)...(1859): n = A,T,C or G
tgaggtacgngatagagtganggatataattatagtctagtganagacaacngnatntganaggagcactanagaatnatagatanagagtanaatgaantantgcgtgagtcatngcgtcgatgtagatcagngtctcaggangtgctgctaangcgtagcatatcttctactcgatgtcagcgcactactcgtnataatatatactnatatctcgactacgccgcgtcggggggagagtcncacangctgtacgcgtagatagangtggcgagtgcgcgctgcgcgtgangtccgcgctcgacgcantatagctncngacggtctgcacacgtgtccancggagactacgtangncgcgtcgagtacgagcaattgacangtcacgtgtagtcagatctgacagatacntgacangcagtactcgtgactacacgcgttatnacgnactactcgatcatacagcgactctcgtcatcacgcaacagngcggacgcgagccacagtcacnctcgagtacactgtacacgattgtcgctcgcacncancacagacnantcagagcacagcacgatcgatcgacgnaacgcacgacgatgancagatggtactatatacanactcgcctacctcantcaccaatgacacagcgagccccacacgctagttaccantcgacncnagcacgtcancgtatttgatgctgtagcgtctatcggtacgccagcattaagcacatatgcgtcgatgctgnctcgctgcacgngtcgacgcgcgatgtgacagcatcctagagtangatcancgtggacgagcgtatgggagcgtcgantacagatgtctggacgtttgctgacagacgctatcagcactgttctgcggctgcatcgctnancgtccatnactgannctcgtgnaaccactattgcgagctcacgcacggtacgacagtcgctacgagacacgcngctcgtccangtctgtgctacaggtgtgatatcgtgactactgcgcctcgtacnccagtatcgttgtcgcgcgatcgctgaccctgacgaggtgcgacatacagacacacgaataggtgcgtcacatggagacnactctaaccgaagcacgacgacacgggcgcctcctgagcgtcctgctagcctctgatgcgtgacttgcnacgagctacngaacagtgcgtacacatcggagacaacagatgagctatcgtcctacgcatcacggantccactcactgctctctactggtcacgcgcgcgtgcaggtgnctgcgacggtcgcgcgcacgtgcgcgtgcgngaggacgagagtgtggacgcgtcancgtcgacgcgcgagcgcacgnagtacgcgagatnggacacacgtcgngncatctctgtcgaggcgacgacgcgcgcagcacaccacancactaccctcgcatgtgacnatcatcgtagcgcggtacctgactacgcacacgtatacaagatgtgacgcgcgcggcggcgcgacggcggagagcgcccactcgtagnacgtaccgtccgccgtcgtgagnacgtcggcctgctcgtcgtcgtgagaacgaggagaggacgcggaccggcaattcgngagacctcgggcgtgcgngccacactacgcacacggcaagcatncaccgcgccgtcgcagcgcccggcgaacgccgcgtcgccgctagcacggcaacgcgcttcggtggagccggaggagacgcgagcatgttgcgacctcgtnctcgctgctacncgccggtcagtcacacagtctcgctgacgcatgccgacgcggtacgaacagcgctgctgataccagcagaggctgcgtgagcgaagattatc

SEQ ID NO: 20261 - DNA, 726 bp, Homo sapiens
  misc_feature (1)...(726): n = A,T,C or G
acggcccccccccctggtttctaaaaactcgggatgggggcctgacccccccccccgcccccggggaccaattcttactcccccctctcaggggggaatttcctgccccccttttcccgttccccatttttttattcttatcttccccccccccctagttgttttccacacctgggcccaatgggaagaaaaccccctcccgttgaccaaaaaaaaggatttatggtaaatgagctttttggaagagtaaaatctaatacctttaaaccaccttttataaacccccctccccctttatggtcgcctttaaatgggttttaacccagtaagagtattaggcccccctttcccccctttaaaatatgattctcccatataggccccttaaaaggtttgaatttttggtttataatgttattgagtgtttaagttttaaaccatattccatgtcccccctttagatcccagaaattgatattaattaaataccctgttgtagagttggaccccatgatttatgtcgccgcctagtctgttttttcccatcatcttaccctctttctctatttttggcacattcttttgccagtaggcgcaagagaagaaatgaaatttgattcatcctgctattatactttatgccagataaaaatttttggtgtgacttantatttcccccttgctcaaaaaaacacaatgttgaatcagaaaaaaaaaaaaaaaaaa

SEQ ID NO: 20262 - DNA, 945 bp, Homo sapiens
cagagcggctctgccacatgtatgaaagatatcttccaaaacgaaatcctccagcatcatttggatccagttcagcctcacatacttctcaagcgacatcaggagccaatagcgaattggggattatggctacaccgcagcctatccatagaccgtctcttaagccttgatatccgttacgatgacacgccggcggaatctgccgtcgacgctctccggtggctcgcgcgcgcgccgaccgtccgcgactctcgtggtagcggctccccgcccacatgcggccagggcgccgaccgggccggcgggctccatccgccgcgagggagagtcggtggagcgctatcggggccgcgcgcgtgcccgggtgctcggaccggtcgcgcttcgggcgtccgcgcccggcgtgcggggtactgtcgcgccttgccgcgccgctgtggccaccgcctccgccagtttgccacgcgccgagcgcgcgcgcccgcggcccggcagaagcgcgcgcgcgtgccggtcccctgctcgtgtgtcagccagccgccgaaggctggccactcactcgcttccgcggttactatcgcaggtctggccccgccccggtgcgcttgggtgcggtcgctatattgtcacgcgcgctccgcgccgccgccgcgcgccgtagtctcgcgcgtcgccgggccgcctgcgcgggaggcgctgtgccggcagccgccgcggagcacgccggcgccccgcccgcgcgcccgcccacgtgacggccaacatatggcggaggcgcggagcgcgctgcgctcgatttcggacgcggtgcccgcccactctccactcgaggggcgagctggtatcatcagcagcacatagagtgtctcgcgtcgatgtgagcgcacgcggcccgggtgcgcgtgcgcgccccgccgcgggggcccccgcgcctggctgccctcg

SEQ ID NO: 20263 - DNA, 1882 bp, Homo sapiens
  misc_feature (1)...(1882): n = A,T,C or G
acgagagaatagagatatcatatacagagttaggcgacgaagngacatanggaaccgtgcgataacacatactagctagtgaatanacancgcgngcgngnggtgattgtgcgtgtcgatactnagacgtcaactagcataccgacccagctactgatcgatcagacagtgaacttatactgctgtctagtatgtatanaatatacgtatactctatnctgctcttagaggtgataccgtcacgcgcagtatgattgctcactcttgcatcgtctgcgcgctncgtgcacatcgcgaactgatcgcagtctcatgttatgntgtgtcactagttacatgtagaatcatactattatagcatctcactatatataatcgtatganatntcntgctaacgtattctcanatctctcttgctgatctgcgttcgcgatgcactgacgactcgactcagcacgcatgcntcgtacgtcgcgctacttcgtcgtagtactaacgtcttcatacagtgcggacngcgagattatcagatatgctagtatctgcatatatntgntgntgactngcaatcgtatcgcacacatgacgcagtctcgtctcagctatctctctatagactgctgatataagtgtgatcatctntcttatcatctctatctcncngctgcatcacatncatcaatactaaagtnagaactatagngtgcgacggtagtgagtacaactgganacaggtcgtgcactcaactgatagacatcgtcgctgtctactctgtgttctggtgtcgtgacgtcggtcgcttgtgntagtgtggcgatatngtacacagtcacangnaagtgttcgatatngtgatcggtcgtgaacactacgcactagaccatactctctccatnntttacgncgcgtgcggganaacgtctgctcgantaattgatgcgctagtctgagtaagtgattgagtctcgagcacgccctcgagcttcagtcaacatgnangctgcatgcgctcatatgagcgatntgatcgcgcactctacgacgnagctgtacatacgttatcagacactacntngatctgagngttcgacatatcgacgtagtagaactgatcatggcgccagatcgcatacgcgtcagtaggctgtccgctcacgancatccccgacagctcatgcacttactgntgacacgtcacncgacgcatgcagctctcntctcacgcgtcgacgctgactgtcatcatcacgcctacacgcagcgagcctcagcgcccactcactataccacgacatcaagtgtatcatatcatcatcaccaggatgaatagcaagcgatagacaacgaccgtactccgtctgtatcagccatcgctgnacgcacattcacatcaagnctactagcacacanaccacgactgagacngcncagccgntcgctcacagtcgaacgacatancngggtagtcagatagngctgactgtcagacgcgacactagtactactagagaatattcagtgtcgtagtgngcgacgttctgcgcangncgcaagtactcgctatgccgnanattcagtgtctgacacctnacgaataatagtatgtgtatgtgcagatatgacacagnatgacagatgtgctgtgtacgagtagcgantctataggtgctatatagtgctactnatatgcagaatcgatctcnctagatctangtatgctaggaatcggcacncaactcaaccnncagtcaccggctgctgagcatgtgacgatgcagatagtgttgctgctagacatatgatatgatnngcagctgtaatgagactacactggacgcagcagcagacattgacagttatgtagatagtagattcagtca

SEQ ID NO: 20264 - DNA, 1047 bp, Homo sapiens
  misc_feature (1)...(1047): n = A,T,C or G
agtcctatataagtatacaagaacacagntacctcatataagtagaggattatctanattcacttcctactggntcctatagaacatgtttcagangacgggtagtctgtataagagaaaattattgaaaatataagtagtatntacgtggaccagcagacatattactatancaacaagctgggttatatgaggtgtggcagtgttctgtcagctagagttccttgatctcgtaatatntntagtagtagcggatgggtgatacgtagagggcgaggttcgatggggagaagcttgagcagcagtcgggagacaactaancagataactccgtaactgtatattacacatggctaacttgtagctatatgtctgtattttattcgtgggtggtgggttaattattgataggatctaggaattcgaacacgtataatagtggagggaggcaatagaagaatatnggngcagtggtttggcagatacgaggctgccttagtgaanaacattataagaataatataataaagtatattaaaagagtgacagtgtatgacatataaacatatcatctgggaggacagttatagatcatgtctgtcatggattaatntgaagaggnggaaatatgtacgaggtattgagtgatagccgactagaagtgcgaagcgagagagtaacatttaatgtaaatgatactataataaatattaaagtatttactggagngngataaactatatatcttattattcatgtcctaatgtctaaanaatcggaaagcggaaacaaaaattggagacatatgctcggtaataatagctagtagtaaatatacagaatgatgatatcagggggagaaggcgccggagtaggggggtcaacagccacatcctctgtccctttntactttttacctaaattacaaagtggaacttggagaacatgaaattggatataaactacttgttttagcatggaggtggagtataattagcatgatgatgatcattggtatttagaaaattgtgtgaaaatttattaaac

SEQ ID NO: 20265 - DNA, 1137 bp, Homo sapiens
  misc_feature (1)...(1137): n = A,T,C or G
ttcagaccaacataacggattgggtacatgaaaatacatggaagggttgcagtatccacattctcttacagatagtaagaaaggatacgcctcttcgggggatggagaaggatatgcacatcgcccagacgaacgaccacgccaacagacacacccgagcgagcgcacgcccacactgagcgcctactgaggaaacatcccccgaatgacgccccccaaccaccacaagaccggcgatattttgagacaacaggacactagaccaccggcacggcacgcaccccgccgctactacctcacaacccacgcccaggagaggccagagagcatccgcggaacaccatccggaagacgcagaccaccgccggctcgcagcggtcagagtcagccgatgatacggttaccccgctcgccacccgaacctcagaccccgagacgagcaaagacatcgcgttcacctcacatcaggcacgccgctgctccgcgcacccaaagtacatcggtatcccgagaggtcgaataaaggatcagaatagtacgagtagatgcattcccagccgcacaacccgcactcgcgcgcgacccgacaagccacgaacgcagacactacgaagacgcgagaacctcgacgctgacttaccctgaccgagaacgaataagagaggaggagacgcaaagnacatacaaccgcagaaaccccaggcgaccagcacacgacccgaccgtgacgcgactccgtgcacgagcctggccgagcaagaggatagtagaggcacgtatgcagagaagaagcggcgacagagtnatagtccgaggacacgcgcaccacagcgcggacaggcgagctcgcggacactcgctctccagtaacactatacgcgcagagcattatgaggattatgacgacagacgtgcgtgtacgagacgcatcgtacgantagnactgacatcgcgcgagtcaagtactatatgcaacgcgaccangcancacacgacagcgcgcatgcnccgccatagacacgcagtcgcgcacgacctatgcatcaagtgccagagatacgtacagctatacatangcntatgaaagtatccagagaactacccnacccgccganantacgacaagtaacacgagcg

SEQ ID NO: 20266 - DNA, 924 bp, Homo sapiens
  misc_feature (1)...(924): n = A,T,C or G
taagttcagacaacagaactgattggaacatgaaaattacatggaagggttgcagcatccacattctcttcagatagtaagaaagtatacgcctcttcgggggatggagaagttcatgtccgggatgcgtatagcctaaaccgctcctcgcttctccacgctccgtagctcatctttgaacgatacatcctcatttacgatctaccggtccgtcggtatccaaccccatcttttatccccaccaaccgcaggtccgtcgccccgccccccccgccactcactaaccgtcgtccacctcttatccccaccgcacatacacccgctacagaacatacatcattcgatatgatactccacaactcattaacacacaccactgttctttccgcatccaccctcgagatataacttaatctccacaccacgccaacacgatcaacattccctcctgcataccccaccctctcgcctctgatagcccgcgcatgactagcgatgctgataaaaacactcatcgacctcactctcctgtaattaatcatcagagtataacaaacagtacccttcagacagcaatacatcctcaaccacaccatcacatttttaattcagaaccgtacatcgccccatcaccccccccgctaccccctatctanctctactccccaccacccaccaccttataccactcaacatatcatcccacacctatgatacccacgaccgctacgacgactacgtcgtcgacgactttcataggaagctatcacccatactcatcatccccgcctcatcccaccgccatggcctcatagacaacacgctcatatctactagccataccccctctcacttctaattctcccacctcccatatcccaatacacatcaccatgattagcgctaatcacgtccgctcgctct

SEQ ID NO: 20267 - DNA, 1291 bp, Homo sapiens
  misc_feature (1)...(1291): n = A,T,C or G
caggggaggggtggaaggtgtggggcgaggatgagcgtggtgcgaacgatcgtcggggcgcgccggcgcgtttcccgtgtgtggcgagttgggtcgtcatccaactaaataaagggtggaggtatagataacaggtaaataaaatatgtaaggcgtcgtccttctaagaacgcgacaatgagcggactaggatatactgagaaagtatagttaaaaagtaaataaataatgaagacataaggggcgggacacgagatcaagtgggactctgggatgtggtatgttcggggtccgagcaggaaagacagtggagtgaggaagggacatgtaagaaactaggagttgtgtcaaagaaacaaaggtatttatgttactattatattgatattgatgcatatagagagtgttgtagtatacttgataaatttcaatgagtatcaatgactcaacgagatattatacgtaagttatgaatgtcagtacatatatacagagatatagangtcaacagacgtcttacgcgtccgaatagtatctaccgcagatgatatgagtgcttcatctattacgcaatcatataactgcctagctgtagaaggtatgagtcatatagttgtgatagataaatgagtaacatagatgtatatatactaagagtgatgggcgtacgtgactagtatataanatgagtgaacgagcatagttgtgtactttgctgagatgtngttagttgtctcgtacatataactaacgaagantttgatacaatgtatgtaaacagtgtacgtgattattggcacatcatgcggcgacatttttatattatatagtgatcattagagcgaccacgncgatacgctgtatagtgaatacacctgtgataacgangattggttgnatgatagatgtaattcgcactacaaaatcagtgtacgtgtatcagtacatatattattggatatataataatatacgtggagcagtatgcaagagttacatgcgtacggcgagcgtgggggactgatggagatagcggaacgatgtagaatagcgactgtagtataacgttaatagaataaagagatagtatgtgtatatggcgactgagtgagtcgttaagagggaattgaaatatattagaggactgtgagccgattactgtataatacagtgaattagatatattgagatgacgtgaggaacggacaggcgggagagtgtaatagggatagtgagagataaagtagaaagagatgaaaacgtataagagaataagagtagaaagaggatg

SEQ ID NO: 20268 - DNA, 743 bp, Homo sapiens
  misc_feature (1)...(743): n = A,T,C or G
cctctctttggggccgcctcaaagaccccgttgcagccgacaaattaggagaggggggcggggcccccatttttctcggaagtgaagaagggtcacccctctccgggggcagggaaagtttatgtttgggatgggaatccaaggaagggccttnccagatttgttgagaggcaggtctaaatggattaggcactgccccattagggaatggccagtaaggtgcttgtggttctaactggggatgggtaaatatattccatcacgattcttgtcttccaagaaacaaaccccaaagccaataaaaggttataatgaacttggttccaggtgtttctttttttgaccttcaatcctactacagaaatcttggcaattgtttcaaaaaaaatgaaagaagcagtcagattggttcatcttccttcctgtccagtattttcaaacttcccagtcattaaaaataagaatatttctcatgttcataccatggatttttctccgagaagtggatactttgccttggggaatgaaaagggcaaggccctgatgtataggttgcaccattactcagacttntaaagacccccatttgaagtccagttgagtcacaagagaagcctgtcttgatatatcatctcagaaactttcctgaatatgtgataatatatggaaaatgatttatagatccagctgtgcttaagagccagtaatgttttaataaacatgtggcagcttctcgtctgccc

SEQ ID NO: 20269 - DNA, 821 bp, Homo sapiens
  misc_feature (1)...(821): n = A,T,C or G
agagggcaggagagaatgtatgtgtgaggatnctcacgtgcggcaccgtccccggtttcccgcggctggacgtagaagcagacaattagtgggagtgagggagagaatcgagttgggggcggcggggggaagatgtcgtagggcgcggatacgcggagcgaatcgctaggaggcgggcggagtgtgtgaaggagagcttacgaggaggggaattgagatcgaggaaaagtgcggaagacggtcggggggcgacgagcgggcgcaagacggccgcggcggctagggtgtgtgtagtgatgaggaatggggacgggtacggaaaggggccgggaaagctccctcaaaccacagaatcaaccaacataaagatgtactagggaggaggggggacggcggaggggggcgccgggggcgagcaggctccttgcctcggacggggtggcggtgcgctagagatgtacggccgctgtcacaggtgggatgtcatccatctccatgaaagcgaagcagttggtgctggtaagcctttttttaggcttgtagtgtttgaattcaaacaagatagctgcacctttggttaatttttcaacatgcttctggagctcaatgtccacattaaaatgaacatatgtatcttcttttcttgaagccacaggagtatcttgcacaggagttaagtctatgccattcagatcctttacactaactgtaatatagggatcgatgcactgcccagcatctttcaaaccaattttctcaattctgatagtgagtaatgtcattcctggtccgataggcaaccttggtaataaagtaccatg

SEQ ID NO: 20270 - DNA, 746 bp, Homo sapiens
aagacaaaaggctaccccttcaaaagcagtcattgtcaagaaaaggaaaccctggcagagtagcccagggttaatatagggattaaaacggcagcgggtcataaaacgcacccaatcagcactctgtcaaaacggaccaatcagctctctgtaaaatggaccaatcagcaggacggggtggggccagataagagaataaaagcaggccacccaaaccagcagcaacaacccgcttgcgtccacttccctgctgttgaagatttgttctttcactcttcacaataaatcttgctgctgctcactctttgggtccctgccgcctttatgagctgtaacactcaccgcgaaggtctgcagcttcactcctgaagccagcgagaccacgaatccaccgagagggaccaacaactccggatggaaggaacaactccagacgcactgcctttaagagctgtaacactcacagtgaaggtctgcagcttcactcctgaagccagcgagaccacaaacccatcagaagaaagaaactccagacatgtctgaacatcagaatgaacaaactccggacacaccatctttaagaactataacaccgcgagggtccacagcttcattcttgaagtcagcgagaccaagaacccaccaattctggacacactatgacaaccactatcttggaatatggtgttaatcactactatgcatattttaatataggtatctataaacaaaaaaaaaaaaaaaaa

SEQ ID NO: 20271 - DNA, 446 bp, Homo sapiens
ccatactgcttttatgagctgtaacactcacctcgaagatttgcagcttcactcctgagcccagcaagaccacgagccccccgggaggaacgaacaactccagacgcgctaccttaagagctgtaacactcactgtgaaggtttgcggcttcactcctgagccagcgagaccacgaaccccccagaaggaagaaactccgaacacatttgaacatcagaagggacagactccagacgcgcccccttaagagctgtaacactcaccgcgagggtccgcggcttcatttttgaagtcagtgagaccaagaaccccctaattccggacacagtattatacaaattctgtcagatttattcctaggtaccttatatttttgttgttgctattgcaaattataacattttaaaaattaaaaaaaaaaaaaaaaaaaaaaaaaaaaaaaaaa

SEQ ID NO: 20272 - DNA, 832 bp, Homo sapiens
atatttttcctttgggttttttctctcctaaaccggtctgccctggcagtaccgaacttctgtattgcccagcatctaactcagcttttgactgaaatgagtacaggcaagctctgaggcagctctatccagggctatgacaagaatgaagtgaacacattttaccctacatggaactgcccattccaacaagtgctaatttgacaatggcaatgattactatgggctgaattgtattatcccacaagatatgttacagacctaacccctggattctgtaaatgtgaatgattcataatgcagaaggatgcatatatcattcatcataatactggattcaggcggatatttaattaaacaaaagtcgcgcgttccatatcgatataatatatgcatgtatgcagggccgactacccctttattacggtacctaactttgtcacttggtagccctcataaacaatacatcttatcacaacctccaagctcggaacattctcccccaaaatccctaatataattgagagggagacctcctcagtcttcgccccctttgcatattatctgtcctcactcaatcacaactgttttcccctattcctctctattaccattatatcatccacgtttcaacatgtacttgaaatccatctaacatactcacctataatccctcatctctcggttatgaactttttcctcatgtacgaactatacacaacattcacccctgcgtagaaattcactcgagcgcccaaacaaacgttcttcacatcccgttttaatccgtatcgcataagcctagctccatagcgtcgataataagctcaaa

SEQ ID NO: 20273 - DNA, 994 bp, Homo sapiens
gtggattatgtatggggatgcgacctgggagcgggtgcgctccagcatgtataatggacactacacggggggtatagtggatgaaatcggggacttgcgagacaatacaggcaaaaaacaattggcgcggtgcggctggcggatacgtcggtcggaaggggatcggtcggaatatgcgatgagaaatcgtcatcggccatactgatcaccacgggatcaacaaagaactatcgggcgttatgggatcttgggcaacattctagtgcgctcgttcagatcgcagtttgtgctttctcaaataatatattggtaagacgggggccggggaggggagtaatactcttttgggtgagaatggatgggggggacgggtcggtgcgcgacgacgcggtgaaaattagggattggggactcgagtgaagttagaatacttgtcgcgatgggcataaggccggtaataatcggcgggcgggcgcgccggtaaaacgcagccgaggggcgaaggacgcgatttattgcgtcagcgcgtggtgattactgtcgatggagcgtatggcgcggttatgggatgcttattaggatggatggtactgataataataggtagcgggcggaggaataaagggcggcgtaaacacagagagtgggcgtaatgagggatctgggtaggcgtacgcttatctcggggactatcgcggccggaggatagcgtatccgcggtcgatggggccgtccatcatataattggttgcgggtgtgggtatgtcgttataggtgcaaattgcgggcgcttggatgaggcacaagtcgaggcgcgcgggaaattcggcgtagcggcggcgtgttactatcctgcggggtgagggtatttggggggcgcttaatgggtgtcgcctgcatacctcatatcaatagttgatcctgctgcagagggtcgaaaactaatggggttgggtgaaaatggtacattaacataataaaaaaaaaaaaaaaa

SEQ ID NO: 20274 - DNA, 172 bp, Homo sapiens
acaatgtcgttcatgtcagggaaattgaagattaaaggtaacatggccctagcaatcaaattggagaagctggtgaatcagatgaatgccagactgtgaaggaaaatataaaaaaaaagtcgactgctatgctcaaaaagtaaaaaaagctcaacagtcaaaaaaaaaaaaa

SEQ ID NO: 20275 - DNA, 261 bp, Homo sapiens
  misc_feature (1)...(261): n = A,T,C or G
cccccctccctggcanaggctgcctttttaatcatcgaggaacttgattgccataattattctcaanttnntnnaanggcccccacctccacctnagccaccaaaaacggcagttgcccatgccaaagagtatattcagcagcttcgcagcccgaccatcgttcacactctatgatgaggacattcatactcccagggtgttattttcccatttattttctaaaaataaacaaaaattaaaacccaccaaaaaaaaaaaaa

SEQ ID NO: 20276 - DNA, 983 bp, Homo sapiens
  misc_feature (1)...(983): n = A,T,C or G
acgggactggcgtactcagtgtgatggatggtgctcgcagcagtgagtatcctaattatanaagggagactcgatggtagattcgatggacaagagtcgcgggaggggataggctgagtaggggtgggtgggggggacgttaagatgggtaggtgtcggaggcgagatagttagcgggaggggtgcgcgggttagaggcggggtgagggaggtgagggacaagaggggagagatcttagggtataagtagagaatgctgtgttagtaggtgtgtgataatcaggaatacaggtgatggcgaggcgctacgatagtcatgtggtcgcgtcgatatgacgttggaggttggcactggagctacggcgcgtcctgtgaatctgcggttgttgtcggcgtggtaagggtgggtgagaaagctggaggaggggcggaggtgatggtcggcggcgggggcgaggtgagtgcgggggggtggggagaatttaaagtcgagtcatgtgaagtaatggatgagaggaactgtgctatgctcgggggtgtcggagtttggcgtggccttgtttacaacaatataacacatctagcgtagttagcgaccgcacgtctggcgtctagaaatgatttttcgcagattgaatgtgttcgtcgcctcttgcgtgccgggtgtgaacgagactggaagagagaggcataactcgacactaacaatcggccatctatactaatacgaatcatcaaacgacgcaaaacacaaatgaggaaaagagacacagtgtatgattggtgctcttggtattgctgaatgatgatggagcggtttttcaaaaaataataagaataaaccttctccatgaacccaaagcgacctctgccatggtagcggatgcgtgtcaggcactggaatcgttctgaggtggtattctagcagcctttccttccctccccaaattatttcaaatattctattattnattttattttat

SEQ ID NO: 20277 - DNA, 380 bp, Homo sapiens
  misc_feature (1)...(380): n = A,T,C or G
caccctcacaccaaccacacccaacaaaaaagaatnaanancctcaacctccgactcccacctccacagacgtaagcgcactgcctcnaaacccactcccctaccctagacacaaggtgccctctttcaatcctccaatgaagtgtgggttgcactatctaaaaatccaacttnnntcaagaacccgcccccaccttcacctcgagccacccaaaaacccgcgaattccccccttcacacaacagatatattctcaaaagatttcaccaaacccagacccatcctttacacactcctcttaataaacaaacattcacaacctcccccagggggggggtgatattctcccctcttctttcttctcnncaaaaaaaaaaaaa

SEQ ID NO: 20278 - DNA, 869 bp, Homo sapiens
ctactatgatatcctgatggctgcggacgctgtcctgcggcaaacgctgtattgttgatgttgctatgctgagcgaatagtggtgactagtatttgcttacattttcatatagatctaaatggtagccgggatattgtaggtgcggcgatattgtgctggttgatcggaatagacgaagatatgtcttaccggtggcgaacgagatttggaggataagtgcgttttatgcgtgtggaacggatgacgtgaggggcgtagcgacagatatgcggtggagatcgtgtatgcaagtaggagcgaatcttaggtgtaggatgcgtctggtataatcgaatgagtgggggcggtgtgaggatatgagagtaggggcgctggactgaattcaaacatgcaattggtcgatttacgagatttgagagtcaaacaaatcacagagagagccacacgatatttatctcatagctgggcgttgggtgttgttcttgtgagattgtgggggtcggtgtgtggtgagggggtggcggatgttgtcgagcattctgccgcgcatcagtccgtcttgttgtacttgacttgattaaggaagtgtacggttgtcatcgtcttttttctcttataataaacaaataaattgtatgttaagtcatccatcttattagtgtgactttattgactatttttgacatatcatgaaatatactcttttgcatggtcaccttccgtctttggtggctcaggtggaggtgggggcccttccaccaacttcacaaaataatggcaataaaccttctccatgatcccaaagcgacctccgccatggtagcggatgcgtttcaggcactggcctcgtcctgaggtgactcagcat

SEQ ID NO: 20279 - DNA, 956 bp, Homo sapiens
taattcccccccacacgccacaaaagcagtccggacaagaatctcatatgttgaccaggctggtcttgaactcttggcacccaagcgatccttttgcctggaatcccaaagcgtcagacttactcggagaatatttcattgcaattactttctatactttatacgacaagagctctgttttaaagacaaaatttatcgactctactttttcaaacaaagtttcatgttctaatcattggcctgatttaagcaattaaatgaaaacacagtagcagaaagatcgggctgacaagacctgcatcaccataagtacctacacacagatcgagaaggagaagcactaccccacaaacataggttaaataatgtaaacacacttgtgtccacgataccccccgctcgctctaactttccctacaaccaaccgctatccttcctcgcttataccgtccaccatctcacccaccctcccaagccgcgtaaccccccccaccacagagtggacatacacacgcctagcccacgaatcgctagtgatgatcacacaattgcacaccagaagtgtgttggaacctgcgaaacgaggccaccagcactccacgaatatttaacaactcatcgactacgtaggttgctgtgacccagagccacacagcagatgtgtccaccatctcgtacttttatgtacctctccctctccgcgaccacccacccagtaaacaacattaaagccaagttgggtgtttaaccctgatcttaaacaccgcaggaataaaactgaacccacatcaatgaaatttgtattccgagctttcttgatctccactatcctccaccctctcgtccattataataaccatcaccagcactgagtatactgatatcacccgccactcatcactttattctgcctctcatctaatagcgcctacgatgatctcccagatatgtatcgc

SEQ ID NO: 20280 - DNA, 560 bp, Homo sapiens
ctactgttatgaattgccacaacttggaggcttagaacaacacaaactagtactctcacagtcctgaaggctacagctctgcaatcaagatatcagcaaggccatcattccactaaggctctaaggaagaatccatttttgcctcttcctgcttctgggatgcatccactttattagacggcaaactagaaaatgcttcctacagtcgccacataaaaagggtggggcagtaggagacactgaattcacatatcattgaaaaccaaaatattagaagagcttaagttttaaagaatgctggcaaatgtttaagcgatcagcactgctggtttactataaacataatggactacacgttgagtaccttgacatatgagtaaattcatatagtacaaatcattcaacagatatcttgagaacaagtgagaagacagccatctgcaaaccagagagaaagtcctcataaggaactgaatcaaacttcaccttgattttgggcttcccagcctttgcaactgtgagaaataaatgtgtctttatgccaaaaaaaaaaaaaaaaa

SEQ ID NO: 20281 - DNA, 960 bp, Homo sapiens
  misc_feature (1)...(960): n = A,T,C or G
cggcgcaaactataaagtggtaatatatattanntttgttgagggaaacagnagatgatctggcccaggagtcatcaccagatgaatataaacaactctgtgtctcctgactctgactcttaggggggtggggctactagaaaatctccaaagctgttcaatgtgtgatcatcnggattaacacaacctcggtgataaactcttcggacaggtgttattctttgattttctgcataaaatcctacatcttccctgagattggataagaaatgccatcaattatggggggggcgaatctcattcagcccagcgatctcactacgtggatatctacccaaagaacaactctatggaaaatagtatggggatttctcgaggaactgggaattgtagtcttagctaaatgaactgtgagatggaaaaaaagactatacgaatacttacacgcgttgtgagagattggtgggaatccgcccaaagctaggaaatgggagggagtgtgtagaggagagaagagagcagaggggcgagggggagtggggagagaaacagagcggggcgggcgggaggggcgagagaagggggaaggcagcggaggccgccacgcggacccgccggtggggtggggcgaggagacgagagggtgcgcggggcgcgggtccttagggggggggaggcggaggcgccgcgaagaatgagcaacgggtgcgggtgaaggggggagggggagaggacggatatggaccgggagcgagtagggtagggcaggcaaaacggggggagtataggagatagaagcggggacagaggggcggggggccgccggcgcgcgagagaggcggggcggagcggggtggggtgggggggaagctgcggggagactggaggtcagtgggacatgtgaaggggatagaggggagggggtgtgcaggcgcgccggggtgcgagcgggcgggcgct

SEQ ID NO: 20282 - DNA, 1250 bp, Homo sapiens
  misc_feature (1)...(1250): n = A,T,C or G
ccctggtctctttccgttcggtgcctactttcctgtcgtcttttcgttcgtgttgtctgtcttggtcggcttgttgggtgtgtgcgggtatcggcacggtatgtcggtcttcctgcctcttctgtttgttatccgtggtgcgacttcccttctctcgttgcgcggccgcctgccttccgccggctcgtccttgctactgtgctgtcttcgccggcgtgggtctgcgctcggggtggctgtgccgtttccgcccgcccctgcactttgtccgtcgtctcccggccgttggttctgttcatcttcctcgcgtctcctgcgccccgtctgtgctgcgatgtgtctgccgttcgttcgtctgggcgtgtgttccccgtcgccgcctccgttgctcggctggtctgtgttgcctctgctcttcctttctctttgggcccgtgtgcctgctgtgtctctggtctcttactgccttctccgggttttcctcgggcggcctgtgcggttcgtgtctgcctgccgtccttcccgcgctgttcctgctcgcttcttgcttctccccgcgggcgcgttctctcctggcttggtctcgctctgttgctcttggcgttccctccgtatatttcgtttcgtgttgcgcacgcggtcgctttctcgctccgccgcgaggtgcttcttcgccgcctgcgttcttctcctgctgccttgctgtggttcctcctgtgtccgcctgtgtctcgtcctgctgtcatgggggcccgcgtagctttgtggtgtcctgttcttgtctgatcttcgccccccggcggctgctgttgaaaaacaatgtgcgttgctcctcgcggatttgtcctctacggttgcgcactttgctggatgggtggctggtatttacgcctcccctcctctcgcttttttgcttccgctctccctggtgcgtggtgttgtctttgcctccctgaggctgatctcgtacttcgcggtgggcgcttgcccgcctcgcgcttgttttggctcttctatcttcactgagacgcgcggcgcctccgctcattatcctctcacgagtagatagatggagcgattcgccaacgcgttgtatcacattcaagtgaatattgtagatgtgtctctncgtctgngtctcaaccagncgngtgtgtagcggtcctncccgngcccgaccccttcntctnctcgctctcggtctgtgtcctatcgtctgtctctcggtgtttattcgtcctccgtcttgt

SEQ ID NO: 20283 - DNA, 1192 bp, Homo sapiens
  misc_feature (1)...(1192): n = A,T,C or G
cctgtcgtgcttttgttgttcgcggctgctcttgctgcgtttcgcgtctgtctcctgtcccgcgtctcgcgtgccgctgttcgcgtgttgcctctcttcgcgttccgctggcgtggtccccctcggttntctcgtctcctggcctccgctgcgcggcgcctgcccggcgcgcctcgtccgcggtngctcctctctgtgctcgcgcctctgttttgtcgcgccgcnccgggtgtcgttcgtctcgccgctctcgctgtgctgtcgtgctgttcgcttctctcctccgctggtctccgggcgtgtcgcccttcgccgcccggccctgttcttgctggggtggcgggcttcccccccggcctcctccgcggtccggcttgctgtcgtgccgtcctgtcgcacgctcgggcgtgtcgggcctgtcctcttcctggtgctgcgttcccgccgccgcgcgtctcggctgccgtctcggcgctgcccaggccggctctttctttgtgttccttgcgcttccgctctcctccatgttctctttgttgcttctcgtatattctctcnttctctctgctccacgggctcgtcctcatcttccttcctggggtgttgcccggccccgcggtcgcgctgtcgcccgcgcgtcggcgcgctgcgcctctctgcggctcccttcgcatctgtccctcgtgtctgcctctcttcgtctgctctctggcctccctctcttcgtcgcgtgtccctcgctctttcttcccgtcgtcctggctccctgccttgntgtgggcgcccgcggcccgtgcgtctgttcttctttttggcggtccgcgcgtcccgtgtctccccgcnctccgttccgctctccctccctctctctcggttgcgggcggcctgtcttctttgttttctcttggggtcgggcgtcggttcgtgctcttttctgtccgtcgtttcggcggcgcgcgctgggctgtcggtcnngtccttcttcctcggggtttttctccctcccctttgctctaaaggtcttcctctctctctttctctctctccntctctcccgcccnctctcggtttttctcnccccctttaggtttttttctttttttttgttttccttttttaanattttttctttctccttccccctccccttccctccttccttaccatcctctactatcacttctttcctttt

SEQ ID NO: 20284 - DNA, 436 bp, Homo sapiens
cacacaggctggagtgcagtggcaccatctcggatcatgcaacctccacctcccagattcaagcgattctccttcctcagccttccaagcagctgagactacagtcatgcaccaccatgcccagctaattatgtattttaagtagagacggggtttcactatgttggtcaggccgctcttgaactcctgatctcctgtgatctacccgtcttggcctcccaaagtgctgggattacaggcatgagccaccatgcccggcctaaattagcttcttagctgagtctggcatgaatagagtgtcaccagtatctttctgaagaatttcctttaaaaaaaaacccagatttatattttgaagtttttggacaaaattgtaattgcattcaaagtaaattttatggcaaataaatctgaaattgttaaaaaaaaaaaaaaa

SEQ ID NO: 20285 - DNA, 937 bp, Homo sapiens
  misc_feature (1)...(937): n = A,T,C or G
tggtataggtaatgagagtataggtgagcaggccacctcnagatgactactgggattcatgctataagtattcatttttcctaggtatttggaaacataattttcaggtcaagagggaggggaattttgtattttttgtatttgagaagataatgcttttgctttactgagacattgtttactttgactatttttggttcaatactactactgagggcaccatttatgactctgaattgtatagttggaaagttgctaagcatccccgcccctagtgggtgagtgtgtgcacagtctatcaatgagagaggtcaagttcaagacccttacgtaccgtctcctgttcacttatcatttttaacagagaattggatatggatgtaccccgcgtataggacgggcatatacaagatgagatgtgattggtcatttgtctcgttctttatcgtgttgcggcatatgaaatgccgcgtatgatctattaactgtaatacattagttctagcggcccctggcccgctggacctattacagcatttctctttagagaggagtgattaatgcccgcgtagcgaactccaaattgcgcctggcttgatagtctctagtctaatctctcccgtcagtantcatatcgcgtattagtcgaatctattgtatccgccgcgtattctgactcccccccccgtgaagcatgtgtatccgatctccacgtccgacctggtcgcttgcttgcgagttatgtgcgaacggcccgacctctcgcgtcgctagtacattcattattgtagcttgtggttgcatagccccttgatcgtaggcattagatgtaggcgcggaaggaatcgctgtatgtactntaaatgatgaatttagtctgtagcatctatgtatgatttctgttttgtaccgatgcatgaaagaagaataatcgggg

SEQ ID NO: 20286 - DNA, 1069 bp, Homo sapiens
  misc_feature (1)...(1069): n = A,T,C or G
cgtagacgaagttccgtctgtgcagtctgtagataagctctatggcttcggcttagtcccgtattcgattctgtgtagatatacttagcctcctttctgatgtcattgtctaccgtgccgtggatgtgtgtgctgtatgtcgctgcggtcgtacgtgaccattcgcggggcgcaactctgggtgcgtcggtgggaggcgcgcgtgtgtcggcggcgatgcgggtcagggtgcacagtctcggtcgtggcgaccgtcgtcgtactccctgtagtgtcgcgcgcggtggggcgggtggcggtgggcgtcgctgcgcctacgtggagtcggcggcagccgggtacggccggtcctagttggcgtatgctctagatgacggagtcgtctcatcgcgagctgcgcgcgtgcgggcgcgtcccaaccgcatcatcgagcggagcgagcgcgggggcgtgccggttcgggtcgcgcacagctcactggcggcgcggggaggctgtccctcactcagccggtgtccctccgctgtatatataatcatttcatcgtggtgacgtgagtttcgaactcgtccgcaccgcgccgggcgtggcgaccgcgcgcgtgccggcaccgcgtggtcgggccttggggcgtcgcgcgttgcggtccgcggggtcccctgtcgccaaaaacacgcatgtcccgttggcttgtcttgccactatatcgccgtctcacctaagaacacgcgtggcgtcgacgggctgactcatattatgtttagtgaggtgtgtataattttcttactaatcttgtatacttgtctcctcgaaccgccgtccgccacggttcaggggtgttggcgtgttgggagtggctccactcggcaagtggggtcaggcttcattgctacgctggggtttcctctccntacttgacaacgtgccatcaggccgtgctatgcagtatccttcatgaacatgtatatgacgcgtttaacgtttgccccgcgaggtagcgtantagcgttttgcgattgttttccaccnccccttcccctacccctcaacccaattaacaccccaatca

SEQ ID NO: 20287 - DNA, 920 bp, Homo sapiens
  misc_feature (1)...(920): n = A,T,C or G
ttccctaactacaccaaaaaacagacgaaaattcaaatgctcctcggtctcactcaaaagctattcatttttcctagctatttacaaaaacacaaattttcaacctcaacaaaggaaatgaggttttaaatttttctatttaaaaaaataatccttttcctttactaaaacattatttacttaactatttttcattcaatactactactcctatcaccatttataattctaaattttaaacttcaaaacttctaactatcaaacctcttagtaggtgatactnctccaatctattcctaataaaaaaaaaaaacaaaagcctcaaagactcacaactttacacttatcatttataacactttattcgataaacacctcacctcttctatctactgctatatactctaaagaccttctttaaacctttaactatattcctccaccaatcaaaacaataacatctcctcgactactcacacattccccataccctttcctataatccaccttcccccaacccatttcttcgtttacacatatccccgcaaacactcatttcttacattacacaaaagaaaaataactgcccccattaaccccaacgaacaaaacccactagccctctccatacacgaaagttagctcattaacctccctcactaacaaccaacctccccacccccaataaaacaaccaatattcaccaaccccaaacccccacatcacgtaccaccccgacacaccaacccaccacaacaccacctaacccatcaccccccacatacaaaacactacaaccacgcattcatcacatactcaacgaccccacccctcacaccacccaactacacacatcaaaacaagaccgcccacatccccaatactaatcttccttagccctcgacccctacacaacaccg

SEQ ID NO: 20288 - DNA, 806 bp, Homo sapiens
atttcacgtgagcgtattaggtgttatatgatgaggaggagagagaggaggaacgtaatacagtagattgttgaagaatgagtggggtgtgcgatgtgggggtggcggaggttgggggggggtggggaggggaatgagggagtgtgggtggttaagattgtgatggggttgagcgtacacgagttaatggaacaagggggacaatgcgggcgggggcagacggcggggcgagcaggttgggctatagtgggggcggtggatggggacggcggataattagtggagcggaggggcgagctggaggtaggggggggagtggtaagaggtaacggcggggggggggggggtgtgagcggggaatgattaagtttgtattatatcggttgattaacatgtggtggtccggttactctcagtgcgggggggtgggtggtagtaggtgggtgggggggcatggggtgaggcggagggcggggaggtaagggtgggtgttgtggtgttgggggcaacgggtctttcaaaaagaaagaagtgatgtataatcatcggccaacattatatattaaaaaaatttatttttttttttttcctacttttaagttcacaatcataaatggtgacaacagtagtagtattgaaccaaaaatagtcaagtaaataatgtctcagtaaagcaaaagcattatcttctcaaatacaaaaaatacagggttcatttcttttcttgaccttgaaaatttctgttttccaaatacctaggaaagatgaatcccttaaggcgttgaatgccatggtagcaatcaatg

SEQ ID NO: 20289 - DNA, 899 bp, Homo sapiens
  misc_feature (1)...(899): n = A,T,C or G
tttcatattgagtgagggaaaaagaaaattacttcagggagacacactcgggngatcagcaccaaggcaggcatcgtcattctgcatatgcaggccttgactggcancaaagctgagtggggggaggggtacgtcantancacacagaaggatgaagggccgaatcagctctgggttcaacagcgactcctcaagaggccggtccacgtggaagtcatggatgtgggggggccctggatgggccttgggggcaggtccccctatacgctggggggggtggggctcanatggatgggcaggcaggggagctgtgaagaagtactgatggaggagagcctgggggtggcaagcctctgtccaccatttctctgttcagggaacaccttctcgaacatctcaggcttaaacctgccctccaccaggaagctttgcttgaccccaagtcgggcttgcctgtttcctggggctcccacagggggagaacatgagctcttggggccttgtggagctggaggtgcgctaccaccaggagtggccccgggaggaggactgattgtttccatctgggcagggcccaagacagtccgtgagtgggccaagtgggcgaaaagactgggtagtgggtaagggggtgagttccggtggagaaagataagaatgggctcgttggcctctggtgtggaactttgtggtggttcgctagagggggggtgaatccagagtctgggtcttaagtgtgtgcgtcgggcggtctgtgggcggacgtggtcagtacctggaaggggggaggggtgtgcgacgtgatggggatcctgtgtgcgggcgggcgagtgggggatagactgagctgggaggttgggtgtgcggtgttgaagggtggcccgtggaggggagaaagg

SEQ ID NO: 20290 - DNA, 1233 bp, Homo sapiens
  misc_feature (1)...(1233): n = A,T,C or G
atcgacaacggtggggatgtgagagtatagataatctgtgcgagtcgatgtgctcggatgtgtggcaagcatagtctgtgcctagtgngtgaccacggagagacacgggcctcactgaggaccataacgagtaccacctgttcaacctctatcgtgggcgagtgtgtgcttagggtgactcggttcgcagtgtggacagtggatgcgtggcaggtgctgtgcagagtggccaatggggtcgnggccttctgagagacatacttacttgtgtgactaaaagagcactcgtgacgctattgtgatgaagttgaatacttgcgttatatagtcgatatagtagatgtcgtagatagggctatgtactcaactagtggaagcacagcaggtggncaggcggggcgttccaatgtcgtcactactagactactaancacaggcacaagaaggagagtacaggacacgcatacagggagtggagggtgatgacgactgtctgaatccgtgacactgggcacgtatcgaggagtgatgcgccggcctacgtaggcgacggtggtgggcggagactcgtgcgggcgcgctgaggctgcgtnatggcctgtaccgtctgccgatagtgcagaagcagattaggtaganacacctcgactgcacatgtcctcgacacctcttcgnnacacttcctctcttggttactnatgnactctatacgactacacataacatatnacataacangactacatcactatatagtcttannntantcatctatttcactattacaacaactatattnnnntntactcatcatatactcacctctctctctcatttcactgtctatattggtgttccgtctctactatctcttcctgattgntcctatctctntcgttgcatagcctgctgttntttgttgtcattgngatgttttaacttagttatatatcagtcnngacttcntcaactatctgagcacactatgcttntnnattgttgagcgtgnttgatttnnccgttnncctatctntntnncacgtccgctctcttgtttttcagtctctnagtgtcctttccatcattctattataccatcgctatngcgctntctcttccatccaaaaacttcgcggttctcaantntgtttctctncactaantttttctttttttctctctcctactttcctttttcctttncccttttcccttntcctttcctccccctct

SEQ ID NO: 20291 - DNA, 1324 bp, Homo sapiens
  misc_feature (1)...(1324): n = A,T,C or G
agacgatgttatagttctcgatatacgataccgaaccaggaaggggngttcggagagaagcgtggcatcttgttttttgttacaacacacgagaacacgacacaacaacgaaagccactacaggaggcgcgagtgcagagcggtgttttttctgcgacgatgtcgatctctcagagcacatcgctctaccactcgcttcgcctgcagcgccgatacgcattcatgtgtttctatcgtatnatatgctgcatatagcgcagatgtcagatcgtatgtgttcgtcggcaccgctgcgcgactggaaggcgtgacaatgtaatgcactacgagtgaattaggaacgctgcgtcggctgcgcagcgtagaagcagaagtgtgtatcttttgtgtatgatctgtcttgttagtacggaaanagagagcgtgcgcggtaccagcacacgtggaccgatcatcncgatgtagcgtcatgtgcagcngcagtgtatttattttatcttactagcgtcgctcagcacaggtccgcgtcgaccgctcatctataacagatatcgagatcgcagtacgtcttctggatgcttcgtacgagctgactagtggtatcgtatcgagctctagctgctccgctatagtgcatcgngttgccgcctcgcggctacgcatgatataggcacagcgctcaggcgaaatgcttacacccgatcacgnactctagtggtagcgtctcgagagatggtacagacncgatcagatctgctcgcgatcgnagnctgctgtactacgntccgcgacactctgcttacgctctctctgagatgagcantattnctctacccgtacctctttcattgacagtatcgcgctgntactgaatagtcgtgcgcatgactgtgatcnagctgccatntacgcgacatgcgtcactcgctcgcgctcgttaggtctgntgctgacacancgtcaacatggagctatatcacggtcgtactnggtagtacactacatctgatatgaacgatcatgccgaatgtcctcgtcgtacgatcgtcacatctcatctgacgctgcgtagcgcgcntgtatcatatcactcttatacgtcgcagtatgtcttcgtatgtgagtaggagttcattagactaacgtcactccgtcggcgtngatgccgctccggtgtagttgacatctctatgactanctcatgattgtaagctctgnnctcactgctctcctgtcgctgagcgctgngatttatatatctcntgnacgaagccgtcatcgctggactcgtaatgagcgtgcagtaatagcagtgctgtatagt

SEQ ID NO: 20292 - DNA, 748 bp, Homo sapiens
atcgtcccacaccaatgatgataccgtatatagtccacatgagtctagggacctgcccaccgatgcatacgcatcctatctatctcactcggaggattgctgagtctaaaagctgacacttccccctgtagctgcattatgctatgagtgtcctgagatacctctgacgtggggcaactgcgtcagcacatggctggagactatccaccacacatcacacaatgttctgcatgtaccctaacaggcatcagagcagattcgcagacactatacacagaatcgactgcccggtaatgcctccatgcacctaccctgaacctcctatacagcagagggctccaagatcctacactggataaaaaccatcttttcaatactcggtgctgggacaacccaatatcaatacgcgcaaacgggacctagacccctcgctattagcgtatacagaactgcaatataaggcatcagggacctaaggccagagcgctgcactactgaaactccgcggtaaaacagtcggaacaaggtgggaggaacgggggaaggggggcgcggcctgatggaagcagcacgacgacaagcgggtgttcgccccgggggcgggcggatcacaggggaggccgagcagccggccgaccgcatgcgcgcggagtcgtcccggcccgatctgcgaacgcaccagctgacgacgtgggcgggacggccgcggagccggagccgccgcgcgcgaggcgagagagcagccggg

SEQ ID NO: 20293 - DNA, 226 bp, Homo sapiens
  misc_feature (1)...(226): n = A,T,C or G
tttcgacaggcatattggggataaagagaggncctcggctcttacccaatagtggattttcattcaaagttttttatccttctaataagacagtagaagatagcccacttcaaggcttttgagattcttaaagatcatctcgaagaaaattcatcagttttgctgcttaactctatatcttatgggatgctgaaattacaataaaaacatggcctcgttggcctca

SEQ ID NO: 20294 - DNA, 557 bp, Homo sapiens
cgtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcagggtccttgggctaggtcagtctgagtttcctagagaaggcgctcaagagtgcgttttacttctatgcatttcacctattttcagtgttctccattcaacaccagtattcagttgagtagtggaaataatttctggcatttgttccttcaaaggggatgtattttcttcctggtactagatgaaatctttttgcctgtaacaaaactgattatatgtctgttgtgaaataaaaagcga

SEQ ID NO: 20295 - DNA, 999 bp, Homo sapiens
  misc_feature (1)...(999): n = A,T,C or G
acatgncatngcgangaccgacattctttcttntacatctatatctcacaccgccgtacnagacagctagnagtttgtncgtcagagacagagcctaagnntaaaatgtagagtaaggctagagagaagtagtatatcgaaatgtcctgacgtggcagttatagctagcctctctagaaggacgaagaaggatagaactggagtgcactatatatgaggattagacagagctagatggaancaaaaanagatagcaattttctaggagagcgaattggataattagtcctgagatntcgaagcgatggaaaatgaatctccatatactaatgttcagcgctgaaatacaacgaactcttttcatcctagccaggtgcgtcaactctcatacatcgactgtataattctatactcttacaacacatagatctctttccactactaaggtcgttatacatcttatacttatctcatctcaagatcagtacttgccgtcacctcgtattaatacttgcgcgagcagctccggtatctctccgagagcagaacttgatcacattgatccccattaccctgcctaggtccggtctcattcctctacatgctgactcatgagcagatcctatatgctctcgcccctatgaggctagcggtctgtaatatcgcggcgttattcactttcactaatttaagaaacggaggagcataagcccaaattagaaagagtgaccaatcagtgtgcnaatcttcaccaagggaacttttttttttttatagntgactctcctgaatccattgttttatactcaatctcagccctccttaaatcaccccagtactcacactcccttcctcaatcctatatgtcctcctaatcttactctcctctattcttcttttctgcttctcacatctgtcctatgccgcttacgttccgccttcatgctcaatagttttctccccctaatcttattctatcttctctaccccccttccgtc

SEQ ID NO: 20296 - DNA, 1296 bp, Homo sapiens
  misc_feature (1)...(1296): n = A,T,C or G
cacctctccgaccgatcactacnccggctgtcgtctctcgcaggctanctcgctcctctggcacaganagatgtcttaagcctggtctagtcgatactcctgctctcattctcattcccacncagcctgacgagaagctactagtacatacatatagtgtctactcgtatgtcacgctgcacctccctcttctcttctgatagtatacaagcatcgacacgccaacaccttgcatgaactcgcgccacaacagtatnctngtgctcgtagagtatagcatgagtattcaccaccgcgatcacggtatctgtccataagcatactgcacgcacgctcgctgctatctgatgtactcatactattccctggaacgcctccagccacctagctatcgccgctttgtcatacagatatcgtcagcggcctacgttttgcacgtcctcgtctgctctgtccctgagagctacaccctcctctactccctatgatctccgcgtgcgttacctggctcttcgtactgatcaacgcccgcgttcactactttacccactgncctcgcgtcgcgcctgtaactctcctcgccctctcattcgtcgagtcgtcgtcttgctgttgagcgcacttcatctcattcttgtccctcctcgtctatctctcttatcctcatcatctcgcctcccagacatacctcccctacctctcgccgccatctctactagctcagatcttaacgtcggctctgtccgctgtcagccggcacttcctctgcgatctcttgatctcctcaccnccccccagtgcttgcnttaaatggactngtctcgcgagtcgcccgnnantcctctcaccatccgcgcttgtctcttcgcttaaaaagttaaatctcctactcagcacatcccatctctatattatacttttcattcatgtccncgctggtccgcggccgcgcggcgnnctctncnnctttggtgntgtttgtattcttatatgctctggactcgtaccgttccgatcatcacatagtaactatcctagccatcgcacatcacctatccctcacttacgtcccgttctcatgtcatcagacggtctcacacagcctactcaccttctcgtccttgccatccctgtctccgcctctttcctcctgctcgctcccccacgtttctatcagctgcgtntcgttacatgcttcgccgcatcttccacacctgatcgtatatcgtagcctcgctcccgagtctccactctcttgctcttactgaacactgccctgcacgctttatgtctact

SEQ ID NO: 20297 - DNA, 858 bp, Homo sapiens
  misc_feature (1)...(858): n = A,T,C or G
agtgtagcnagtacccccnantttccagactnactnaccgagctgataccaggacataccagcctttatcaaagactggattaaagcagaatatctacgtgctccttcgtcggcaggcccaacaggctgggaaataattgtgttggaagcactgggggggttggggtgggcttggaacacaggtgtgtacagcgtgctgtagtggaagttttggatcatagnaatcccgctgccactgggngacacncnagccaagaaggactgtatnagaagaaangcgaggaacnngnncaancggaaacccccgntaccnccncnnnnncnnncncnnncnnnnnnnnnnnaacccaaacannnnnangaagannnaganggaagnngnaccacgacaccgaaagggggcaccagacccacaacgggacagagccacngnanaacanccacanacnaacccnncnaaaagaggggggggggggcggaaaagcagggcacccacggccccaaaagaaagcacgcggaaaaaaaaacaaaggacgacgccgaccggaaccccgaaggagggaaaaacaagaccccagcacaccgaccaccngaacaacggaaaaacggacggggggagcggaaacaaacaaccgcaaggccggaaaacggcaaaacccagaaacaggaagaaccgccgaacaaacaggcgagcaaaaggccagaaagaggcccgaacccaaaaaaggccaaaaaagcggaaaaaaacaaaggcaacaaccgcgcgcgaccagacaaaaaagacccgagaagagaggggcaagacaccccgagaccaaagaacacacacgagagcccacgaccaccaaagcccacaaa

SEQ ID NO: 20298 - DNA, 128 bp, Homo sapiens
tggcctcaacttctgggctcaagagatccttctgtctcactctcctagggtgttgggactacaggtgtgagcccccacaccccgccaggtttctgatttttaataaagaactggcctcgttggcctca

SEQ ID NO: 20299 - DNA, 440 bp, Homo sapiens
  misc_feature (1)...(440): n = A,T,C or G
ctcagcggttacccaagtgataagggatanaaataaaagcagaagacccttccacctgcccacacacacggaagaaccaaaggaccatggcaagcaatgtgaagatgtgcttgcttccccttcaccttccaccatgactgtaagtttcctgaggcttccccagccatgcttcctgtacagcccatgtaactatgaagaacagttcagccatggactgcagctgctgcgtggctaatggaaaaggagcccaggaatgcacactctccgtatctactcaatgccaacaggcttgcctgatgtgaacaaaaattcagtcaagctgcctgcttggcactgtacaagcaatagatccaggtgcctcacaagatttccaactgaaataaggggctgtttttgaatggtgccggtccaatattaaatgctttcttccccaaanaaaa

SEQ ID NO: 20300 - DNA, 267 bp, Homo sapiens
ggagtttcccacaccacacccacaaaccatttcttgttgactcgcgcgaagccttttgggcaaaaacgccgccaataaggatgtcttcagagatcctgctcttaaatgcaaggcccgacgggaggccaaggtcaaatttgaagagagatacaagacaggcaagaacaagtggtccttccagaaactgcggttttagatgctttgttttgatcattaaaaattataaagacaaacacacaacattggcctctttggcctttgtggttt

SEQ ID NO: 20301 - DNA, 916 bp, Homo sapiens
agcataatataaaaaacaaaggacaacaatcctgagggtaacgcacactccagcgttaggggttaaaacagcagcagcgcaagcagccctgccagccaccttctgtgagccccaagccaaaccgcccaaagccatgtccacccccgaagagccctgagccctgaccaccaccaaagcgtacacagccctgcccacctcaacaatgccagacaaaatgtcctactgtgacaccttacacagcctgccagccaaagcgctcacctttttagcaagcacaagactaaacaataaatcacgacgatgaaacgatatcgataatgagactcaccatgaaacacaaccaacgacgccacctcccatcaaaccctcccacgcacacaacaaaaccctcccccactgttaacagcacgacccccaacgaaaaaatctaaccacacacgaaaaccatcaaaagatgacccaacccacagacaaaactaccaaagaacactgaacaccactaactcactatatacaccactacacctacagccccgcactacacaccaagccaccaccctacacacacccacccacccccgctcaaccacaacacagaacgtgaaagccacccacgcacagaaacaacacaattaacacccgtacccccctatgtgaccccctccaactaatctacatctaacaacccccccccactcccgccacttatatcaaacctataatcaccccacccgaacacaacactaaatgatcccaccgaccaccatccactagaattcctccacccataccaactacactactgaaattgccgcgctccactccataccgcaagttacaccgagtacaagtccaacaagccgtaataattgtactctcatgctatccgaatacacccatgcaacaacacacaaac

SEQ ID NO: 20302 - DNA, 1219 bp, Homo sapiens
  misc_feature (1)...(1219): n = A,T,C or G
tcttttctgtgcctgccgtcacgtgcactctctccccgttctctcctctgccccgtcgtctgctgggcgttcttcgcgggtgctgtcgtccacggcggctgggtgccggtgtacgcggtcgcgtttttctccatcgatcttcgtcctgctttgcccgtccttccggctgtcgttctcgctcgacggtgttcgtagtttctgctcgcngtcttcttcggcgcttctgctcgctctgccgcttctcgtgcgttcgcgtcggctccgctcgctccgcgtgcgcgggttcctgctcgcttccggccgtggcgcgagtcttattcccgcgctttcggttgcctcaccgccgcccgcgcgacatattcttttcttccttcgcccctctccgcctctccttcttgctctctctctcccttccggcccctctccccttcccctcgctcgcccgccctctctcccccccttccctccacnattctcttctccccgtcgctctccttatcttcttcttctgtctcccgttcgttttgttctctgcccgcctctccccgttcctctccgcttgtttacttgccggtttgtgggtggtttctggcgcctcnctgggccgtcggcgagcccggccgccggcgcccctctgcccggtcgcccgctcctcctccctctgtcttggccccctgttcccccctgcccctctcccgctggcgcgtctcccgtcgcgcccgctccttcttcctccctctccgcttcgcccctccggtccccctcctcctctgcctngtctctgctagaccattctcnccctttatagaaaaaacttttcctttctccttctcgtgcccctctcgcctcgcccccccgccgtnccccccgccctccgccccgcctctgtttcctctcttctcccctcctgccctcccgcccgccgctctgcgccctcctntctcctccccccccgcctgtcttcggcctctttcttcctcccttgcctccccgtcccccgcncggggcgccccgctnnnncnttccccctcccctccgtctttttctcccctcccgtgtccnnaaanccctctttcctcccttcctcttctccttccntttctctttttctntcgggtttccccccccccccggagggtttcngcccctcttnggttntcccctcncagggcctttttttttttcttccctttccctctcttccctccttctctctnct

SEQ ID NO: 20303 - DNA, 1720 bp, Homo sapiens
  misc_feature (1)...(1720): n = A,T,C or G
cagtgtgcacgactnagcatccaatcacacacatagcattgagccgtgtcatcgacgcacgtcntctcacacactccgtgtatctctattctcgtgtctggtatcacgtctgtcgctctattgctcgcgagcactcacctagttagttcaggcacatcgagatgancctgcgtctggatcgcgcatgccacgctgcgcataagcgccagacctccgaactacgtcagctacgcaaaatgcgatgngatacgtataacgtctggtgacgtatatanattagcacntgctcatgcgtgatcgatgtgtgcaagtctcgtgtacatagcacgtgactgagcgtcggatgcgtgtacaanagcgagcgcttccgcgctcatcgagtcantagtcagcgctcctacgtactnaacgctaacanggatgagcgcgcagattggngcaagttactgcgcatgtgttgtatacgtccatggagctaatgaataatgtgtcttcgcgantcgtcctgtatctgacacctggatgcgatccgtctgcgtacatagntctcttanagatacntatcatgcgaggagtgtgcgctatccacanccgcatcatcactgtctcgcacccgatcatactactcantgatgncacgcagatcacgctgccatgagacctgcagtgatacacaagnctgcagcgagctngacacgacgcaatcngctcagcagctccattatcacggctcanntatgcacgtcatctcaatataactatggaatatatgaacgngagacgacatatagcgagcagctatcgatgctacgtcgatgtgtagtncgatcagataattagtatgtngacgtgtgatgctgtactatgtganctcgatcgtcgactgctgntcgcgcacnaatcgcgctcaagtctagcgcgcgccgatgtgatgtcttcgctgtcgtctgctaatcagacgacgcagnagtaagctgcgcgacctgtgcagaggcactaaggaagagacgacacgatacacatatcacatangcgaagaataggtcacagtgagtgacccgtactnccagcaacaacgngaccactcgcctcacgtatcaacactacacgacnctagaccanatccacatactcatcatcatctaatatcatattcatatactaacttcacttctctctacctcactcatctctctatattctatcttactccantctcgacccgcttgctctcgacacactcgccctcgctctcnccctgcccagcnactacctacgcagctcctgtancactatncgtagcagacccgctgcggagtngncacaggaacgcgcactacaccatctcgtattcatcaagagtgcagatacagnatgtgagagagagacgagcagtanagaagatgatgaaactgtactnaactgtgctgtgngctggcggtgnatctttgggtantggctcgatntataggtgcagctntacagctctcggcgcccctaccagagttcagccagacgcggccctcttcgctcggctcggcccgcgccgcctcgggggagccctcggactcncgcgggacaanngaagatntgatactgatanatnanccacccacgccccctccctcattcttatcnaaatatcatcatctaccattccatcatctcttactcatnctctatcctctcatctantatatcctacataacactacttctt

SEQ ID NO: 20304 - DNA, 874 bp, Homo sapiens
  misc_feature (1)...(874): n = A,T,C or G
gagcagaacccgcacgagccgtggaacaaaagcaaggaaaaaaaaagaaaaaanctgagaaggtgaacccgagccccggncgtgaggaaggacaaaccgcaagacgcncccagaaaccaaagggaaagccccgccggagaccaacgaggaagccgaaaagacgcacagacccagagaaaagacagaacgagacgaacaaccaccaagcccagaaacaagacagccgcaggaacgaagaagagagaccgcagcagcagacacgaccgaacaaagaaggcagcacgaccaaatgtagaaaggccggcacgcaggacaaagcccagacaacgggagccaaacaaaccccggagccccgaacaaacgcaggcccacagacaggggcaggccagcgcccacgagagaaaaaagaccccacgggaccaagagacggccaagagcagagcccggcaggagagacgcaagcagcccgagaacaccgacacaacgccacccgacggggggaccgcgacgagccaccgcgcaagcacccaaaagaggagccgagcgacacgcgaacgcacgacaacgaaaagaccagaaggcgaacgcgcagacggcggcaccgcgacaacagaaacaggcggggaaaacacgcacagacgccgacagggagcagccgacacagaaaaagacgaaaaaacacagcccgggagagagaaacacagcgcggagagggggacaggcagcgacaaagaggacccgcccggaaccaaagacgccacgacaccgacgacaaccgagacggagcccgcaggagcacaacaaagaacggcacaaagcagcaaaaccgcaccaccgcaggccgccgcgaaagagacaaaaagagagaagagag

SEQ ID NO: 20305 - DNA, 784 bp, Homo sapiens
caggaggtctccacggggctgtttatcctctgtgtcgttggttaaccatccggatctatcaaagcgagctcggtccgaggctaagcacctgtttttaatgactgctcggttgtaaaggctatctcccgtttgttcataagtaggccctatactctcgaacaatggttgaagggtgcggcacttccaacaacctttcccgagccattgggtctattcttcattctgacgtattgattctcatgggacttgattcaggccagttttttccaaattcacatctctttttagcttgcgtaggggcttgataacattgattttctggaggagactttgctcgtagatcgaatgcactcccttgacactatagatcaatttacttcgctcatactatagtacccgcggagactatatggggatttgtgggttagcgctacactgtttatttaaaagttgtgcgcccctcgtacagttgggagaggagcctttatttttttaaagacaatataccccccaaaacaggtagacatttgtccaggaatgtatgtcaagaactcttagataggccatttccgtgacacaggcgacgtatttataaaaaatactttgattattatctaggttagccttaaagtgaatctccaataaaagatccaggaatacaacttaagtaatcatgaggtccttccatatttagattgggtaagcatgaatgtgtattttttacaaaagcccatgagaagagttctataaaaaatgttagctttataaaaaaaaaaaaaaaaaa

SEQ ID NO: 20306 - DNA, 811 bp, Homo sapiens
  misc_feature (1)...(811): n = A,T,C or G
tgttctgtgatgtatccatagtatagactacacggtatataaagtaatcgacttgactctcataatttcatctgtctacatcaccaacaaacatccaggggccaggcactacttacattatatactcacgcgtcgtatttattgtaaatagtcagtgatggtaacgtagacaccataatactcggtctactacagtgtggcttcaaacgaaagttactcttatactattaacacgcacttgcgattgctaaanggntagatcaaattcccttcacataaaacttacaaaagaacatgatcaaaatacagacaattgatctaaattatgttttgctcacatatttactggttgtctctacataatattcatagaatctctttangcaccatgacgtataatagagaaggcatacgacacataaatatgggatacgatcagaaaagggagtgggtattcaataaagatgaaaaactatatatcacttcacttactctactactattggtggactagagacagcggacacattatactcatctttttgatctagtacaatataatataacaatttttcctcctactacctaaaaaaaaacaatctaattataaaagtcaacaaatgaaccaaaacccttctttcctcatatcatccagagaattagggcccatgcctctgtcaagcccttcaatttctctttacaaaaatcaacggagaacaaactccagttacctactgcctagcattcttgttaagatacgtatgtaaataaaatgtctttatatacctcagccatttaaaaaaaaaaaaaa

SEQ ID NO: 20307 - DNA, 1098 bp, Homo sapiens
  misc_feature (1)...(1098): n = A,T,C or G
taaatgtgtctgtactcacagnttntnnccccgcgcaggannntttggcaaattcggagtactagtttttcggcccacaaagnatatcgtgctcacagtgcacaccagaggtagcgagtatctacgctggcgcgccgacctggtcatngacgtgggcttcacttggtctcatacatactacatagtggactacaatccatggggcacagacgatgcttgcaagcgaccaatagttctctctagattgcagccaggacgggtctcacacatgatcactcaaacatcgtctagtgatagctcgcgatcaaaaatatgtccagcgcatcatcatacaagagagatttggctagagtaacatacggcgcacggcacgaaacccatgtagttccaggaagaaacaattttttttttttcttcactaggcgatttgctgggaccaatcttactaagtaagacactggtgggggccgctcccgcctacattgagaccttctactcgacgatgtcgcctaaacaaaaagaaaagtgcttcttattaccatgctacgtcctggccttaattgggatctaaatgcacacagtctcacatacggtggccaataacattaacgcatccattatactagtgcatgagtcttgttcgctctaagcggtatcgnatcatcttcgttccttttgtttgtcgtcatttctgcggaatcgtgcatagatcaatatattacgtattcataaccatcgcacccaatctgcaatgtggtctactagataacgccgccgttgtcactgtgtgcgtaaacgcaatatatcatatagcgcgctgtattacggtcgcgttcgatcatatatatgatgttccagctcatcgcgcataaatctcttccctttatactacgcctactcggtattcggtctgtgagtcgtgaattggttattgcgcactctactgatcacttgttattcacataattaatatcacgcgtatcctagtattgatcatatacatgtttttgttcctcgtcctgttgcgattacacgtgtcgtccgtactaataggatatctacatacctccgttctccttgacattaattttgtgttcg

SEQ ID NO: 20308 - DNA, 134 bp, Homo sapiens
tgctgtgttagcggaaaatgatgactagtaggaagctacgcctgtgaagatgattttacctgcagctgaaataccatgacccagatattgaacacacagaataattaaacttttcgtctagaaaaaaaaaaaaa

SEQ ID NO: 20309 - DNA, 326 bp, Homo sapiens
ctcccacctacattcaaaatacccgcagactttcagctacctgcttcagcctagacctgccatgaagcggactgctgctccctggctcccactctgatctgcttttcactcttgccttgtctcccaattaataagccaggtcgtggtggcaggcgcctgttatcccagctactcaggagtctgagactggagaatcacttcaacccaggaggcggacggaggatgcagtgagcggagattgtgccattgtactactccagcctaggcaacaagagagaaattccatctcaaaaaaaaaataaaaaaaaatggcctagctggcctca

SEQ ID NO: 20310 - DNA, 743 bp, Homo sapiens
ttttgaaaaacctccaaactgtttcccataatggctatatcaatttccgtgcctcccacagttgtcaaaaggttccctttattttgcatcctcactaagaatgattacctcttaatttttgataataccccttaaaaaggtatgaggtgatatctcactgtggttttaatccgcatttccctgatgaattgtgatgttgagcatcttttcactactggccatctgtacgtcttctttggaaaaatgtctcttcaggtcctttgcctattttgaaatcaggttgtttttctgctactgaattgtaagttccttatatattttggatattaaccccttatcagatatatggtttgcacacattttcgttgtgtttttagttgattgttccctttgctgtaaggaaactttttagtttgatgtagtttcatgtgtttatgtttgcttttgttgcctgtgtttttgggtcgaatccaaaaaatcattgccaagctcaatgtcaaggagcttttcccctgttgttttctcctaggagttttatggtttcaggtcttacatttaagtctttaattcattttgagttgttttttttttgtgctgtttatattttgaaattacatttgttgctctgctagttaccaggcatattcatctctaggaaagttattttctgccatcacatcctactaatcctattaattaaatggtcaaataaaaatttccatagagcaaaaaaaaaaaaaaaa

SEQ ID NO: 20311 - DNA, 1061 bp, Homo sapiens
  misc_feature (1)...(1061): n = A,T,C or G
ccaaggaggcgccgcgacgggcccagcccccacctctacggggacaccagactacaaatttttcaagcgcaacaaccatccgcaccaagacgccggcccctggcgtgaacgccggtatccaatgcaatacatgagggcccctagtgcgtgaagtgaacggtcgcatgatctgtctcactcgtatcgccgagcggataagaaaacgataagagtggatccaggaatagacttactaaacacctcgggcctgcccatataaccggctggtgcgcgagtcagaatgtcctaacacgtgagtgagagctcccactctcaccacctagaatacatattgagacattgcgacagaattgttcgctaaggttgagactcggctgacgtcgttgatatnaagcactatgtggcccgggagcattgcgcgtatttttttaatcctcttcgtgcgctgtctaatgtctatcggaatcaccaggcctaataacaaagatcggcgacggcagcccagctagggttgtgtaccctgccctccgccactgtcacgccgtcccaagtgtttaaggggaattgtaaatcttggattgagtgccacctcgcatcacatctgccccgacgtacacatctccataccgatcagaagacttattacggttgtggcagtggcgcccggagccgcgccctcatgtgcccgatgcgcatatggaacttcgcaaactacttaacatagtcttgtcaatataagaagagagtcgcgtcgatggctgattctgcaagtaggaaatagcgcgctatgtagagcacttgaggtaaaatnagcgtatgactcaagtattgtgatgatctctgttgagctcncactgatgatcttctccgtaatcttaaagtaaggcaccttgccctcgagtatgacacagtcgcgtatatttcttccttcacatcacccatgggcgaatctgatatttcacataggtataagagagggactgatctgacagacgctcatagaaatacactggatgacatacgatactacntacaagaacgatacataatgtaatgtatag

SEQ ID NO: 20312 - DNA, 891 bp, Homo sapiens
ctcaggcataatgtccactgccctggatttgtatgattcttacaatgctatggaacttgtaactttatcattaaaacaatctgtggttgagtcaagtagtaaagcaaatgtacttcctaaagatcaggaccaaagattgccagggagcactacagaaaaaagtttgcttgtagaagctatcaaaaactgctcagaacaatccaatcttagactggaaattacactgggactttatattagatcgatctttcccacaccattaaggccattgacctacaaaaatgtgcgagtgcaaagtcccccacaaaaaataaatctcaatttgtgaaaaatataaataagtagaagttgaaatatttcctctttatagatcctatgctttcactacttccgacttcctcccgttctgcttctccttttcggtgagactacacgacttttctgatgtccggtcggtcatttactttgtctgcttttctcttatcattcctttgtctctcaatactactccaactcatcgcttcctttactctccctcttcctttctacccctctaccttatcccatctcatactatctcctgcttctgcgccaattggatcgaagtatatcaatagactctctcttcatcttatcccttctaacctcgtatccacccgccgacacgcccgttccctgtctccgaccctctcaatctccgtacatttaaattagtaccggtactgtatttcagtctttatttttcagaaacgcaatatcacctctagttctgctcttataatttttaaaagacatgtattaacaactatgttatctatcaacaggttttctgattctcacgctcttcatattctctcgaataatttctctgttcctctaatgtttgtatct

SEQ ID NO: 20313 - DNA, 113 bp, Homo sapiens
ctcagacatgcactacggagtccccatccaaggcactgaatgagaacatctggaacactcaataaatattccatcaacaaataaatgagggctttaatttaaaaaaaaaaaaa

SEQ ID NO: 20314 - DNA, 768 bp, Homo sapiens
atcacaggtcgcgcatgaagcgtctgtttaagttccttgcctgaccacagccccgcttcccctttcacgattcccaccgccctgatctatacaaaatatcagacgttcattcgcctccacacgatgctcccagcattctattcgtccccccgcccttagtcaacacgatcccgctataagctctccactctgactccctaccttcctagaccctcatccacttccctctaagtcaccaatctgccaagcctttcccacgcctgatcagttaccttcataacagtttactgcatgcccgcccccgccatgtcctgtttctaacttgaatttcttacagtttgctcaattaccctcgatgtctcatagctctctgcttaaacgttcttattcccatttaaccttcagtcactatcaagtggttccctatccccacctatacgacaagaatcctgtaccgctatacaagtgtaggtccacttttggttcaccatgcaagtttgtgtaatgaccactaacccatcccctctatgtatctggccacccatcatctgccctgtgccttacaaatgctgcaaaaaaaagctcccatagcgcaataacggtgattaaaaaaataggccccttaagctttttcccaacatataacatgccagtcttgtggcaatctgttatttttcctcagtaaatatctatttgtaactatatcaaattatacagtttctggtgttactaataaagaccttgggatggcaaaaaaaaaaaaaaaaa

SEQ ID NO: 20315 - DNA, 1845 bp, Homo sapiens
  misc_feature (1)...(1845): n = A,T,C or G
aaaaaaaaaaaataatatataagggggaaanagnataaaaaatannnnaaaaaaaaanaaannanntntnnnnngtngntggtgagantnanatganataatgatgnatnnnannnntntatntnnnnnaanntcccctttgangnanntnnnanacanctcnnannacnnagaaaatnggtaggntgtcatagnnanagnanngnnanagagacacatnngnaanagacgctggagngagagagatagatatatgagtagatagagtatataagaaatagtnggtgtttgtggntgtagtaatgtgtgattatagagatgatagagagtngtagagtaanatataggaaatgatgagtagcaggacaagnaaganacacagancgacacgtcgagagntaaagcgagtaataatatantntaatcgtgagaacgttgggnttcanctcatnttntntgatcgcgatncggtgtgatatgcgtctntatacgctangtacagcactccgtcatatcgagattctacacgacgctccatgtccacaacagataagctaacgcagataagtgatgaagagaagnaagtagatgagtagtggtgaagantagacgtggcgcgccagactactcagatacatagaaanggngagaangtgatctatagacnnagccacgacaccgcggatacgatcgncatccgctncncgtccagacgcagcgcgcantgcgcgccaccaggcgcacgcgcncgcgcacgagcgagatgngcaggaggcgagcggagagnangagggncgaataacggagtcgtccgcaacggcgctgatcactgacgcgtcacgccgcacncagctcgatccatcacacgcactagcgacggagcgcgcgagacgagagagagacgcgcgacgacgagcngcaacagcgncnagcgcagcgcgttatcntccgactcatatctaccactcacatactcacngcanancatcaccnatcttntcgcactcacanactcacgcacccacttcacctgcccagaagtatgttgctacgcatantctcgactngntactatgcgcagctacnagactacactcgctgtcgctgtaccagnaagacagatagtngtagagcgacacacncgnactcgtagcgtaaggantatantgcacgnanatgagttcagcgnagcggcgctgtggcgtgcgggngattgancatcgcgcgtacagtcgagacgtgtngctgtgcntacgcgcgccgcactgnagcgtctcgatntgtatgtcgtacgttctgctacgatcgagngacgacacacagatacacatgatacngtgtacgaacangctgcgtgcacatcgcagatgaagactgacgcagcgcgnancgactagatacgaccatcacgcgccacncgatnacgtatggtagctagtagatcgccatgatgtagtctacgtgntacaacactangcgactcgaagcgagtatgagacagaacgtcatgagcacgcacgtgtccatccgagacacacgacgacatagttacatggatgcacatgcacacacaatctagacacacgaatgagtgaggcacgtagtcaacacgaagagtcgtagtactgagnagcatatgaggangagctggcggtgactacccgtcgcgccacgatcatgcaatatattactncagagacatngntggcantactacgacgtatcgcgacacagcagagacatagtcctccgtgtaancnatctcacgcgatagctcatcaccccacacttcgagcgacgaacgaatagagacacgcatacagccactacgatctcgtcatacag

SEQ ID NO: 20316 - DNA, 136 bp, Homo sapiens
cttcaggtgttcaaaagtaatcgaagtacgaagaggacatggtatcaagcagtcattcaatgactataacctctactcccttgggattgtagaattataacttttaaaaaaaatgtataaattaaaaaaaaaaaaa

SEQ ID NO: 20317 - DNA, 1823 bp, Homo sapiens
  misc_feature (1)...(1823): n = A,T,C or G
ggaagagagagagtgagaccggtgagaacagcacacaagaaggcgcagagaccagggagcgcgacgacgagagcgagcccctagnaggaaggggagngaaaagcnggngaggggagaggcgctcagcgcggggggagaaaagaacacccgcaccggccggcgcgaggcaaagnggacagcacagagaagagcgacgaccgcagaacagcgagacgcagccagacgacgcgnanacgacagcacacggcaccacgcgcgcgagcgagaggaggagacgcggacgcaanagacgacggagacgcgacgcggacgagagcacacgcaccacngacggagaacgagncagaacagagagaagcacacacgnacagcaagacacgagcgcgaggaagacaacgcgaggagggcgacagggacggncgacgcggacgcacgcagacgacgccacgccggcncgncngagagacacagacanacagcagcagacncaagacggacagcagcgcagacgcaancngancagacgcgacggagaggganacgcactaacgtgacgcgagacacgagcaccgagaggacggacacgacgcgagaccgcggngnaanacgaganagaccagagcgacgcnagcgagaacgaagagcgcgcagcgcgagcacggcgggcgcgcgcagcgagcacagaacgccggagnganccgcgaaggcgnagngagcgcgacnacacagcacgggcacacgagacnacgcgccgccanagagacgagacgagcggaacgcgagacacgacgccgagacgacgaccacgacacgcaccnacgagancgagagcacaaaagaccgcacacgcggcacgcagcgacgcgcgcagacggcganagacacacacagngagacgcgacgacgcacaccncacgacgcagcacgagggcgacagccgcaccgacgcnaacgagagagcagcggacgncgcgcacacnacgacgaggcgacagagcncncgcacagcagcngagaagcgagagaccagcgacnccagcgagaggagcacagacgcagagcgaagagcacanagnagcgacggaccgagangngngngagacgagcgacggagacgagcgagcggagacggagagagnacgcacganangagcggagcaaggacgcagagcacgcagaagagggagcggacgacanacaaggacaggaggcgcgcagancgcgcgcgacgagacgagagacgacgaagaganagcgcggngaacgcgacgagcacagccagagaacgagcagagccagacagcagaaccgngggcgcaagncgcacgaagagaggagcgcacgagcacgagangcaccgagagaganagagacgaggggagacaggagagaacggagagagagacgangcgacgacacgncgancgancgacgggganggtgangagcagacgacacacaaannacacgagcnacacagagaggaacagcgagacnaacgcaggagaggacggagcagtgnacgcagagcacacaggagaaaggacgagagacagcgagcagcgacagccgcgcagncacagcacgcgcgatggacnacagtcagagcaacgtcgctaacggagacgacanagncgagcgaacgcagacagctgncgacacgagagcagacaagaggagacantaatacagcagcgacacgcaccggtcgaaggagagtcgcggacacgacctacacgacaacagagagcagagactgccacgtgcagngcgaggcaccgccacgacgcgcgacatacgacacacagacgagcaagcacagc

SEQ ID NO: 20318 - DNA, 1279 bp, Homo sapiens
  misc_feature (1)...(1279): n = A,T,C or G
ctccggcgctgcccacgaccgtcttcctaaccgtctttctccccccctccgccctttcacacatcgctccacgtgacgaccgccgtgtgtctcagcgtcccattgtttcgtctatgcacactccactttggtcactgcctgcacgctttgccgccagcatcccgacgtccgcctccacaggtgcgttatagtatcggttgcctcgtgcatctcctcccaacctcttaatcttcgtacggggtatcttgtccctcgtgtcgagccgatgtcgttctatttatcaagcatacctcacgcgcctgcgacacagtgggtacaagatcttatctattgctaacatctccccgccggctcgtcagagtgtggcgtcattcatccggtcgtctgccgtcgctgcgccacatgaccgcatcgtgtatgtatcacaaatagaagggccaagctcaataagtatccctgttcgcgaatacatgcttcgcaatatcgccacgcgacctgagcgcgtcgagatgacgtattgacgtttcaacagaggtgtgagcattctctcaanttcacgtcgtgtatggcgcccgtatgcatcccgcttgcgagctcaancaacaccgccaacaaccagtccatattagcactacacatttccggctatgtggagttaatcgcgaggacgagagacaatatgattatcgaaggcgacagagcttttcatcgtatctctcagcgcacagcgaagcgacctatgagctgtcgggctgtcctaggcccnacgcacgcacctcctccgaggcgtctatatattgattgatggactcttcgtgtgttgctcagctcacgccatctcaacacatgtcactccgacgttgagggttgaatctcttctgtttttctctactatcatattcgtcatccgctcacattcgccgatgtgttagtctcatagagaanatgcctccctcccagaatgatcgcgtggagtcctagtattgtgctcacactctcaatcctcctctccccccgcgcacccctctccgatactntcttcaacacactacgccgcnctcatcgtgtatagtaatcatgcgtgctggtgagctgggacagaaggtacgctctgtgactgtgcctggacgtatattattatctcgtcggatcgcgtcgtatagcctatattctcattgtgtacaacccatgcacgncgcgcgtcgtgccctacatcgtacgtctcctaccacttagatctattgcgtgtgatctacgggctgcacgngagctaattggg

SEQ ID NO: 20319 - DNA, 612 bp, Homo sapiens
  misc_feature (1)...(612): n = A,T,C or G
aagaaagaaacagaagggaaaaaccaaaaataggaacgaaaaggacaccttgcgacacnangaccaacttgnangcggnacnaccgggcagnccngnccngagccnggncctgagcgggggaagagcccncangnaggccacagcccagacgcccaccccacacccacaggaacggcaaccacaccaaccagaccaagccagacagcgagcacaccgcaccacggaccccaagaggagggaggacaaccagccgcacagcagatttttttgacaaagcgggccgccagacacaaaagaaaacacgagccagccgaggaggcacggaagacagacangcccccgagggagagggcccaagaccggaaagaaaacaacggacacccaaaagagcagcaagccaacaagaaaccgcggagacgaggaaaaccacgagaggagaccggggcggagccgaagaagggaaaacgccgccccgcaaaacccgaccagcaaacaaaggacccgcgcaaaagaagagcaaaacacacaacagccccgaacaacaaacacacacacaaacaggaaggacggacagcagcacaaaaacaacaaagaacgcaaaaaaaaaaaaa

SEQ ID NO: 20320 - DNA, 942 bp, Homo sapiens
  misc_feature (1)...(942): n = A,T,C or G
cctcagactaccaaaatngatgtcacgtcaaaaagcaaatcaagcaaattcaaaagattttcttatttgagtgcataatgggtcataaagcagcagagacaacctgcaacatcaacaatgcatttggcccaggaactgctaacgaacatacagtgcggtggtgtttcaagaagtttgcaaaggagatgagagccttcaagatgagaagagtagtggctggccatctgaagttgacttcgaccaactaagaccaatcatggaagctgatcctcttacaactacacaagaagttgccgaagaactcaatgtcgaccattctacagttgtttgggatttgaagcacattggaaaggtgaaaaaactcaattaagtggatgcctaatgagctgagtgaaaattttaaaaatcctcagttttgaagggtcatcttctattattctacccaccacttcaagaccctttacttgatcggattgcgacatgctcaccaatagtggattctctcccgttacttggcgaccactacgatgcatggctggatgcacttaaatgttcttatacactttacccttagcacactatgataccaataaatggtcttgcgtcttgtcccggcggcttttctattcgtttgtaccctcaccatttccttattatctcctcagccgtttatttctgttctttctatctggttctgtctttttcactactacccccacatacacatctcttcagtcccgtttcatacctctacttcctctcattgcctggccctggatcatttcctggcgaactatttagcagctcactgacaccataggatgccgttagcgagtacatcacattaagtactataccagacgagtaagtcagccatcacctacctacgcgcactcacagcatctcacacgatctcgcgaaacatagctatcttcactctat

SEQ ID NO: 20321 - DNA, 911 bp, Homo sapiens
  misc_feature (1)...(911): n = A,T,C or G
cttcagttgtgttgcctgtggattcaaagaagaaacattctcagaaaaatggaacccattcttcaagtaagggaatgtggagagtgacattctcctgccagtaaggacaagagatgataaaattgaactaaggtgatcacaatgggaatgaagagaagcaaacacattcaggagatatttctgggtccataggactttgtgacctcttgagcacagtggcgaaggaaagacagatttaaggtttctagtctacattcatatatggatagtgatgactacaacccatgggaaacatggagaaagtttcattaaaaaaggacaggtccaaaggcagtctacaaacttcaggggagtacatgctctggtcaataaatgtgtagttattcaaaatgcaaggttcgataaacataagaaaatgtgccaaattcattagtcatcagggaaatgcanagtaaaagcacaatgacatactagaatggctaaatttaaaggaccaatgataccaagtattgatgaagacgtggaggaactcattcaacgcaggtgggagtgtaaattgatcccctactttggaaaatgtttggtagtatttatcaacgctaaatcaggtagcaattctctcctggcttattaatacgctccaaaatttatgtttgaattgccatgtatcacaacaccggcacaggctaataatgctttaatgtacaacgataaattgcacgggctccttcaaaaaaaacgcattatacacgcccttatctctgcctccctggcctaacccggaaccctcctccctccctttgctagggtcttttttgtacctcctacattactcgttggcttgggggcagctccgagagagtctcgcttcttatggctccccccgtctcccaaacatgtacacccgaaat

SEQ ID NO: 20322 - DNA, 517 bp, Homo sapiens
ttcacagatgaggggaacataatgtgatgaaagaacacctggaaaacagccaggaagctggaattttagttttagaagctagtgactttgggcaagtcatcaaaaaagcatcgtcctctgtttccttactcaaaaaagtggacattgagaaaggtgatcaatgagtttttcatcagctttaaagtctgtactgcggcttctgtacatctctgttaaaatatttggaaacagaacagaccctatggcagaagtcacccctcccatgccggctgttgaaaggattgaatgagtttgcagctcccatggatgagggcctggtccccagtaacccctgcataagatttacctagtattttattcaatatttcattaatcaagttttacctgatttatgtctttggttattaatttcccaatttgtaaaatgaagtttttggattaaatgaatattaaatgtaaaaaaaaaaaaaaaaaaaaaaaaaaaaaaaaaaaaaaaaaaaaagaaaaaaaaaaaaaa

SEQ ID NO: 20323 - DNA, 1079 bp, Homo sapiens
  misc_feature (1)...(1079): n = A,T,C or G
gagagtgganngggggtgngnnatggnagtgnnattgntaggagnaattgtgatgtgaggaagtgatgtgntgttatgnnaatgtnnagttnnnnngtatggnnnnntgtgtaattgaggnattgatatttgtnatgaataannggnaagagtaagttttgnnattatgtttntatgttgnnaagtgntgnntgatagtggnngnnatagtgnaagggngtcaggtgtgccatatctattaatataccatactcgcgttatgacnnntttnntggtcttgtttgtagattgcattatanacatttctcncagtattgtatatacaattatgtatattttgttatgtagttgggncatgtggttttattnaagtnnatatnnnaatttntnnttaagtntatttctttaattggcaagttttttctgtttttattgtatttttattgtgttatgttatgtattgtggcgattttacttttgatttcttnnataatgatttgagaacagacataaattatctaacgatcttttactttatactgtaccttctcttaatcttctattgttcatgtatataatattatgattaattttatataactgtctagttatcaagagctccattttatgtgtctaaattttcccccatgtttgatattatgttttttttatattatataattttatgtgatttagttttaatgtttaattnaataatngaaattgtttttgttttgagtgtatgttatntttatataantaggtatataaatatttgacactagtttaattaactaaaaaccaatggtctcancaaaccgtatgaccttcactctatatgtatatatttattttcttcccccgtctcgtctttctccgttcctncctctttcctccgcccacaatagtcaaatgccaccccnccctagttcgctcaagtatctcccaactaattcacacgcccaccaagncncagaatcccatcccncctcataactatacacattcaactatactcagatgtgtacacctgcatagctgtaacctaagnccacattcaactcntacttcaccaagtc

SEQ ID NO: 20324 - DNA, 1438 bp, Homo sapiens
  misc_feature (1)...(1438): n = A,T,C or G
gtctccccccggggtgttgcccccccccgcgcccgccttttccacaccacccccgcccccctgcccccttttgtggctggatgattttcgcgaaatggaaagccctccccagtcctggacattctgtggggatttctcgtcctgagaaaatcaaccaaggaatgcggcaggnagcaaggcaaccctcagtaggtatcgcagcaacgggcagcgtggtgcgcttggctgggactcgcccccatgtgccatcgcggcgccgcggcactgcgcgcctcggctgtaaccctggcgtcagtggtcgcgggggcttgggagggtagtttacctcgcgcggatcccccgccaccgccggcgtggcctccccgcccccccccgccgcgcggaccccgaggcgccggagaccccccccggcaccccccccccccccccgcccccccgcgcgcaccggcgacgggagaggggaacgccgccgccccgggggggcgcccgcgggtagtgcttgccaccagcagagtcggcccacaatcccgccaagatcccccccccgttctcatcgatccatcgtccccggttacgccgcccggttccctcctttccttatgttcaacccccccgcccgacacaccctccccttctcgcgccacccgcccctccccgcgccgtcgcggcaccccaccgcngcgcccccgcccgtcagacaacgccggccccgtccggagaggcgggcgtgtcgcaggcgcgcggcgccgtggctccagtaccacttgcggcgtggacgcacgtctggcggggcctgcccgcgccgcgcccggcggagagggcgagcaacagagtgaggctggctcgcgcgccgccgcggcgaccaacgcaccaacccagccccggccgccgccacccaaccgcgctccgcgggtccgcgacgcccatgngagcgccgcggtgntcctcgcccgccgccgccgcgcggcccccggccgcgcctcgcgccgcgccggggagcgccgtgngagtcacgagggccgccgcgctcttgcgcgggcgcccccgccggggtcgtcgagcgctcccgcgccgccgccgccgcggcgcccgcgtgcggcgcgccggccgagtccgttgccgcatgcccgcgccgcatggtacgngtgccgctcgctctccaggcggctgcccgccccgccgctcccgtcntgcgtcacggcggcggccgagacatgtcggacggctgcgacttaagatantcggcgagcgcgaccgccgccatctgagcnacgcgatantgtgcttggcgtcgtctcctcggcacacgccccgtctgcgcgtcgcgcgcccctgtgacgcgacgcggtggcccatctgcgcgcgacggacgntgatnaagttatgcgtggcctgtcgagatgttggtggagtgaggtggaggcggaccacggccgcc

SEQ ID NO: 20325 - DNA, 315 bp, Homo sapiens
  misc_feature (1)...(315): n = A,T,C or G
tttttgntaattagaggaatttttgtttaaaagatgttattgagatggatggaattattattaagaatattgtaagatacaaaaataggaaatgtgatgatattaagaaatggcaacctgccacacctcattcccgcggcttctcgtctagaaccaaaacaaaaggacaactatacaactacatgggtgggaaaaaataaataaaaaggcaaaagtaattataataataataattatattctcagtttacataatatgaaactatatgaattatattgtaaaatagaaacgcacaacataataaaaaaaaaaaaa

SEQ ID NO: 20326 - DNA, 1108 bp, Homo sapiens
  misc_feature (1)...(1108): n = A,T,C or G
gggtagggggaggtgnnngnnnnnnannnnnnnnnnnngtagaaanaaagttnaataaatatgatgggnngaggagannaggaaattagttntttttgttgttttatgatataataatctccttgcctcgcgnacacacttcctcgcctctcctcgctccgtccttccccccctatgncggagggtnaccaatattatctctctctttttattcagtaatttttattnaaaaggcgatgnccnccccacgccccctctgacncnttcccgggactaactgaggtatcctattttggatgatcncaccctttccttccgttacgccaggctcggggctctcccagcaaaaatttaagctttntctataaaccgaacnncccagacccttcccccgccacgcccaggtnnnattttaattccaatttgtctcggtgactctctaccggcgcgagctatctacccatcgctaatcccacagaacatggacnattgacttcgcaagagtccaaccacacaaccacacaccgctacctcgtccctctgtcagagttatagcggcgatgtgtnccctctatgcgctcgagccactgtaccctagcgtacgcctgcgtatcagcatggaagttagcgtncaattgtgttatagaggctcgcnaacagttagagggatgatcttggtccagcgcggcgcgtctggtctaacactattcttaaccatctatcacgttactacatattnaacgattagattataatcgtttttatcgtctntcgattacgggatggtcgtagtggctatcttccgattgctatattctattccccgcggcgccnttcactctcgctatcatgttcactaagctatcacttgctcgtctcgcctcttgtattcattcnttagtgtncgacacctacacgtgttgcgtcccgtcgagcgccacgacgctaacaccgggtgctncggtgcctaggatgagcgggtgtctccaatgtgggagcgcttccgtcgcacactgcaatcttcaactccaaacatnctatagtgcgcgnaccagtagcatgactggaagacatcggtctcctccgcatactgagattaaagaattag

SEQ ID NO: 20327 - DNA, 2234 bp, Homo sapiens
  misc_feature (1)...(2234): n = A,T,C or G
gttttggtattattatgttagtgttnatttgagagtggtgtgtganagtgatatggatactgatgctagagaagcaaaggcagcagagcagcgacgtcgcgcaagaggatacgaaanagagaagganatttagcggcgacacccgaacagtanagcggacggnataactcacacgctcgtcctctgagcgcgcgcgcggtagcgctcgcaagagcagatatattatctcngctctgtcattcgagatcgcagatgtcagacgtcgctagcgatncngcagcgcggcgcctagatatgtgtgcgcaccgctgacgtcgcaatagcaanaacacaactactacncactcctctaacgantacgaatccagttcatgatctgtcgcacagcgcttcngtgatgtagtcggactancgtcgtgtaggctgtgtgtgtgtattgttgtatgtgtgctgcgcgtctgttctatacttcgtccgggcgcatctccgctcactgtcgactccgccacnagtcgcncgcgcgcccgtntctatgttnacgagtactcatcgccgaaccgngcctcnacatcatcggcgagatacgcagtngcacgctgctgagcgnctcgctnctccgtgngcgtgtgtgtctncncaccgtgctacantgagaggttgcatgctctgaggtatcctaggtantgactcaaccactagtatgtgctcattgagtgagatgtagatacgtgcgcagactntgcaanatntatagatagacatgcacataantcgnatatgtggtacatatggagcgcacaatacactggctcgcatngtgcgcgacncntcacgcgcgcggcatantacaatgctagggcganatagtcgtcagcactcgtgttagacagtcnacantcacgcatgtgtggnacgactcancgtccgtcgtgcnagcntaagnatngtctcntgntgatgtnatggtgngctcgcaatnattgtgtgntgtgatgtagantntgtcgatatcngaccaagtagatgtagtaggacgatacntacttatanaccgcgcgcagcaggacgtacgcacgacntgagctccngttattanacgcntctacngtncgctagcccagcacccnncngnttnatccgtnacatcgatcagcgatctanacgntactcgtacntnacaatgagcntacacgatcatcagcgnagacgcgtcgtcntcatcatcctagcncnaatntgatacgatagttagatgacgctcnagnagcgccagccagtgntactacncgactactaacanaccatangtgtaagtangtcagcttgacgcacancgagtcagacgtcagtgacacaatagcngngcttgactacnanctgcgtcaaaagntagcacgtcgncgtagagagtacgagacgagatgtncgtgnnaagcggntctgatgatcgtcgacancnctngtcgactgcgacgacgactgaatgataggtagggnngnntacgtagatnatcncatacatntgtcatctatgtaaggtantcgtcgtacgatagatgagtatgngtgntgacactggacccaganctacgccnntacggtcgatcatactacgcgcantanctgcttgngancnacacnatcattngtagttggcantcantgtgcgacagcgacatcgtntagctggatgcnntgatncancnatcgtgnncgcaataacangacatnacgtgtcgcagggtagcagctcttgatgtggtancatctggncagtcgcnagcacatcactagtgctactcatttgcgctgtgggntgncnactngtngctgcaagctctcgtacgcacgtagtgacanatgacacagcagcagctacgcacngtgcgtgtattggtgtagtgactacacncatcgcntgacnacngccancncatagggctgnggtcgcgtgatgcncgacatnanatcantgatgtgntncgntccctggnacgacnagtgcngntcnagcattgcagacnagatgtntgggagtnntagntngtatcantcagtacatntgcggtagntgggatgnntgggtnactgtgatgggatcatntcanggannacngcgacganctacgacnactgattggnacnatcnggtcagcngcngtacntngtaccngtgntacagacgcgtagnccgctgatnttagactgaggtcgacgatctggtnatcantncg

SEQ ID NO: 20328 - DNA, 1499 bp, Homo sapiens
  misc_feature (1)...(1499): n = A,T,C or G
ggacagcagatgagagcagacgagnnatcgatcagattacttgcctgaacatcgatcaccaccacgtcgggctagaggaggtatgagacgccgagcgagtatcgnacagacaccagaccgttttaagaanagcagaagaaacaacgaagaacaaaacagaagaccggtttagacacacagactagaactcacaacanagaaaananaggacacacactcagcacaacatagcaacaacatagaaagatatcgagctgtcacagcaaagcacacacaagtaccacacganataaactggaacaccatacataaccaccaagcgctcacccctatcacgcagcacagtcgcacgccgcacgaccccagccacagctgctcnattatgcccacatagantagcgcanccatacgcccttgtatacaatagaacacgcacgacaaccctcaccaccgctgccacaatcagcacacacatgagcactcgttatgacgacccacgaccacactcggatactgccctagatgagatgataagacgcgagttactgcagattgcagcacccaaacaccgccaccaacatcgcgcaccgctagcgtacaccgaggcgccgacacgcganatgcagcgcnggagagtgccacacctcccggccggacaccgacacccacgcagacacagaccagccccacctactaaaccacaaacacagaccgagaagtacccacattcacgcactcgcacataccacccacacaaggaaaccacaatcaggacaagccgccgacccgcctcagatagatttaagcggccgagcaagcatccgaacagaagtcacgagagcccgcagacgcccngaagcatcgccgagaggtgccctaccacaggaaatcaccacatgccacgcgcaaccacacaccgcactcgagcggagcgacaggccgcgacgccacccgagcaggccgggtgccacgcggaagtgatcacagtcntcaggacaagcacgatcagccggtgaagtacccgtacaacccccgctcctcagccccgccatcgtcatcgganagtataaggcgctagcactagctgtgagaccaactangtgcctggcgtacatcaccacacgctcaccgataggcaccacgagcacgtantctgcgcccgcagacccccngtggagtcgtagatagcacactgcatcantagtcgcggccacacgcgcggtgcgtgcagcacagtgatgagcctcacaaagacggatgagaggcggtgccaacgcgacacgtgganacagtaggtctgcactacacggagattngcggcgtcgtgatgcantaggacaaaggccgtcgtcgcgcgcgaantgtcgtgccgcgcacagacgcgagcgcgnagactaacacaacaccatccgcggaagacgcagngaagtngagagatcgcacaccagcaaccgcgccacgtgtaatgcagtttatagtatgactactcacgcaacgcg

SEQ ID NO: 20329 - DNA, 2044 bp, Homo sapiens
  misc_feature (1)...(2044): n = A,T,C or G
acaggtaattatccacatccntaatantatnattncgtctctcatgcatgtntctnnggtagtcgatctgacgatagttctaantacngcgcgnaagtagtatacgacgagatancggcttagnntatnctgngcgnactgaaagaccccagngatcagncgcgcgcagacgaaaacancagtatacttttcagcacgcangcgcagacgagnagcaggaaacgcacnnngttagcgggagcagtagtatanatngtnatcgcactgtcagtcagcagnttacgtggagataatcgactagtctacagtcccgactagcangcgatcagatgatgctaattacatctgacgtacatatnctgcatccccnngcgacgcctgcgcagcctctcgcncncatctctgctntgtcactgtagtgatagccgctcngtntactgatgattctgnagtacccggccnnnacgacgcnagtgtgtatagtagtatcgcgctcgtcgacagcgagcgcctgcacagacagcacgtccgcgctaatatccgcgatatntgctatactacacacgcgccgcgtnatacttataacgcgcgcgacatgttatttgttagtatctactaccctgtcttaagatcgagcgcggtgctgcgtagtagcangatcgagtacgacatatgcatctagacaacagcantgtgtaggtntgtgtgtgtagcatgaanangacagactaatacatgtaggatgtagacaggcgcgcagcantagangngtgtggnacgatntntnngggangnagcttgagcatcggcgagagtgtnagcgctctcacgatatatcattcactgctgctgcgcnatgtctggtacgcgctctgcagcgctgnacatgtacagatcgacgcgtcgcgtctgcatatantcctatagtcanatagtaganncacgtcgtcgcagatactacagcgtgcattaggatcgaancngcacactgacgcgagatgtatgcagtgcgtgtctgtcttgtattatntatntgactccnancgcgactatatacggtgtgtgctccacgcgcagactgatgagtagatgatagctcgtgtgatncactanacgacntatntagctctgaccgcgnacctgagcgcanatgtcacaaattatcacgacagatagatgtctcacnctctggcatgtgtgatatcgtngcgaccgctccatcactcgctcgctcgnctgtatgtagcgcgcatcactatgtcgtgcgatgtaggcgtgagcntgctattgacatggtcacatacnatntactgccgtgactcncacccanacgtagcgaacgccatgtcngangtcgcgatacgccgcgtgatctgnactactacatcggcgtgcgagtntgacgtaagtcgtcgcgagcgatagcnagtaacgacaccatntgattaccacgcgatatgcgnaggatctcgcgtgtagagtgcatagtgncatcantgtgctcacccgcacacgacgcgctcacgacgtatgcgagtatgtagtggctctcacgatcgtgatgagcacccgcacgcaacgcgccgattagtacacatgtatcgatcgaggtacgcgactgacgatgctcgtatatgtatagatggacgacacgacgcgagagaagcgtgtctctattgtcacgacntangctggggatgataggcgcgagcgcaggcgcgatgtagtgcgaacgtgacgtgtnagtcgatgctctantgcggtgcacgcgtgagagactcggcgtgtcntctgcnatgagtacgaacgctcggnctccgcatcgcagcggacaggaggatattgcgtgagagtcacacgtagcaagcgtgtattgntagcggtgtgtngaggcgcgaatccagctcatacatgatgcgctatggntgttgcacgccgcgacacactctgcctcctatgttgtatgaacagtacgcgagtgtatgtgtatgccaggcactcgatcgctagcgctcanatatatnatgtagancatcgagcaacg

SEQ ID NO: 20330 - DNA, 1839 bp, Homo sapiens
  misc_feature (1)...(1839): n = A,T,C or G
agcgccagcgcctgccgatctacgacagtttgcgagcggagagagatgcgacaaaacaaaaaggaggagttgatgtttgtctaatgcatcaacgagagcaaaaggaatgttttctatcatggtgggctttggtgtatacattgtgtggtgacaatggtgagagcagtttataatacaaaactattcaccgtgattctattactgagccgactgtcgagtggaagatggaggcgtatagtaggtactnataccatcataagatgacatatcgaagtacntgntntcatactactgccgaacaatgtccagcacacccacctctgttctgaagttatacaataantaatcagcacaatacgaagagacacgatgttcacgctttcgtatataatattattataactcacgcaccaccaccccttgtaatgtgatatntcactccttatatgaatcgaatctgtggtctcagcaacatgantcataaatttacactaagtgttacgtgtctctttccgaccacgacgacggggtcgagagtgcgtactntaagattgactagcgagtacnatgagtacgtatcaacatatgtgcgcacttacttcacactgattatactacatacgatgcattatgcacacgttcagctactgtcgtctgatagtgcacgacacgtatgtatatctcgcgcgaataacaccgatgtgtcatcgtacttatattgactatcacatatactgtatgtataatcatgatcgttatgcctgagctcagtctatngtgctgtcttcgacgatagtataattcacgcagtctaagagaagcagccagcagtataagttcangagtgacccggtgattcgccgatccgtagaaggcatatcgtacgaactgtatcacgaatcactactagacgagaccatactcacagtttagatacgccaccntaaatctgcgagtaactgaatatatataataatgtagcacgtcagctatcatgtcttcttgcagccagcgtacttattgatatgaatcgtatagctcgtcctgatctggacgatctcatacgcattacgacataagatacagcattgagcagcagttggagtctgattgaatgattgcgcatctgcgacnccgccgcacantagcgtaccgtatanatatatatatttcntacacatgcatatctgtagcgatctacgtcngcagagcggatcntatanntgactgtantcattctgtgngcagatgctcataagtatgtatgcgtactgtattatancngtnanntcactggtcnagagatgcngctgagcgctggtgatagangtanctcctaggtgtgcagtacactntntacttcgaagggagtcacatcgatcgtagtatatgtataatcagtagacagtgtgtgttgntgntgngattgatatacagtngtctgangcactacatngnaatanagctcagtgtctactcacgagttatntgatcatacacctaccacagtngcagcatcatgacgtcatatacatatgctgatntatgtgatgtgcgatagacanacagcatcngngctgtgcgctgaggncatangctgtcncatcgctgcnactangggtntnactagcatnatntnagtgtattcctaggtctcacagtatgtgcagcactagaactgncatgatgtacggtggcatcatactatacttcatgngcgtagagagaacgcactacncgtgagnatnanntgctgcgtantgacatatcaantgtncaganatgcngtactcgancgtgcggnaagggcagcgtactctcgagcgatgancagcgang

SEQ ID NO: 20331 - DNA, 1008 bp, Homo sapiens
caagggaggtgtgaatccaggaaaagagagagagctcgacgcaactttaacagcttataggttattcctgcccgaagtcagaactttgacatcttgcaaagtgccatcagtaagcatggggggggggttgactgtaattcctgacagcacggaatggctcgtgttttctggtgtaatctagtaaagctcctggatcatactatgggtacgggagtgagactctactcaccatctcctgcgtccctcggtgctacaacggcttctttatttccttgctcactatatgagaggggggaagcagaacatcctatagaaagagggacaaacttaaggggcagctggaggccacatagtggctgcagttgcctcaaaaccctcacgaccatgataccgaccccgtgcgtcgatcagaagcggcgaatcaacgaggctgactagcacgagcacatctgattcgcgctgctaagtccagatgacaatgcgttgtactccatacgttgaccacccgccagctcgatgccgagataaataatacagagccacacgactccgacaacccacagacgatagaaccatatcgcgtgcagacgcgcatgccagcgtgcggccagtaagaacacgagagaacacgcacagacccggccgagggcgcgccccggacaacccgagccactgactgcagatatctcacaccgacacacccgtcagccgccctgagcgccagcatcgacgcaagatcatcgcaggcatggtctgggccaggcatctcacacgtcctaccccctcgcgtcgcccacaagcaaatcaccgaagatactagccagcgggggcggcagccctcgacaggacctcgcttacggacgaagtgagaaaccaggctcgacgaagcgcgtatgaatgagatcatacattgcgggacgacctagcgtacggccaccgagactcacgcgattgccagagactgcacatgaatcaacggacaactgtggctctaagagtagcagctag

SEQ ID NO: 20332 - DNA, 510 bp, Homo sapiens
ctatatacttctacactgccttctatatccgtcctgatcttccctgacccggccgactcttcctggtcgtctccccccattacgtacaccactccagccttccgcactcctcatatatttgttttattgtcggatcttaatatgtctgtgcataccttctagtcaattcagtattatatcgtctaccgacatctcctcttattctcacatcgtatgtatcactctagtactcgttacgagccacgctggttcatcataatttcgtaccgcacatgtcatacgcgcgacattaccaggctgaccttcagtatacgcgacacaagtcgatagtgaactttcacagtgattgttccttgtctttctacgtaatgctgtgtataaaacgcgacggcctcgcccccttatgttatcttattacacttacactctcccttcacttttctaacactaacacctcaaaatcccctcctgaccttgtctttgtgcgacgacaagccagcttatgccgtg

SEQ ID NO: 20333 - DNA, 1261 bp, Homo sapiens
  misc_feature (1)...(1261): n = A,T,C or G
taattagtctatactatctcatacatgtatccaagcatgaagcagactgccctcaagagtgaaaccataatactcctagcaaggtagcaagcaaactcagcacagcttgagcacgctgccaggtacctaagcatgtaagttgatgctcgagcacggcagatccgtgatctatcaatgaatagccttactacgtcgattagcncgtggtcgcaagtagctggtagtagcactctaagtatccacgctacattcgagtatggatcgagagtaaagtacggtatgtgcgtccgcagttccacagtaaagttgttcagctttgcacttcgagtaaggagatcctatactcactcgcctcctccaatctctgtggttggcgtcacccgtagacccgttgtctataataaacatacatcataatagcaaaaatacctgtcatttatactttcaacgtactgctctatttagcaggccgtcacaatgtgttacagtctcagtcccagatggcctactctatatctcaacctcctcacaatctcataccatacgcgctctttatttatcgctatcgctatactctggcacttgagcccatttggtataagagcctttcttgttagtcatctatgaatgagcaacacattttgaagggtagtctagccctttttaccgcagcgatattcatatgtactcatatccctctgctccaactacacgtcgttgttcctgcgtccgcgcatatcactaagactgcgtgtcnagtgtcggacgcacacttgcgactcaccatacagtcacctttactcactcattattcaccactacactgccaccgtcgttatcagcnatatacaaagatatgtgtctctccatcggaggcgcgttattacatatatagcactctctccgattaccggcggcgcagcatctgatacgtccatcatntcatcacctgacactgcccgtcctcaaagcatgccataacagcctgagtcgacgcttgatatgccatacgtgacaaagtatgtgcgcggcctctgtgcattatcataggattatcggtgtcatttatcgctactacccttatcttatctgcgcttgacgnagtatataccgttgcgcgtctccgatttatatgtagcgtgtttcttgcgtccagcaattggatcgagcttcacggagtaccaacagcaacgcgcgctatcgtgcgcgtcaataagcaatagcacgattagttgcgactncgtacatggtagtatcggat

SEQ ID NO: 20334 - DNA, 1004 bp, Homo sapiens
  misc_feature (1)...(1004): n = A,T,C or G
ccccccaacactttcgaacgatccctccgcacaaacaaaccanaaaaaaaacttcagtccacaaccttactgtttaactccacaaacctggatgatgatctcagtctggggagaggctatcaaaccatatccgagggggtgcagagacaaaaacacatcactgaaccaattaaatactctgaaaaaatttctcaacattgcaagaaataattttcaaagcctaccatttggtccacaccatcctaccacatgcttncggcgacattttacaatagaaaacccgatcactactttcaaacactggggggggtggctcttcacccacatctatttctacacaaacaaaaaatacgctaatacacccatctccctctccatatgatcgatcacaacaattttccactcatcgcacatacccaaacaccatcatccaacatcatttctctacccttgcatacacctataccttaaatctcacatcatccttaacccacccctcaacctacctcgatcccccattgctaactgaaccgcattattccaaccctctgaactctaatcacaacacactctaacattccatacatgtccccacaacccccaacgtcttaccctcagtatctcaaccacccctccttcaccaacttcatccagcccccccccccgttctcacacaccatatatacattcctcccgccttctctcctcccaccccgtccatccccaaacgtccaactcaccccacctcatctttacacattttagccatcctccaccccccaaccctcttcttcctcccgccttcttccccattttatctcccattttcttccccctaatttattccacttctatccccatcctatatctcctctcactgcttctcctcaccaccctcacataatcttacccctattccccacctctacttcttatctctcctatttcccgcatcctctttgcacttctcactttatcttacacttcgctcctcactccacatt

SEQ ID NO: 20335 - DNA, 1373 bp, Homo sapiens
  misc_feature (1)...(1373): n = A,T,C or G
cacaccggtggcgccagtgcaacacgaggtgacgcgcgtatatccgagcatgnacgtagtgcgcgcgtgacaccagccacanctacactacgcgtgcctactaccagacgtagcatatggatatgtcgcggatacaatgattagtgacacaagagagcaaggacgtnggacacgaaatataccgtgatatctaagagttaacctaaaggtcagtcggtctaagatcgagtagctgtgtagcacanggcgcatcgtgctanaagttacgatctacacacggcaacactcaggcgattgagtacatgntgagtacacgcactacgaggtgacncatacatctacaaactaacatcgtcgacgcgtagcgcatcacagacaacgttgcaccatgcaacgaggaagtacaacgaggagatgtagtancacgcgncgtacaactcatngngcatgtgtagcgacctggtggacacagacaacatatatatgacgatcatgtcatctaatataatatgtcgcgtttgagatagcagagacgtgcgataatactaaataacatgtgactgtgtaccaaccgatactgttaccgtactggatgtgtacttacacgccgccatcgaagcatacatgtaacttattacagtatatgcagtctcatgtgtgaatcagtcaccgtgtcacatctaccttgtgtgttgatggggactctgtacgactacgtttcaggttatctcaatacatcaatatgagatatgggtgatgtgtcgtgcacgtatatactatgcgataactatgcagtcctatatgatagtataaatcgctctgagtactaattcatctacatctgttgttaacttcacgtaataaccagacagactattggaacctttacataccgcgcatatggcagcaccgacgactcggttatcatgtagagacgcaactcacataatgcgacacacagtcggcntcgcggagaggagacgatagcatatctaatagnaaaagtatgagtaagagcacgtcttatatcgtttgtatactctttgcgacaatgacaacaatgagacggtcgatagtgtgcgaaanaaatcgaacaaaggtgtccttgatgatctcatttctgctgtccgcctattctaccgttatcaccaccacgtcatcaatcgagtgcactgaacacggttcgtagcagacaagaattgtcttagatgatggtgtggccacatgatgttgaatacttggttacgtatattattgtgcgtgtactgttcacgaattcgcaagaacaattatataagaacgtacaccacataaatacaatagcatagcgacacacagactctatcgagcgatatatctcaaatcctatccgt

SEQ ID NO: 20336 - DNA, 457 bp, Homo sapiens
ccccttccccccctttatcccgttccgcaccccgccccaatcacttcaggcaaacgcgcaaaccaccctcgcatagcacaaagactaaaacctcttagccccttaagcaatgtttgtattcttgggaacatgtgggacaactgcgcaagtggtgcccttggagctcgctttaaaagtcagatcttttgaaaaatgtttattcatgccctttgcccactttttgatgggatccttttcttactgattcgtttgacgcccttgtagattctggatattactcctttgccagatgcatagcttgcaaacatacttgggtgacgggtgcactaaatctcagaattcaccactatagaattcatccgtgtaaccaaaaaccacttgtacctcaaaagctactggaataaaataaaataaacgacaaaaaaaaaaaaccatggcctccttggcctcacgcgcc

SEQ ID NO: 20337 - DNA, 918 bp, Homo sapiens
ctcctatctccccatatatatcccgttacgcccttcccccgccctttcttccctctacgaacacacgctaccgtcgactttacctgggatgaaaaaaagaagcaccacctaaaccagactggatggaacacttcctgccctctctcgtcaccttcctactggagcttgccgttctactacgcggactgtggcctaactattttaatactgttgccttggcaccattcctgcgatattaaagattcggactgtgtcccatttaccatacttctatatctctttatctagcaattcataacataaaacatcctgtcaccatccccttattcttaaatttccttctccttcatcacggctgactgcatctgctccatctctccaaatactaatcctcctttctatcaaccatcatatttaaccccgcatccccttcacttatcttttactcccaatcgcttatcatactcatccccctctatattattcttccccccccattataccatgcccatccccatcacttaatctctctacaccctcacactcattaccactcctttcacactccacatacctaacctcaatcttccattcccatcatcttcctcctttcctcatcttcctccgtctacccctaccccaaatatctcaatcaccccatactattgaccacttcactcgacgatacttccccgattttacctgaactcattattcactccaaaaatatacattcatctctcatctcgaaacccaacatcaagcacaattaacaaaccgacctacacctcaccctgccctccccccgttaccccaccccatcacacaacgaaaaaataaatgacatccatctccacatcaatcctacttcaccacccaccaatccctcctccccgcaccaccgcgtccctcaatcct

SEQ ID NO: 20338 - DNA, 678 bp, Homo sapiens
  misc_feature (1)...(678): n = A,T,C or G
cgtgcgtgctctgtgtggtctttnacgccctttgttctcggggggtaccttgttgcaggctggcggcgagggcagctgttcgggtgcgcgcgggacttgggtgagtcgctctggtgtggcgtgtgtggttggcgtctgcgttgggttgctgttgatcgttggtcgcggtacggttgcgccgctcgttttatttcgttgtggtgggctggatgctgttttgtgttgttccggcggttctgggggcggttgtatgggtgtgcgttcgggtgcccttcttcttctacgtggtttgtttttctttttgttggggtgctatgggtgtgtgttttgtggggtagggtgctctcttgttcttgtggtctcgcgacggggattgttactcggtatcgggccgtcgttgtggtgttgggggggccgcctcgtgctcccggggggggggcgggcttctcgtcctgtggtggttttcctgttgggggggggggtttttgtggggcccgggggggcccttggttttttttgggggggttttccccggtggcgttggtagggtttcccccccccctctttgggttctgttggggggtggtgttttttttttgggggggggtgtgtttttttttttttttttttttgtggttttgggtgttagtgaaattaaaaaaaagaaaaagggggagg

SEQ ID NO: 20339 - DNA, 1204 bp, Homo sapiens
  misc_feature (1)...(1204): n = A,T,C or G
acagcgacatacacgacgaaagcacaaagaggaacaaaggagaagcttaaaggagggaaaccaaaaagaagcgaccttccacgcgccaccaaccaacaggcccnacagcgcacaaggcacaccacaggcacagcttttcggcgccgcgcggacggaacaccgacgacgaacacggagccccgcgagcgcgagaggcacgaaccggggaaagccgtgaaaacccgccagcggcgtgagggcccactaaccaagcacgccgacacaacacgaccggcaccaacgccgagccgggagccccacgcaccgccgcacagccactccgcgacaacgacaacaactatcccccggccggggcaccgggccgacaacgcggtcacgacagacaggacccacaaagcacgtaccacaaccagcacagcgcaacgacgatgacgcagggggaggccgcgcccagcaacggacagaagagagcacaaagaggggccccacaccgtaaagccacgacaacccctccacctgccccagcgcggacagaacacgcgcgcaccccgctcgcacgcacgagggcgacgtcgggctcgcgaagggacacgcggacagccgcggctcgcgaagcacgccgaacacgaaaggcacggaaacggcgcagaagaagcgtcaacagagcagcgaaacggacagatgacaaaccgcggcgacaaccgacagggacaggcgcgagaggcgcagacacccacggcgcnccagcgcagaccagcccggagacgacacgagcaccagcccagacagcatagcggcgcaaccgagggccagtcaaaacatgagagacgcagcccctctcacgacaacggcgaggctagcgccacccaatcacagcaccacgcacgcccagaacaccgaggccagagagccacacggcgaacagcaaccaacaggacacccgggcgcataaaccccacaacgccgggctagacgaagcaagccacacggccagcgcgagcctccacccgaagcgcacgcgcgcgcaggagcagaggacaccgaagggaccacgcangacgaccacgtgcgacgacgacgcctccaacacaagacgcagaacaagcagcgagcgcgctcgacgacagagatagagacgcaccaccncacacacgacgcgcatgcaacgccgcacgagcggagcacacgcgggacaacgacaccg

SEQ ID NO: 20340 - DNA, 1554 bp, Homo sapiens
  misc_feature (1)...(1554): n = A,T,C or G
gagagagtaacggcggggnccacaagagccggggcgacanaaagaaanaccgtcnagcgagaaaccaagaaaagagnaaaagaagcgttaacgaaggaaccgcacaacaacgacagcggagaaccgagacgcacacaacaacgcaggcacccgcgcggnccgctcttccggaccacgcgagcggcagcgcacacctccganacgacaccaccacacaganccagcgagcagaggaacccacgccgagcagcaccaccgcgaccccagccaccgcgcgacacccgcagaccaccgcacggaccacaacgggaagcggagccaccagaggacgcaccacagacgagccgacccaagccgaggcacccacctgcgacagcacacacgccccagcgctgaaacacacgaacacggaagagaggangccncagagcacgtactttcgtgtatagccacgcgaccgccgcacgcccacggccaacagacgcccgtggtccccacacgacacgcacacggcgcgagccgccgcggggtcgcgaagcggcagaaggagaggagcaagagagcggnagtgaggacgcacagcggggaagaggaccacgccaacagacgaggaccaaaccgcgcaataggcaccnntcacaccagcgagacagcacacaacggacacaagcagcgaacgcgcgcgacgacgtcagagagcatgccgacgaagccgaacgacccacgccgcggacgcgcggcaccgagcgcaacacgcacacaccgagtcnacgcgcagatccgcattcgacgaagcgaccaccactacacacaccatagtacgcgagagagcagcgncacgagacatccgctcgcaccagcacacagcagcgcgtcaccgcacgcgcacacgcgcgagcgcgaaccaaacactagaggaccacgacacagacaccgacacggtatcgacgggagacaccaacacgagcacccacaccaagacctacncntccacagacaacgcnccgcgaggcagcgcncgccgcgagcgaagcaacgcgtaacgcgacgactcgagaacgcgccncccaccagcgagagccacgcagcagcgacgaagcgggcgaccgcgctanacgacacaacggcgggcacacncnctacaacactccgacagcgcacacacaccgacacgccgcagcggagagcgngtcgcaccgcggggcaggagagagatagcgagaggactccnanacacacgaaggaagacccangagagagtaagaggacgccgagacggagnacgcgaagaggcgagangggcgacgacgataccgcgagaagcgagcgtacacgacgcgacggacgacgagacaccatgcagaaccccacggacacgcgcgtacagcagnccngaacacgaacggcgagacacagacgcgagacaagccgcggagcagggaacagacagctacgcactctgagggagagattcgcgcgaccggcgcagacgaagcaacggacagaggcgaccaagcatacccgagagcccgaaagaggaaacacagagcatcg

SEQ ID NO: 20341 - DNA, 960 bp, Homo sapiens
  misc_feature (1)...(960): n = A,T,C or G
gcactccccccccacggttgacggaaagagggaaggcgttgagcagcaactttntncaggcgccgnatcctatgaaaacctataacatcatattgagggggattgacatgatataatctccagggaggagggccaaaaatgctgctaatttaattaaaaaactatgcagggacaatccatcagaaagattagggaattcgaaaaatggagtaaaagacattcaaaagcacatatggtttgagggctttaactgggaaggcttaaaaaaatgttccttggacaggggggataataccaaggtggggcatgacccacacacacaagtcacctccacagttcccctggcgacaagcatgaagcaccctctgtggacgacccaggatgggatctccactgctgacggcatcccacttaggtacctttgccttcaggcggacaggggcctggcgccccccgtctcccggcgctcggtcaggccaccggagaatgtcggtggtggcgggggccgtgatgcgttaagcggcccgcggccgagcgcccgcgggacggcctgccgagcacgagcacgacgggcgccgcgctcacactgcgcaggacacggaccccaagggcacccgggcgcccctagaggaccagcggactaaggaccgccggaggccagggtgccgcacacacccatagcagtagcgggccgcacgcaggctccgggcggacaacgacactctcaccccctgggtctgtctggtccagcctccacctgcgggtaagacagccgaaggggcggacggctcgctccgccgcggccccgccccgcgcgccccggcacgcgccgtgcagcacccccagcacaccgcccgcgggcccaacgcggctgccccgtccacctgcgggtccccagaggcccgttccgggacctcgcctctcggccgcgaccacgcgcgcaccctgacacctcacgcg

SEQ ID NO: 20342 - DNA, 763 bp, Homo sapiens
attatttctttagtttgggggcacgcggcgtgccggcctggaggcgaggtgaaaccgctggaagcagcccgaggcaccgcgggcagcgagtcaaggagcggggagcatgcagttacccctcaccaagggaagccggccgcagagctcccccgctgaggccaacaagcccggagatgtggtggttttcacagttccattttaaacgggaaagtgtcatttcaaaaagcaggacggaagtttgcacccaggcgaattaaaatctgggctaaggcacggcagtcgatgacaattctgcaagccaatcagacagtcggggacattgcaaggagtaaaaaagagcataagactgtatgtgtaagaacacaatgttaaaaggcctaccacaataataaaaaaccgtcaattacatcatcacattaaaataagccagatgtacaaaagtctgagacagagaagacaaaaggacaacacaagatatttgttgaaaaatgtttgtgctctgcgggcacttaattaaacattgcaaaatcagcatcatcttatgagcatcagcctctgcgaaatattttacttctttcctagcccgaccggttcgggcagagaaggtggctcagtagggaagtctgaggggaagatgtccacatctgaatcctgatcaaaagatgtcttcttcggttcagcggattgtctggatgtaaaagccagggtatatcgccttcacttcagagccgtagcccccaagcgtgcccccgagttccaccag

SEQ ID NO: 20343 - DNA, 1018 bp, Homo sapiens
  misc_feature (1)...(1018): n = A,T,C or G
ctagaatcacggatgctgccaattctgagcagtttctgcaagaaaggatcaaagtgaacggaaaagctgggaaccttggtggaggggtggtgaccatacagaggagcaacaccatgatctccctgacctcccaggtgcctttctgccaagggtctttcgactctctcaccccccgctctcctaacacgaaccgtcttccccgactgtttgtctctctactcctaccatgcgctcatacggccgagtgggcgccccatccgagcgtgctccctctcccacccattacgcgtgcgccttatgtttctgttatacttctctgggcactgccgcgtctgcgactctagtctttacccgtgcgctgctcccccgcaccctcaccttgctattatcacgtctcctttggcgtttcgcgccccatttccccatgtctcctctctatcctaccttccttgtcgccccggatgctctcccacgcatcctcagccgcggcggctcctcccccgcgccagccccctcctgcctcctaccctttacgctcctgattgagccccaccatgagcgcctttgttgcctgtgtcttacaaatctgaccacctccgttctccgccgcctccgcctcctgattggtcgttcatcgtaccacccctctcccgcgtgcctggccctcggtggtgctgttaccttacctcgtcctcgccgtcccncttccgcgccccgcgcgtgccctctgggggcatcgagccatgtggtggctcttcatatcccatagctcgcgctggtctcgtttgtgtccgcagcatctcctgtatggcgggtngttgtattaggccacgtctatgcgagcgcggcttctagctcggncagagtctgccgacagcgcgagtgtcttctgatcaccacctgaatgtctcgcatatactggcatctcctntgcntcacctccaccacgacacctgttcgctccagtcatgtctctcgtcgntgactcattcgccggcctccggtatggagaannacc

SEQ ID NO: 20344 - DNA, 1233 bp, Homo sapiens
  misc_feature (1)...(1233): n = A,T,C or G
tttgattttttttttttttggttattattatttatttattcgggtacacccagagctcctgctataagatcgttcagggaacacccgacagctattgctatcctcctcactcagttagctcacccaccgaggacgttcatgccacagctagccgaccatgattacatggagctttatgactctaagctagagtcatgattgtaaggtttattatgtacgctaacaagttcccatgcgaatcagtgcactggatcataggtatgcactagcaggcagtgctagtgcgtcttaatctagtagccatgcactttgataaagttatagtgttatgtctatgttattgccatgctatggcttgatangtaacatgtgtgaactatgtgcgcgcatcatattattccctaaataaaagtgttcgtttgatgttatatcgagttctagttgatcgcagtactcttatctaatgccactcactactcgacctggtcgtattttacttaggtggcatgttcatttatacgagtgattgcncgttggtntctatgcccagtgtcacattgtcacgttattacagtgaatgtagtctacatttatcgcgattatcgtcaccaatagtttagtatctatgtattctagaatactctcgttgtcatcgaataatttcgatatggatcgatagcgtgaagctccctccgcttgaagctgatagctatatgacactccggtccgcgctcatgagtggatcgtcgtgtttagctatattcgcgtgtgatataatttcagggcatttgctctattctttatgtcactcgctacatatattccattcatgtcatccctttgtatctattactaggtgatgatgttgtcgccgtaagtgtctatgggtagagagctaattgcttgctcttattttgcgttctattaggcgtctcgcttacctaggtgtgttgtntagctgtgtgacacaactattcgtacatggattcagtttccatttatgtgcgactcatcgtcatacgttgtgtatatttcagtatctacgtttgtctttgtgttctcctcccgtgcgcgaactatctgcgtatcgtggttaatcatgatgcgtatgttgtaggaacgtacgaagtgatatctagaagatgttgtatatccatgttgtagattatatattgtctgttctatcgaatcattatgtaaagtgtgatatgatactatatatatcacgataat

SEQ ID NO: 20345 - DNA, 887 bp, Homo sapiens
  misc_feature (1)...(887): n = A,T,C or G
acgccatacaagaaaacacccatccaacctagataccatacaaaanaacaccctggagggcactcaagaaaagagccttccgcgttctagaccatgatgacaggcatgaccacgcgtggaactgtcagnccatcaaatctcccgaccttgagaaataacctagactggggtacatcattatcagcagggcgaaaacagaatagtacagttggaaggacgaactgcacaagcatctgaagcaacaacatgacctgtccaaaaggaatatatgcccctaaaaactttatacaaaagctccagaacataaacacctttatttacgaaaatgaaattagacccgaatgccactatcccaacttaataaactatgctcttggaggacaccccgaaaaacctgaaaaacttcaagacgagacaacacctcacaaagagcaaaggaggacacaccctatcggcatcacaatccgcggaaacctaccaaccgcacggatacatcgcaagccgtggacacgccacagcactcccaatacgctcgggggagccaaccccgatgcttgccgccactaatataccgccgcccggaaacaaagaacgtcacggccgaggccatgaaaccgagcctacaagcgcccccccgcagcgcgtccacacaaccgacccaccatccctctcgtccccctcaaattcgcgacccatcgccgccacaatacaccccgaaagccccgcgccacgacggccgcagcctacgaacataaaatagaagaaaacaggaccgcacgagggggaggatccacgagagacctactcccgcgcccgcaaggctcaacaccccacccccccccccatataccccacggatcacgaccccgtaccaacaccgcacaaat

SEQ ID NO: 20346 - DNA, 1048 bp, Homo sapiens
  misc_feature (1)...(1048): n = A,T,C or G
ttgcgcggggggtgtcctcccgtcgcccgcgcgcctcgcttgtgtcgtttgctgtcgcgtgcccgccgcctctcgtggcggtctgctcgcgggggcgtgtgcgcctgttttgccggctctgctgcggcgctgttgtgttcttgggtgtgttgtctgcgttgtgctgtgtggtgtcccgcggctggtgctttggctctgggcgtgctccttcggttggtgtggtcctcgccgcttccttgttttgggtggcggcgttccccttggctcccngttcccgccggccgggtttgcgcgtttgtccctgctgtcttgcgtgcgtgtngtcgcttgccggtgttgggtcgcggccgcggtggtgcttgtgtgttgtccgtgggtcgtcggggggctctcgctgcctgctgtttgccctttgcgcgcgttctgcgcggtcgttgccccggtgtctgggtcgctggtttcgtgggttgttctggtccggtggtgtttctccgtggtgtctctggttggctctttggtgcgntcccgtctcgtcctgtgggtggggggtgtgttcgctgggtggcgcgtgggtctgcggtgctccgcttgtgctttcgcgcgggtgcttctttctcgtgcgtggttgtgggttggtttcccggttctggtctgtggggcgggggcgcgtcctttgtctccccgttttcggtaagaaaaatttttttgtggggcggcgttccgggccgcgctctcgtgcgggtgttgcgtggctcggtttctttgccggttctgcttggctgcttggcggngtctgtgcttttcggtgggtggttgtgtggtgtggtggttgtgggttgtggggggggggggggggggggtgnngcgggggtttttgggggcccgnggnnaaagngnnnnnnnnnnnnnnngnnnnnnnnnnnnnngggggnnnnnggttcntccccctgcgcncagcnnnngngtgggngggttnnaccgancccaagnnttttttccttttgtgtggggctcggtggtcgttccctgctttggtcgcgttttccgc

SEQ ID NO: 20347 - DNA, 772 bp, Homo sapiens
agttccctcaagactggacagtctatagctatgacagtgggaatttttgctccaagttcttctgtgatatccttgcctcatacttgccagaagctacatacaaaaaagaataaagtttaaaagggagttccctttcctcactctacaaatcaaatccattgccaaggactgttgcaagctgcagtgtggtaaactgcctttgaaagagacccacatgtcaagaaactgagcatcacctgtgaccaacagccagaaagtaactgaagccccaagtcgaacagcttgtgcaaaactaaattctgcctacaacaagagcatgaattgagacgcagatccttccctagttgatccttgaaatgcttgcagctctatggacaccttgattgcagccttgtgagaaattctgaactagaggacctcgtatgccttacccataggtcttacaagataatacgtgttcttcaaaaaagtcagccgcggggataattccttatgcagcactagataatgaataataaagcccatacagttccttgctcgtgacttaaaaaatggccaaagcatttactgttctatcattcgtacctattcagggggtacatgcgacattcttgatacatccctacaattgtgtcatgctcatactggggtaatcataatatcaaatcccctcaatgggatttcacggtatttcgtcttctctcacctgtcggactctcgcaccacccagcagccatttaactagtaccagcgcccaccccaacaatcaatc

SEQ ID NO: 20348 - DNA, 802 bp, Homo sapiens
ctaggaggcactgtcgctgcacgttgacctccagactcttcattgtttccatcactttgccactgatttccagctcggccttggtcatcattgccctcagcaactcctggttctgcagctgtgaacacaaaaaaatcaacctcagtgggctctgcctgcctgaaatggaggcgagtgaatgccttgaagtcttcggagcactttgggtagacagccctgcggctgaatttttacttatttcaatgagaaaggaaagggagcaaagactgtacataatgtggcttcttccaccaacatctgaattttggcagccaactggcaaccagactgcctgcaagacaaaggatcctttttctactctggtcaatgcatcatggacaacaggcgtaaactctcactaatgtatctttagagggagcagcacagggcacctgctttggagccaagaagactttgggtctaatcccatactctctctctagcccactgtgagactttgggcccattatttagactcccttggtcttcatttccttacctctaatgatggggaatccactttccttggccattcttgagggttacatgacacaccgcatggtgtagaatgggaactcaacaccgtggtgatttggctatgaaatatgtaactatcagttcaaaaaaaaaacaaaatgggacttttggccttatcggtggatctctgcggcccttttccttaatggagggtaattttatgaacctcgtttactgactccattatctctgaccgttggctgcgggcagcgggatcagcttactc

SEQ ID NO: 20349 - DNA, 805 bp, Homo sapiens
  misc_feature (1)...(805): n = A,T,C or G
aactggagtncatgagcccaaactaaaggaaggaccatagcatcatgggcactggcgatagtcctgggtcgagcagagagtcaggaccgtcaagagaataaagctaactatacttcaagggtggatttctacacatccactgcagagcatgatagaatacagcgcacccatatgcatgttcatacgtcatcaccgcccagctaccttgagcgaggtagtcctggaacgacaggagatgaacgtcttccgtangatcngnacgagctacaacatgagaccacacgaccaaagctggcatgctaggattgtggcacacagccaacatcgacacctgcatgagatcaagcgtgtcatttggcaaataccgactgagggcctatcatgagccgagcactattcttagccaacgctaagccgcagacacagagataatgactaagagagagcctgtcaattaagtacaacccaggcattttaccacgctagttaatcggtgggatgagacaatatcaagactgagccaaactgcagctttggctataataccattcaagcctagacaggaaagtcaagggtccaagagctcaatgatctctctctcctgggcttcaatggccacacctacatgatgcccatagaccggcatgtcccatgagatactttgccacaagtttatacgaggaccctctggaaatacgtcgccagtgcaaagcttaacaatatggcctgaaagcactttacgaatagcattaggaacctcaagggttagacaaacccaccgcccacaagggcttcgcatctaaaa

SEQ ID NO: 20350 - DNA, 725 bp, Homo sapiens
gatggaagaagtattcggaaaactcactaggtggaacgtaaacgggagagctaagtgaacaagtatctacggatcgatattaaacaataggaagagccgagtagttgtgaatagcgaggtttaagaggacgaaaaattgatgtgtggagtgggaattctctctatagtatgtaggagaggcgatgcgacgtacgcccgtaagccttagttaaaatagaaaacgggcccgatggtacagaaaaaaaacacataagccaaaccaatggtgggtaaaaaatagactttgggggacagcatgaggcggatagcgctatcccatatatttgaaggaaacccaaaggcccagattcctcttggtaaaggataaccaagaaggaagcacttcataaaaggaataagccatcaaacattaagtaatttacaaactagactcttctctattctcttattttagcaatttcgttatttttgagacagagtctcactttttgcccttgatgaaatggactggcccaatcatggctcactgcagcctaaaaatcctggcctcaagaaatcctccagactcagcctcctaaagtgctgggattacaggcatgagccacagcacctgacctagactgttttaaactagatttccctgagaaaactttcactggaaaaatcaaaattatcctgctgtcattaagagaaaactatctgttgtagaaaaaaaaaaaaaaaaa

SEQ ID NO: 20351 - DNA, 326 bp, Homo sapiens
  misc_feature (1)...(326): n = A,T,C or G
ttgctaacttatcgagttatcagtatagaaatctaaanaaacccttgcgtggnatnaacacaagngtagncgggnngctcncaacatnccagggnanaaagaagggacaaaaggtgggngaannngccggagccaaaaaggaaaagcgcgaagccaccagnaaggaagcaggccaaccaagcccgcggaaaacagaaccagccacgggcganngaaaacggggaaggagaggaaggcacaaaaagagaaaagaggaagacagaaacccagtttttttctgcgggacaataaaacattaatgctaagacttttcaaaaaaaaaaaaa

SEQ ID NO: 20352 - DNA, 761 bp, Homo sapiens
gtctaactctgaagaactgccagattgtttcccaaaaattgtgtaccatttacaattctcatcaacaatgtgtaagggtttgatttctccaaatctctggcaaaatttagtattatctatcttatagccattctagtgggcataaaatggtatctattgtggttttgactggcatttccctgatggctaatgatactgagtatcttttcatgtgtttattgaacatttgtaggtctatccctttgtccactttcaaaattgagttatttgtttttttattgttgagttgtgagagtttttatattctggctacaattctcttaagatatatgatttgcaaatattttcttccattctgtgggttgtctttttactttcttgatggtattctttggaacgcaaaagttttactttgatgaagtccaatttatctattttttaattttgtcgcttgtgcttttgatgagatatctgagaaactgttgcctaatccaaggttttgttgatttactgctatattttcttctaagagttttatagtttttagctcttaacattcattcattatcccttcccttcatctttagtttatcatctcctaagggtaaatgcagtttacagcagatttgtttggtgtaatattctctatatcatctgttgttgtctttatcctgggatgagccatctccttaataaagctgttcatatttagttttgtggaacagacattcataacttcaacaaccttgccttccatcgct

SEQ ID NO: 20353 - DNA, 115 bp, Homo sapiens
ctcatgggcaactgaagaagacctattgcaaagaacgaggagcttaatgccagggacagattttgcagttggtggggtctcaataaaagttattttccactgaaaaaaaaaaaaa

SEQ ID NO: 20354 - DNA, 116 bp, Homo sapiens
cagggaccactgaagaaagaccgtattgcaaaggaagaaggagtttaatgccaggaacagattttgcagttggtggggtctcaataacagttattttccactgaaaaaaaaaaaaa

SEQ ID NO: 20355 - DNA, 835 bp, Homo sapiens
  misc_feature (1)...(835): n = A,T,C or G
cagataactgaagtggagtgatggactccngattcggagagtagtaagacgtgaaaggaatacacttgctcnaagcaccatgaactccatgttcactgttggggagaagaaacaagaaaagtaactggctgtcacctatgagacccttacgtgattgttagttaagcttttattcaaagcaccctgcaattcacgacaataacacaattactgacccaaaaaaatcgttttaatggcctcaactgccctcaaccgacagaatccgacgttcttttttttctccgcgaggagaacatccatgaaccacccacaccgactcccccccaccacacccatcgccctagcgcccccccaacaaccccgccccccgctacatcccaaacactccccacaagaatacgacaaacatcaacccccaccccccccaccccccccccccccatgccacgcccaccgtcgccacccaccctccccacccaactagacgacgcaaccgacaactggtgtggtgatagacacccccaccaccctccctcacccccccccccgcactctccccccgaccttccatcacaccctgctcccctcccccctactccctcccctccccccatcccctaccacaccccccccataactcagccacccaaagccatgaaacatgcacgcagccacgcccgcccctcatacccacctagatattacgctatagacaacacactctctcccccctctacatacctaaatcacctatccacacccacaactactccacgcccccgacccatcgctctgtctcagataatatcactgacaccagcaacacacgcggacc

SEQ ID NO: 20356 - DNA, 863 bp, Homo sapiens
  misc_feature (1)...(863): n = A,T,C or G
aacacgccccccccaaatcaaaacaggcaatagaaattnaaaaaaaaacttgagagtaacgacnggctgnctttgngggtcacacgaagatgacagacgatgggcttgtgtataacattttcctggctgtcaacttcttggtgtcattgctcaagaaaaactggcagaatgtccgggccttatatatcaagagcaccatgggcaagccccagcgcctatattaaggcacatttgaataaattctattaccagctaaaacaacacaaaaaaaaaattttttttttaacacacacacacccacccacacaccaaaaaaaacagcacctctgctactcctacccccagaccacccacaccccacgtccctcttccctcaccgtaacaaactattcacccccctcccaacatgtatcccatagcctagcctaccccacaacgtctgacacagatcctctaaacgcacgggaatgcgctctagatcacttacacgcgcgacgttcatgcagagagcgcgcaaccagaactaaacgaccgattaacatccgtacactcccgctatccgcccccctttttttctcctcacggctcccttctcttcacctcggccctccccactcccacgctccctacatatattacccatgtcctcccccccacctcaaacataacatcgcccatccattgcccgatcaatacgcacccacaaaacccgcttacccccacccccgccccccacaccaaatacccgtcaacctccgcccaacgatatacacccaatgccaatcccacccgcataccacccgcaatagccaataatatcccaccccatatcaccgataccccgcactccccgagaacgagcg

SEQ ID NO: 20357 - DNA, 150 bp, Homo sapiens
ccagctgccactcttcctgaggctgtggcagcctacttgggactctggagcagggagcttggtgattcattttattatgggggagggcgggactaataaataaattactaacaataataaaacaatcactaacatttaaaaaaaaaaaaa

SEQ ID NO: 20358 - DNA, 958 bp, Homo sapiens
agttataagccacacctcccccccccccctccccagaccacaactcagtttccccaacactgcgtgagagttttgcttttactatgcaagaaaagatggtgggttgtgctttccacattttggggggagggcggagtgatgacgaccaccgatctaactactctagaccagcatgtaagaatatcacaaagctggacgacaccacccaccacacacacaaaatcctttctatattccccgaccctcgtgcaccgaaactacaatcaccaccctctcatacgcctcctttattgcccggcgggggcgctctccttcctcccactctccgaaaaactacaacatacccaacaagagctctcactccccgtcgccgcgatactccgccccaccctcccccaccaaaccacacctcccatacacagtactcgcagcgccactaccctgcctcagttatttttgatctctcccccaccacctacacccgacgccccagtcgcatagttatgcagaccacacaacatcaccccacccccccgaccatttaagttcttacacgccctcttgagtcgatcctcccccacgcccaacatgcccttacaacttatttcaattctaacactctctactccccacatactatttttctctccatgccccgtctctacgtcaccacccccccatcaccggccgacccccagatgcgatcccttagttccccgcctagggcgtcgctcccacacgcgacgcacacccagcatcagcccgccccattaccatctattttaacgctacctacatccccactacgtttttccacaatactacccgactcactctccaacgtgtcccaccatctccctcatccctccccccgctatataccctatgtctcgcccccccgcacccctcacttttagtgttgtaacgctccctcgccgcgctcaccgcgcccccaccg

SEQ ID NO: 20359 - DNA, 842 bp, Homo sapiens
  misc_feature (1)...(842): n = A,T,C or G
atatattaatgttctccgcaggttagtgaaccaaatttccaaataaaagaacttagttgctacccaaacattcgtaactgcagaatcaattctggatttgccaaacgtgttcgacaagataattcnagtgaggagcgggtgcgagaaaacaaaccaacaactggaacataaaagaaacatcgtgtaaaataaatccaagcatgggttagaaaatttggaagaaatatttcaaaaggaaatctaagataaatcacttcaaagccaagcaaaatgaagttgatcatttctggtggtgggaagtttatcaataccctttcaaaaatatatttaaaatctttgaaagaagacccatcttaaagctaacgttacccaagtactttaaacaagcagaaaaatgaaactctttattttcttattttgggttctaaaaaaaataaaatttcataacaaagactcacgtcacaatccacccataccactaattaaacaattgtaattgtgttaaactagttgtgggaactgcttaactttctgactgtttatttcatttttccgccgacccttcaaattgatttcgcggtccacatgatcactcctcccattgtagcggagcgtgaattgcgacggagtcccccccatacttaatgtctcttagtaccttaacttgttttcacagcgtatacctttttttaattcctcatgcctttgtttctatagtttatcccgttcgacttttatattacatgttgttctcgctgtcccctccctttattgcgtctgtggttgagcgcgatcatgtctgttgggtatgcgccatagacgcactaacacaatacgaaacg

SEQ ID NO: 20360 - DNA, 1944 bp, Homo sapiens
  misc_feature (1)...(1944): n = A,T,C or G
ccatcgctcgctangngnancatagatcgacggtgcagcgcagatngnctagngggancacgcgcttacagcactgcatctgntantcgatatatcgtcagtgatgcgangatcgatgagngatatgacgctgcacgcgacatgacgtgtcnancgttcgcgctncgnctnacatatgagtagtatanatggtcagtcagtatgaatgngtgtggtgattgganggtacgatntcgantgactgagacgtgtcgatagagagattaggtacgctcgagtagngnacgcgcatcatcaggtngnngagacgtngtactgagcgacgtgcacgtcacacaangcgcatngncnacacctacgattctcgacagntgnngcagtactatcgaagtctgatgcgtgcgatgagctgagtgngtngngncgcccatagngtcgtgatgngagaggacncggtagtagtgtagtagtganngnnnangatacacntcacgatgtnacggtgngatcactacgtaccgtcatgtctanctgacacatatatganacgacgcacgtagtcactgcgatgagctgagagcgtnacatctcgacganatacttgtgactactnacaactgnactctcntnntannnccgatcatntnncagcgatcactacacacaactcatcacgaatcacacatatcgntngatatcaaactacatacatganattatatatatgtctgnaatnaaataatgatanacgtctatanacagcagacatanagcgtgactacatagacctacacattcnacgtgngaganaatgnacacgacagcaacaancnttannagacacntgcaatatctgcagatcgtactnnncatacgcatgtngctacttgacactcgtgttantatctcgcgtataanatnccgctgcatgacnaagtaatcgtntgatgtagcactatagtcnnnacgcancgatgcgnctactgcgagcgntanantagcgngaccgtgntatgangngtgaacatacgaatatcanaatacatanatacatacgtatcgancaagcanaatagtannnaacntcgagagtcatatcatntagatcagcttactcantgtnancagatcatcgatatagngacattacgtntagagacgtatnntanatcctatcgtgagaatatgatccgctacgtcntnnnngcacatagctagttctagcnntatngccctatgtcctccatatctanctncantctactctntnnccttncnctcacncnccctcncnctatctatcacacacntnnnnnccatatacttctantacgtacntcctcatnncncaccacnctctanttnnnnnantacaccatacttctntncactatatctctanncnntnactntcanancactctnctcactcctatnnncattcttcattctntacntttctcttctatnnnctcaactctcnnacttgtgtacttcatntnnananttatctatatatcntncacacncatcatntatcatcnnnactctactnnaccttncnccatcaattntntntcntcntncnctcctctcctntnnnnnnccttctctcatcntcctcatctctctntcnntnncactctntnntactcttctttntctctcctttctttctnnncctacctctcacttcttctcnnnccttcctctncnntnncatcctctctcnctcttcnntnnnncntatcncttcntnactcatctcttctnnnnncctcttntttactttctcctctctntnnnncacctctctcatctnttctnnnnnnncccctttcactctnctcntcctcctntccctncntctcntcttcatcttcttatnttntctcnttcntttcctcctctntcntntnnncncnnnctccnctntcttttctc

SEQ ID NO: 20361 - DNA, 904 bp, Homo sapiens
  misc_feature (1)...(904): n = A,T,C or G
ctttgactactgattattgangtccgtcttagacattatagggccgattttgttgctaacagcacacccgtatttcagcctgctcagacagtggttctctgtgtaggttgttcaacagagttgagccaacctacaggaggaaaggccagactcacagaagggtgtccatttacaagagagcgcactaatgatcaaaacagctcgctgaatgtccaccgttagtgtcgtctcacagatcgccttcccatctatgccataatgtctattagagtaccagcccccctcacgtccgattatgttcagtcaggcctatcacccgaaacccctacgaccgagacaaactccccacaatgttgtcgacggtggtctaatacagtccttcatggaccgagttagcgtctgggggaggaatatcacacacccgacactccagcgcacgcgccgcacctcacccttcgcttacgccacagcaacaccaataacgacccaaatctgcagccgccatgaactgactatctatgaaacaaaaacccgactcacagttgaccctcaatcaagcatcacataaatatcaggtgtatcgaacactacggcgcgccggctaagtccacaccacccacgacactaacaccccccactctatcaaatcgcgttgcctccgccggacctgcttactaagaacatcagcaaaaacgctatcccggcgggccggttagatgcggtaagagtgtcggaggtattagaacaggacctatcacagcaacacaaaccccgccgcctcgacggtacacgcaactcactccaggtaatgtcagtaggacgccacgttatctcttgttccagatcccgtgtcccgcgtccatcccactccaacgcttacgacagccacatcgacgcccactac

SEQ ID NO: 20362 - DNA, 926 bp, Homo sapiens
attagaatataaacgaataaaccgtctaaaaattaaacgagtgctcagggagacattctcacagttctgaggttaacgcgtggcagtttcccctgagctctccttcctgctggtatgtaaggcgtgctttgcttcctctacaccttccgccatgattgtacattccctgaggcctccccagccatgcataactgcatacaacttaggattcataactacatatatacggatacaagggcatgaacagaaaagcggccattctggaataccttgtgccagattaaccagaccacgcagcagaactgggagacaaacacaccagacgaccgcaccggccgtataatcaccgccaacaaacaagtgcccgctgtaccccggctaataacaacataacgaagcctcgcattacacaacaacaagaactacctgaatacttaatagactcgtcaggcacgaatatccccaggacgggcgtcgtgtcagatatagtcgttactacgatgccggctaggtgaatttatataaatttaccgtacacattcaacactaagtcggacggaccctttcaataataattaaatgcgccggaaagagcccgaggagcgcctcgccggatgggaaagcggagactaagaaaatatggcacggcgaggatgaagaaaccaggaagagtccgcgcgtacctaaacggagttgtggcgcatgttatataactctagccgagcacgtcgcagggtgcacctgagggggtataaagaaaaactgtggtcttggcgaatgaagacacacagcgacgccggacagctgatccgacaatggaggcccggtcaatacaaaaacagggaatgaacccgaaaagatatgttaagttacatcagttattagaagaagcctccataacatacatccacaacacacccccatac

SEQ ID NO: 20363 - DNA, 308 bp, Homo sapiens
tagagacggcgtttcaccattttgcccagaatggtctcaattcctgagctcaagcgatcctcccaccttggcctcccaaaggtctaggattacaggcatcaaacactgcacctggcctggatttctcaacatagttttaatggtagtttttaggtttcaatgtcttattcatgttgtttattcacaatacatttatgaatatatattttttctgtaatttttttaccttgtctcacttggtgtaagtcttgaccactttaaaaaaatctttctttggatggattcagtataatagaaaaaaaaaaaaa

SEQ ID NO: 20364 - DNA, 826 bp, Homo sapiens
caagcatcatatggtgaaggagaaggagacacagatgtgatgcagcaggagacagttacagttcctgtaccttgttagaataccaaacagtctaaagattgttttgtgatacgactcaagaggaaagaaacgaggttgccacctagacgctggaaaagaggaattatcatagagactgatgtttcttgtaaatcgttatgccgaagttatggttactctgatcatcgttgtttgttttttatggtgtgttagagtttttaacgttcgatgatttggtttttgtgagtgatcgctgtcgtgtttgtgttatatcatgggctatcattttgtgttgtttcttgtgtgttttaattttttgattctatggttgttgggttttgttttttttttatcgcttgtggaattgtttgttttcagtggctgggttgtttttttttgcgtttgtgggggctatttgttatattttgttgtctttggtatttgagaatggtgtttttgttggtgtaaagtttttgctatattattattattattttagtatacgtgatttttgtttttttatttagtatgtggagcgcgttgatgcgaatgtcgggctatattttgtgcttatgctagtcgttatagattgttgtggaatgttgtagctatctatgtcgaattagctgttttaggagtagttttaggaatatgtgatatattatgacttgtgtaattctgtgatatgctattattttggttattgccgctgcatcttcgtttcttgtaacgtttatcgtttattttgctgttgatttttttatgtgacgtgtttatggtggtcctt

SEQ ID NO: 20365 - DNA, 837 bp, Homo sapiens
  misc_feature (1)...(837): n = A,T,C or G
cctttgctgccagcatgatgtcgtatttataatatgtggaggagagagagctcaccatgctcaggtaaagggatgtttgagaagttgcagtatatctgtacacacaccctctattctacattgaggctcacaagtatttccctccggagtgtagctcctgtgaaatgctccaagatgatctcggatgcaaattcagccatgcaagagtgatgaaatgcttgcattatttccaaagatgaattaagacaatgaggcagctcttcatttgtcaaaaggacttgcaatcaaaacctgaagagggttttctctgacattgacttcagcagttcttcaccctaggaggcctacagagggggcttaaggaaaccagaaaccccatgcccaaagaaggattcttgtgagaattgcccttattaagttcctggatgtttattttttttccatatttgagaggatcttgaggcggcccgcaagttcggaaccctcggggatgcattgctacattctggtttgtgccggcgtaatttagaagggggacctcccccgcggctaaccgccaggtgatcaacagaagtgattatcgattgccggtcccctggcggaaatgggtcacaggggtgaacacgggattatcgtcggagagcatgcaggtcacagattatagacgatntgcttcgcagacgttatgatagcgagcttatcgtttgagggtgaatgcgtgagatcacacgtcgtctcgcacatgatggtacgatagtaatacgttagcctatgcgcgcggtctgcggcgttcgctcgtactagagtatcgcatgctgtggagagtatgccggatag

SEQ ID NO: 20366 - DNA, 968 bp, Homo sapiens
  misc_feature (1)...(968): n = A,T,C or G
ggacaagggtcaccatggcaacagtaccacgccagcggacgggagtaacaggggacgtctctactgcatttccaccgcttcaggtcgcttctctgggagtcacccccttcaccttatgtgctctgtgcatgagccgctgtcgtgctgccaccggcgtacggatgtactacgaaatgatcgaaaactgctcctgaacaactgccaaacttcgctgttatatggagtgggagctgttttgttaccactttcagaagttgttccccgcctgctgagcaatgaggattnagggtatactggcccgagcccccggcatacaggtgcactcttaagaccgctgctgatatatcgggcacgatgcatggcctagtccttagcctaccagagtggcagattcgtggggagagttaggttggttcttttcggtggcccagtcatgttccccatccccttactatctacgatgtctgcgtatgcaaaacgccccgacctgacaaaaagcctggacgctcgggagagagaacggcgcgtcacatgtcgcaaggcagaagattttgtgncatgatggggcctcgtccataattctcgagggtctatagaaaataactccacaaaaaaagggcgacnttaggacccgggctgatagcgcccatgtgggggtcacagggccgcacatgagcacattctgaaacaagtgaacgcgtacgttctttgcgtatcttctatgcgatagcacacactccagtcctcgctgtgttgcagtacctcnacacttccgcctcgggccgcagtnnccagaagagggatcactattcgtccggccnaacgctgctccttaagtccacgatgagtgggagccttgtncnccntgcacctatactagcacagctgtaacaggcatcacttccacgctacttccttatgccgataaacggacgctttcggtttnacgtgtgagggaacgagcagag

SEQ ID NO: 20367 - DNA, 608 bp, Homo sapiens
cgggtgtggtccaacgagggccctgggacagcctggagggagtttcagaagacgaatagatagtaggacagaggggaagccgtgtcttctctaggtgcttgtctctagaatctggccagcacctgtcatatgagagcttggtgaacattagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaaccgcccccctgtgaaggaggaggaccctgagggggcccgaggaaacctgaccaagaaccaggaaatcaagtccaagacctccaggtcatgcgaagaggggaggcagctggcttcggccgcccgtgggggtcacccgaccccgccaggtccgagactggttttagaaacccaaagcggaccccccaaagggttttcggtgagaagggtgggccctcccttgttgcccgatgctcggaacaggacctaccct

SEQ ID NO: 20368 - DNA, 156 bp, Homo sapiens
tcgctaccttaaggtctatctggccgtttaaacagatgtgtataagagacaggtttatatcctgataatctttgtatgatagatctactttaaaactcaaccaagagggtttatctgaaatatcaaaaagcctttgtctttctaaaaaaaaaaaaa

SEQ ID NO: 20369 - DNA, 316 bp, Homo sapiens
atattttacatggggcccaggccattctcaaactgctcctggaaatcacagccaagcccagaagccagtgccaagaaacagcatgaggacgcctgctccgcacataagacatctccggaggccacctgatctctgtcccattccacagctgcgtgtcccatgtcagagcagcagtgacgttggaacctggctttacgggccccagctctcctctcatgggatggcagagactgaataaagcaacgtcaatcctttttttctgtgaaatttattgtttccacattaaaagaatttttttgagggaaaaaaaaaaaaa

SEQ ID NO: 20370 - DNA, 273 bp, Homo sapiens
ctgtggagctactggaatcaaggctttcaccaaactcatcggtggatattataacaaggataacaagggaaatgatgaacatgaagctggaggcctgaaaggagacaaggtttaattatcatagctgtaaagatgacagattcacttccccattcaataagatgtttcactcctgtttgattctgaaattgtaatgaccttggattccatgtgaatgtgccattgtcagaaaaatattttcacattaaatctacaggcagaaaaaaaaaaaaa

SEQ ID NO: 20371 - DNA, 137 bp, Homo sapiens
tttgataagatatactactgccttgctgtcaaacagtaacagtcacctttttttgtatctccaattataaatgcaatacatactgtaaaaagaaaagaaaacatcataaatatctttataaagcaaaaaaaaaaaaa

SEQ ID NO: 20372 - DNA, 859 bp, Homo sapiens
  misc_feature (1)...(859): n = A,T,C or G
cttgttcctgcgaatgaagctgctttattgatgaacataatactactgccttgctgtacagaacaggaacagtcacctttttttgtatctccaattataaatgcactacatactgtaaaaagaaaagaaaacatcgtaaatatctttataaagtaacaacaagaaagaggatgaataaatataataactgattccaattgatataaaataaacaaaaaattgtgtaggacatgaaatttttaccacgagggataaaactccaaggtgaagccaattgggccccgaagccctaaaagggggagcttggcctcccttcccttttagggggggcaactgctggcccttccctaagtgacgcgttagcccacgaccctcgggcggggactagcggtactcgctcattcaagggcggaagaccggtattacccaaatcacggggatgcccccggaatcacacagtgtccaaagaggcccccaaaaggcaacatatccgcaaaaggccggcgcggggggcataatcccaaagacgccccccccctgaaaaattttccataaccccccgcctcttgaaaaggcgggcacaccctccacgggacaataaaaatccggcgcggtttcgccctggaaaatttccgtgtgcgggctatcttgtcccggaacttgcccgttaacggaaacctgtccccccttatccccttagagaagaggggggtctttttcttaataatacggcgaaaggtttctcatnctcggtggacagacctccaccccgaacgagggccggtgaggccaaccccgcttatatcccaccgcgcgcccaatccggagaaaaacggtatgagatcaacacggaaaaaaa

SEQ ID NO: 20373 - DNA, 1804 bp, Homo sapiens
  misc_feature (1)...(1804): n = A,T,C or G
ttggtatgtttagtgggggggagtgaagtagaaggggatttgctgcggtgtggtgtcggagggggcgcgagccgggggagttgagggggggggacagaggggaatagtattttttgttaaggaggtcttagcctacgtgtgcataggcgnagcgcgagtatcctgcctgatacagtaatntagccacacgattccnctcgaggccgaccgatacgggatgtctggcttggctgctgtcttgagggcttgtgaagttatagttttctttttgtggtgatggtgtgtgtgtgcgtgtacgaagagtgtagtgattagtatatattgtatatcttaatagttaagatgagaaattattataaataataaattaacagattgtagtagagagtaagtatggggagtgcgcagcgacacgtagagggggcacgcgagacgatgtatagagagtgagtacagatgactgagagngctacacgagaggcaacgactnaacgcgggactgagaacgtagncgntactgtggtgatgntaaagtancgatncatacganactgacacatgactaaagtcatactcactatcgacatactgatacantagaggcgaanagntgagatagatagtgtatgtacatcgcgatgcgtgtcgacgnagcacgagagcangnnagtgacgantctacgangcagtnagnanganaggtaganacgacacgagatgcggtgcgtgtccgacatgtagtagggagtacncgncgagatctgcaacaagcngcgtgtcaggacggttagtgagagtatatacatagatatctcgtagncgcgacgatagtaacggacgagacagaggcagcgactcgnagagtcaggactaggacgtgacgtcgacgtattacangcatcggctcancnctnacgtggcatcatactagacantacaagcatcaactcgacaagaactccnaccacgacacgcatnaccgacagtggtcgagcgctgatacttctacatatantctcatacgtgtcgaacgacggagacgtcgttccattctctctgtcnctctgtgtacatgttatatatcacntatcagataanacnaggacgacactcagangcgtatgcagacgacgtatcacacgtatgtacatgncgcttacatgtangtcgcagttcgcgtcgattgtgacgtactatagtgcgtgtagtgctcatgtgttcgtgtganagcatgatnacnctcaacatgtgctacctaacgctacatatntgacagtcgancgtgtatgtcgtacgtctcatcaggagcgagaagctcgtcggacgantcatgtcgagagcgtagtgaacgatcgatacgcagactgtgnatactntatcgacgaggccgactacgacagttgtctctcgtacagatgtcaacngagncgtagagtnagtcgtgcntnacgagtatgctnaggtgcgtacgagactgcactnccgaatgcgtgtcacgtgcgataaggntaaaagactatcgcncagcagtacgactgaacatgatcgtagtatcgtcgacgctagtaaagtagnagtntatnagagctcgtcgntcagcgtatcncncngactacacgctctagcgacgagtgatctacgcgatntctggtgcgcagagtacgttctgntctgctgtccactgagctgacgtcgctctgtcatcgaggtgaaatgnagtagagtacntntntantatagngatgcagactacgacagcgngtanagagtagtcatgaatgancgcgcacgtgtagtagtcagg

SEQ ID NO: 20374 - DNA, 116 bp, Homo sapiens
ctgggaccactgaagaaagaccgatttgcaaaggaagaaggagcttaatgccaggaacagattttgcagctggtggggtctcaataaaagttattttccactgaaaaaaaaaaaaa

SEQ ID NO: 20375 - DNA, 840 bp, Homo sapiens
ccttccctcgctttcctttcgttcatccatcccacaccacacgagggttcctggttgccagcgctgccgtatcgtattgatgtggaccgagagcccgctaaggacagccacacttgctgcaggggaggaacctacacgctggactagatgacagggactgaaataaaaagcgcacaccacatggcacgaaccaggatccaatcagatagagctcctgttgtaatctagattgctagatccaatcacaacacatctcattaccttatggtaataagcttatgcttataaaacccgacccaaccgacagcttggggagacaggattgacctttcctcctgtctcgcaggaatgaactccactctctccagccaaaaccctgcgctttggtgtatggctttccctgttgcacaggcaggccagaccactttggttcggagaactctacgccatgctgacacactatccagggctaccaggacacattcagcatgccctcctaaccatgctcacaggaaccaccatgctgcacacacggtacttccacaaaccagacttggacacaccccccgggcccgattttgacgttctccagaatccgcacggccctacgcggcagccaggtctcaccaaccaggactcctaggctcacttattacacccacccggaagaacggcctcacctcttgagtggtccatatagcgcttgcccagaccctcctgacccccctgggcaggctgaaactcgcatacctctaatcgcagctttcaaggtaccaccgttgctgtgctgaccgcccctcccgtggttcccattctgcccccaattctttacttctgccc

SEQ ID NO: 20376 - DNA, 733 bp, Homo sapiens
tttggccaaaaaggcctcctgcataccagcatagatgttaaaatccaaattataagaatggcagaacagactctctggcaattggatatcaaattataaacagaacctaaacccatggcaggcgaggtttaagtcacttacctacccttaaagaataagcttgttctcactgccatagctacttttttttttttttttttttgtctttctctagcagctaaataagcactggcctggagataagcactagtgaaagaatttgcagctcatccactgctggaccctgattaagtgaccccctgttccacaagccatgactccagctttgactggacaagagactgatttcagtagctttttttcatataagaagaccattgactgtggaatgattccagaggctgcacactgtcaggacttcatgtgctgaaaagaccttttgacatgtacggcctgattgcagtgcatttgaatgttgtctccaccctaaagtgaacatggatcatatgttacatgcacgtttgttcaatgcccatgtggcaagaccccttgatgaatattcgtaactcctcctgtaacctgttgaatatgtatgtcctaccccaacccctcctccttcatggtgcctgtctttggtcttgactagaggccaacctgcaggttggccacctggcaggctgtaaccctaagaaataaaaacttcttttctccttttaaaaaaaaaaaaaaaaaa

SEQ ID NO: 20377 - DNA, 1401 bp, Homo sapiens
  misc_feature (1)...(1401): n = A,T,C or G
ccnggcgtgtcgcggctgcccccgggtgcgtcgcgctcttcttccgcctccgtcctgcccgctgatgcgtaccgttgctgcccggtctggtgcggttggcccctctgctcgccgtctcggcgcgtccgttccgtcgccgtgtctgctcgctccnctgcctgcgcggtctgcgctcgcgcgcggcttcgtcctctccctggcgggccctgtcgggccgtgtgtctgtcgggcgtctgggtctgtgctgtgtctcttgtctctgccgtctgtgctgcgggtatcgggtctcgctgtnggcttcgaggcggccgcgtgcgcgtcggtggtgcaggagtttgcctctcgttgcncgtctgtgttcgtggctgctggccgggccggtggtgtgctgggcggcgcgtgtccgcgctgcccgcttgtcgcgcgtcgtcgctctcttcgttcgccccctctgcccgctcctcgtgtggcgcgcgtggcgcgcgcgcgcgcttcgccgtcgcgctgttgcccgcgtgccggcttcgttccgccctcgcatgttcggttcttcggtccgcccgccgcgctccgtggtggtgtgcggggtgtgggtggcggggttggtcttttttttttgggcttggggccagggttgtgcgtgtgtgttgtccgcgtcgttcgcgcacncgccgaggtctgttcttattgttacgggttcgtncttgtgtctgtggtgcttctngtgggtcgctggtcgtgcgtcgcgtcgtggcatcgctgttgcgcgctacgccgtgtcgtctgttcgtgtntcggttctcctncgtcgggcgtgtggcggggcgtcgcgtgcttctgtgactgtgtagcgcttgcgtggtggctcgctcttccctcgtcctctcccttctctcggtcgcgctcgcgcgtgctgcccgcccgcccgtcccgcggcgttctctgcgtgntttgctgtgtagtgctgtgcgttctgcgngggcagcgtctctgctgctgtgcgtctggntctgcaccgcccgctggcgtgncgctcgccggcacctcggcgtcngtctcagccggtcgctctcgtctggtccgcgttctgcgtgtctctncccgtcctcggngnggcgngtgnagcggcgcgcgcgccgggtcgttctgtctngctnagcgccgccnnctcgtacagacgagtatnagncngctctntntgcntctttctttctcttntcttcntgtgctggtntttgttgtnngttttnnnggtggttttttgnnnntctctctntnttgaagccctcttnttttnnttnntnntnttctntgttttttccccctntttctctgagggnttnntnttcctcttnnnttnntttttctcgtcgcactanannntnannnnntttnnnannc

SEQ ID NO: 20378 - DNA, 802 bp, Homo sapiens
  misc_feature (1)...(802): n = A,T,C or G
tggtgtatgcagttaacagggaagcaacgccncttagattttcaccgctacagtgtaagaggtgcctttcacctgctgccatgtttattaggcctccccacccatgtggcggttccaacactgcgtagaggccctagggtacgtcactgtgagcgtattttcgagagagaggaaaggcatagtattcactttcgagagtgcacgccnaacgtgcagcgatttttttgctagtggggaatgctgaggcctcttcgggtgtgggcaaggacgcgagctgcaggagttacatcagcaatgcggatcattgcntggccagccgacgtgtagtcgctnnccacacctatctacgccgacttgttagtagatcggaagttcgccactgcacgcgcgctgaagtacagaaactcgtttgtcgaggacccgatgacggtccatcgagttgtattattactaactctccactctaggaacgggaagagaagtggnctagggaagtcctcgctncctctgccttctgcagctttggtccggaccaaacgacgcccctatgccaggcagacagccctctggacagccntgagctcacatgcccatgcagttcgttcgcctttgctggtctggtcactcttcgaacgtcggctcgatcgcctctaacgtgagttcctcgccacatttgcgacagaggctatggtcgcncaaggaggggtgggcagtgtagagggcccgtcatgggnacgccttgcacccgggtcgtggcgtctcgctgcgcagcctcgatagtagtgtctcgttctcccgcgcg

SEQ ID NO: 20379 - DNA, 659 bp, Homo sapiens
tctaataatcaccgctacagagccgaacactgtcagctacagccagtccagcttgatccacctggtggggccttcagacttgtgcacggaggtgtgaccatgaagctcatggatgaggtcgccgggatcgtggctgcacgccactgcaagaccaacatcgtccattaattttcatgacaagatcagaaaaggctgcgtcatcaccatctcgggacgcatgaccttcacgagcaataagtccatggagcgccgaccctgttgtggacagctctcagaagcgctaccgggccgccagtgccttcttcacctacgtgtcgctgagccaggaaggcaggttggtgcccgagaccgaggacgagaagaagcgctttgaggaaggcaaagggcggtacctgcagatgaaggcgaagcgacagggccacgcgggagcctctgccactggtgcctcgagtagccatggcaacgggcccagcgtccagtcacttaaaagttcccccttggccaaaacccaattacattgggagctggtgttggtaaccatgactctctctgcaacctaccaccaagctttttaatacattcagtatcatgctcacagggttgcccagcgccggaggcgttggcctaacccttggagggaggacccacctcttataagc

SEQ ID NO: 20380 - DNA, 342 bp, Homo sapiens
tccaaggactgggagacagaagccttcagtttgaatttcagattcttgaagactaactttctcaatcatattctcgggaaagtaactatgtgttcatttctaaggatcatgtgaagatggctctgtctactgagaatcgacttcaaatgcatgctactaaaatggagctaatatgcgtcatttcctcagctataatttggggaggttaatacttgttaaatcactagactgctataaggtttgcccataaacattgtaaataatgtattcaaaattattaaaatgttacaatataaacaagaatgtgatataataaaatgtaattatataaaaaaaaaaaaa

SEQ ID NO: 20381 - DNA, 755 bp, Homo sapiens
gcttatggatgaggatagagggactgctgtcctcacaaggcgtcggtcaacaccgcgaagtttggcaggcttgacaagtggagtttttgaatctataatggttcaagttttgagacaggaagaacagctgggagcaaaagaagaaaaaaggcttcgggagcaggaaagaaaagaagcagaagaagctagtcaaaaggaaatagaagaatgggaaagaaaacttctagctcaagcagctccaacttgtaaggagaccatgtgggaaattccagctattgggcatttcctttgtttagctcagcaaattctaaatttgccagaaatagtcttttacgaactggaacgttgtcttctgatgcctcagtgtaatgcttttctatcgaaaataatgacttctctattacgtcctccccatcgcagacctaccttacctcgaaagacctactgtgccttataggaccctgggaagcagcgctgaggcagaaagcacaacagtgggtcccttgctgtaggggcaacctgaaaatcctgataactgggctgaaaaactggggttgcgtcctcaagtttttaaggttcttggaaaattaatccatgggaagaaaacccttttcacagactacctttttaccaaagggtggttccttaagggtctttggggacttttgggatgaaacaccaaaggaaggtcaaggatgctggccttgaccagcctttccttaaaggcagggaagtattctttgggtataattatg

SEQ ID NO: 20382 - DNA, 843 bp, Homo sapiens
  misc_feature (1)...(843): n = A,T,C or G
aaaccaccaaaaccacactacaaactacaacacaaacacaaangtgctaggaacaccaggaggtttgaagacaaacaggctcttgcaccagtatcaaacagatgccagcacttgtaacatctgccctaccattggaataacataatgagaggcctgggcaacccagagagaagtgtaaatgacatcagttactaataagaacactgctgaattttgaaaaactttcgcatgctttaattcctccatattttaagtcattatttttattatgacagtgctgagtattattagcatgctcggtcacaaataaaaacaaaattcatttcaccacaactcaataattgataacttaacccttgcacacactataagcacacccctcccccacaatcccccccagcaaaaaatcatcaccacctgtcccgtatacccgcctatgcttcaccctctccgcccttcccctccccccccccgttcccacactgaccccaacacccaccaccgcccacactacacgccccccctccatcgacgtcccccgcgccgcgcatactatcctacccacccaatccctcaccacattgaaactgcacctcaaaacctctctcacccctcctcacatactgccttccctccccctcccctcacctgcttttcccagccgcgaacgaaaccaaaacaagtcctcccgcgcaccaatgaccccagcatcacctctctctctccagaccctcttctactattatattatctccctctattcagcaccaccaatacccatctatgcccctaccccctctccccataactccctcacacccccccctcaccactntccccgtt

SEQ ID NO: 20383 - DNA, 1059 bp, Homo sapiens
  misc_feature (1)...(1059): n = A,T,C or G
tgatgcctttcccgatttaaaacactanaattgnggganaangnnnaaaaggnnnattatanangangtgtgnnnnnnnnnnnnnnannngggnngnnnngnnnngggaggnnnngagggnnggggggcggaggaagaagggggataannagaagggaataatnaaaaattatatggaagtaaaagaaaaaacacaaaccctcattcttcaaagaaagataaagcaagaaaacattgataagtaatgtataaaacatactagagataaaatagagcagatgagcataactttaaacaataaaaagaaaaaatcaaaaacacacaaaatatgaaagtatatgtcaggagaatccagtatgttatcaacaaggggangtccgttacagcaaagcacaacacgcagcatagcccaacgaaggggccacagaacggaaaaaggaaagcgttatacacaaaaacagccaaagagaaanaccaagagagaaagaggacgcatacggagacaagaggcctgtaaagccccaccagcacnaaaggcaaatattcatcaaaatagaggnaccaagacaaaagaattagcagatatccagcccgcgagttaacagaataattaagagtnataaaagacaaantcgaatatacncactaagagagatgacaagcggaaganccaagacgnccaaagcgtaaccataaaaaagctacaagccaatctccgaatggnctctcacaacaacatactataagcaagaggtgtctaggcagtaaaacnnacctacaaatagatacactatcaccctacgcctctagtgtgaatgctcaagtgataaatcatattgatatagatattaaagaagaagaaattnccgttgtataacgaacaagataaatattccacaaggatancataacaagtagaaataaaataataaacagaaagcttgaaagaggcgccaaaataaagaagatgaatatcgcgtgtatgttttaggaggttttagtataagaggatacagctagaaataggtcaataaaaggatatatatatgaatgcgtcag

SEQ ID NO: 20384 - DNA, 1890 bp, Homo sapiens
  misc_feature (1)...(1890): n = A,T,C or G
ttcgtagcgcaggtgtagtgatctgtctgctatcactcgcatagcacgcagactgtcaagtatattagtgcattagtactcggaatgctggattctaagtatttaaattaatgtgtagatangatgtgagttgatttctatagccgtacagattgattagtaaatgtgatgagatgatgagcgctgacgcggatagtggtgacaggatgatagtgtcggtagtttntgattaaatctatatagagtancnatatgngagcggatctcgagtagagacatgagcttataagtattgatgtgtnatcttacgcgtggtgtgtgtatacgggtgtatgagtggtgtcgacgtgtgtagagcgtaactggggcgagtgtgtagtgtgtgtgtgatntggccatatatgttntgctcgtgatctgtgtcattcncgggancgatatgtaaatattgcgttaactgcttcggtctgatgatgctcacgntgcntcatgtagatggntggtcgtcctgcgtctgtttgtgtcgtcgcgcgttgtctgtgcaggttgtgntgaggtgcagatggtgtgaatactagctagcgtgtcctctatcatattgtcgatcgtagagcgtctnctatcagtgactgcgtcgatctaagcgtttcctccgtctcacgctcctgtggtgtcggcagtatgtacttcacgaagcacagcgagcatcacagcgatgacagagattcacgccaactccatacgttagacgtccagtatncacatacgtgtactcacatattagtcgtctatctcctatactattatattcaacactcacggacgcacgctcgcacacacgcgacgcgtatcggcgcgctcgantactacgtgcgctgcgcacacatagtccacctcgacgtgcgatctcgtcgtcggatacacgtcncacgcgcgcggatcgcgtacgggtacatcntntagtatntcgtctgtcacgattcattgcatccatgtnccagctggtggacgcggagtggtgtgattcntacgtgatgtgcgcgtctcggtcatatagacagcggcngcgatgggagtgtatgatgactgngatacggtgctgatagtatgctctgagtctactcacgcacgctgcgtcgctcgagtgtgctcnctactgagaatgactacacganacaagtcgnacagctgcggcagaatactctctgagcatgctctcnggctgtgtatagtggtnactatcgtagatcgtaatgtagtactcntcttgtcatgatcgacagtgtatgatatatgactgtgtcgcgncgtntatgcancnatatcgtgcgactnacgagagatanacaattctctgtantcagtcatagcgagtatagacaatatagagcacagctaccacctgcacgtatgtgatgtacgtagactcctactcgcgcgacgctggacgcgtgctagtcgatgncagcataacngcgatgatgtcgtagagtagcnacntcatgagtctcgctagtgtgcgnatgtcatcactgtgacgtatgtcntgccncgcntccagtccagtctgctggtcgtcgatcgccancnagctactgccngaccagcatctgtcgcgcgncgtcctagcgagtcntgtcgagctcacntngcngcgtctgcagacctgcgnacgcangcatacgcntcgcacgtgagctgctgnntctntgntgagtcncgtactgtcgccnnantctcgatnactacatcgcacgcgcgatcccgacgntcatgagcngcgcgtagcgatcgatgtcatcgacgactacacnatatcancgaagggcnagcgtctcgacagntagtcgtnccgctgagactgtgtngtcnnctgaccgacgtgatgtg

SEQ ID NO: 20385 - DNA, 1136 bp, Homo sapiens
  misc_feature (1)...(1136): n = A,T,C or G
tacgtctcacctctccccccacacctctacctacatttcctctataatatatttccctaccaactcatctactgacacccaacagatctaatatacccataatacactactctatctatctcattcccgatacttctcactctattactccacctagacgtcgtcgccccaaccaagtacacattccactccctaacagtaccaatagaaccttaatatgctctccactttgccagttctgctcatcaattctaagtccttatattcaactcccttgcttcaacacttctaccccgccgatacactccaccctcccacccactaatcctcccatatccgcaatcatacaaccatcccaccaccaacaatcctctctctcgccctatctaccattacatctcctatcctactcgcccccctccctcccctctacctcgctccccacccaccccctactctacccgatccttctccatccatcccttccatctctaccctctctctatttccctccccccccctgtataacttttttctatttcatcacgctccttattcctttatccaccccacacccaccaccactcccttcccccaatcagccctatttccatctcactcatttctcactcatgcccnaccctgtctattctaccaccactttcttcgcacactcatcactcgntctctctcttcctctcccgcctccccctcttcttatctacccttcctcttctaatttactatcgctgctacacttcctgctttcttcctcactcaaccgccacactcccccacaccctccacttccctcctcctaactatcactcctcactcactctactcactacctctccctcctctctcanaatcctcattctctccacctctcctctctcacccacatcttcacactgtcactaaacactacatcctcccgctgctccttccgtgacgatcgtcgacgatgcatatctcctcattgcacgccctactgcgcccacgctgtccccaccgacacagcacnaccccacatacaacttccaacactctcacaacgactgcgaactctgacacgcgacatctctatgctcgantgcctatcgatgccatccacaatgtgctcaccgcctcag

SEQ ID NO: 20386 - DNA, 1343 bp, Homo sapiens
  misc_feature (1)...(1343): n = A,T,C or G
cgtatacgggagggatgtgcgatcactgagctcattatacttgtcggatgtagtcagaatgcacgctaagggccgagataggggacaagttgagcctcggcgtctgtgcacgttattgctcgttctgtctgtgagtttcgtgcgctaagtcacgaggcgtgggacgagcggcaaggagcgccctcgacctgatcgatttatctagcacctttaggataactcgcgaaggaggcgtggccagtgatcgaccagtaaataccaattgcaagaggggactgtggggtaagagtgtggtttgtgggtctagagccactacgtgctaccagggacacgagcaggaacagaggatagagggtgtggctcgctgtcgttccttagacggcggtcgtggatgatgggtttgatagcggagccggaaataagcgtgttccacaaatcaatcagagacgccacatacggagcgcaggcaggcccgctgaggctgtatgctccacaccacacccctcactcctatatttacacagagacgaagccgcgccgcggcgggcggggcgcacgacagggagacgtttgctcgcccggttactgtttctaacgcctctcaccgagtctaaatattcgtgtccatccgacgcacctccgcgcgtcactactcagccanacaccaattagactgcatcgcctgacgtcactcaatcgggacgcggcgcggcggcggcggcgcctccgcggcgacctctcagacacgtcgccgccgcatactcgcctagtcacctcacaaacgcaaagacataagaatntccgcatgactgatgtgagcactanagtcagcgtaatcacagaatacgtcatactgctcctctgccgcacgacaacacaanccncaagactagatgcagatgatngtagtgttgtgcnttcgatgcaacgcgcatggtcntgcctggaactggacgcnccgccaacgaagncatagaacgatgcgtgcgcagagcgcaggttatctgatgtctatcgcttgtgattgatggtgtgacgttgtccgccgtcccgtctttctatacgctatgtctcgcgtagcgggcgtggctccgtgctaatgcagccntgtatagtgtgtcgagagcatcaagagggttgagtgctagtgtgcgccgctaccacagcggcgtgctgacctccatngtagctatgacgtatagcagcantcgcggcccgcgcgcctctgagcccatactcacgcccgagcacgctcagcggtcgacgcgtgtcgtcagtgagtncncgagcgcancccagccgacaggctcgagcgcgaggcgagcacancgcaccgagaagag

SEQ ID NO: 20387 - DNA, 208 bp, Homo sapiens
ctttcctgtgcgcaccatatgagccctcacagatgtttaccttagggcccttcactggcaacacaaagccttattaggatccgaggagaagacagccatccacgaaccaggaacagaacccaaccagacacctgatctgccagcaccttgatgttaagcttccagcctccaaaaataaatgtgtgttgtttatccaaaaaaaaaaaaa

SEQ ID NO: 20388 - DNA, 201 bp, Homo sapiens
ctctcttaatatccaccgctacaggctggactgtaatggtgcaatcttggctcaccgcaacctccacatcccgggttcacagcctccagagtagctgggattgcaggtgttgtggctgttgagctgaagtctcaccatcatagcttgtgttgtaaagcaaggtctgcaggccaaatttagcctgctgcttgttttgtaaat

SEQ ID NO: 20389 - DNA, 740 bp, Homo sapiens
gaggatggaagaaaaccatgaaagaacgggctgaagagagaggagctggccagaaagggaccggcccacgatatactaaggtgggctggtttgacacgggagcttatacaacagaaatgatagcctagttaataactaaaacagatcaaaccacaaagtaattgatgttgtagagaggaccttagacaagaagagaagggtggacatgcggggagtaggcaaggaaaacgggtgtcaagccaatcagccaagaaactcgggaatatggtcgaggagtaagcagcatacacctcaaagaaaaagaaggtaaacaagtatatcacagtagtagtcacagatagtatagtaagttaaatccgtaattaaggaaataacaagaaatattggaggtacagtgagaaataatgtaataataaacaaaaaaagaacggaatagtaggagagtagataaaggtatacaagtataaaggtatttaaaagaaaatataaaagaaacattaatgaacatttgaatagattataaatttatttaagagatgcaaagaataaaaggaataaatatatgatgagagaacggagatagtgatgagaagaatacgaggataggagtaagagggatggattggtgaggtatgtatattatcgatagtattatttgagtctactatattcgttttatagggacgacgtgacagtcagagaaacgagtatagcgtagaaaagaataaattatgagaaat

SEQ ID NO: 20390 - DNA, 534 bp, Homo sapiens
  misc_feature (1)...(534): n = A,T,C or G
ggggcctttttttaaantaaaccncccggnnacaaggganggggtttnccccaatgnttggcccggggttgntntnggaatttcctggacctcaagtgatcttgccccccntcgggcntcnggaaagtggtggaaatttacagnaaggctttccaacaaccagtgtaaagacttagaatccccagnagcctntcaattgcatgnccacattgatgtgaagaggtgtgcattnatntnaacaacaattcaaagtcatcccaggaaacgaaacctcaagaaatgaatgaaaataaatttctttaaaaaactattgagaaatgacatggtgacagatgtcagtttcctactgagatgagtgaagcatgggaatactttattttaaaaaattaaacaaccagtgataacatgcaagaaatacccagaagcaccctctccaatgcatttattttctatgtgaagttaatagaaaatttcaactcactacccaaaattaagatcatgaaattttatatttactcaaattaagttttaaga

SEQ ID NO: 20391 - DNA, 811 bp, Homo sapiens
tggcatgttctgctgaaatttgtttcagaaggggacaacatcccagatgcattaggtcttgttgagtatcttaatgagtggcttcagatactcaaaccacttgtaagttctattatagcttaagcctcttctttgtctggttgtattcattaactcgcactttatatactacctaagtagaccaagtaagtgaacgtttgtattaaatatagacatatctttacataaaatttagtttaagctgaacttttgaaaattagaggacagttaaccaacctattatttacagttttttcattaaagctgactttccaaaaaggaaaatccttagttcttcattgtacttaccattcatgttagattaattatgccagacatagccttgcaataataagcaagccttctgtggaattcaggaattttcttagggaagtcaaaagtattgctatgggagcacactcgacctattgaatatgtacttacagctggatatctttctctattatgaaatggagagcttaccccccagggaacgtgagtcatccctttaggcataaccgaacacttgagcatacgggcggctttctaagaggggaaactagcctcttatttactgcttttggccacaaaccactcggccccaacgacataacgctggaatctcctcttaaagcctattctttgtggatggggagtctctccttaaggacttcatgtccaggcttgctggagtagttttacgcctcgcgacctaactaaatctgtcctttaatcggcctgaccaaacacaacttcttctctcataacccaa

SEQ ID NO: 20392 - DNA, 341 bp, Homo sapiens
cttcagtctctcgcgatatgataccatctgttttgtggagtattttgccttggatctcctgatggagaatggggagtgccgtggtgtcttcgcactgtgcgtacagtcatgagactagaataagttttagcctagggacagagagaaggccggtgtgaatgagcatagtcaatgaagatatgagcatagacatttgtattaatggaaaagcttagtcatactaactagacaacttaaatctcagctactatggaagaaaagttctagcacaccttagaactattgcggatttagttgcaaaccacctcaataaaatcagtatcttaacaaaaaaaaaaaaa

SEQ ID NO: 20393 - DNA, 757 bp, Homo sapiens
gggcttctgctttgacggaggttatgaagaatacagtggaaacaaacctttgttcatcaaatacataggagaaggaacaccatcatacagtgatggaagaattagatgtggagatattcggcttgctgtcaatggtcgaagtacatcaggaatgatacatgcttgctttgtctagactgctgaaagaacttaaaggaagaaggactctaactatagaagcttggcctggcacttctatatagaatcaatgatgggtcagaggaaaacagaaaaatcacaaataggctaagaagttgtgacactatatatagtctgtaacgctttgtatttaaagaaagaatccactgtaaaaaagccatgaaaagtatgatcatctaatgaaagccagcctcccctcagaaaatatgattcccaaaaaagcgtaactactacttatttttgcagtgggggaggatttcttatttactctacaaggatagtttatatattctcgtatccataaaaaagccctaaaacaaccttaaagggatttggataccccaccggatttccaggctggtgtgaatttaagaattgcgcatatgctggaggtcgcccacgggacattatgggcctttttagtttacagctggaaaatttcttaaaaggcgcgggtagaaacggtgcttccataaaccggaataattttgtccaaagcaaaaaaaaagtaaaaatgggcctgttgacctcacgggggaaaccttgaggccgtttccat

SEQ ID NO: 20394 - DNA, 996 bp, Homo sapiens
  misc_feature (1)...(996): n = A,T,C or G
aagagaaaagagcacaggccggcgcgccacccccncccccctccgcgggccaactttaaaagaaaaacaaaaaaaaacttaaaagggaaaaaacaanaaacnncnnnnnnnnccgnnggngnagaanatttttaccangaacaaacacaccccaccaaccaccacaagaaacgccaaaaaaaagcaaccggcgacgaaccgcgaccacaacaaagacaaaagcagcccacaggaacagaccagacacgacacggcgggaggaccacagcccgcgacaccaagaccgcaagcaaaagaaaaacgggcagacccaaaagcgggctcgtttgtgcagcggagacgacgagcaacaccaacgcgacaacacaaagcaagaacgcgaccgaggagacgaacacaaaagaagagagaccaccagacgcgcacgaacgacacaagacgagaagccgccaccagaaagaaggagggaagcaggcacagggagaggaggaacgcgaaaagacagcgaaggcgcaccagaaccagaacacgagaaaacagagacgaccaacacagacgcggcggagacccgagacgggcgggagcgcgaaggaccggaggacgaaagaaaaggaaaaaagaacccaccaaacccacgacgcgcgaggcagggaacgaacggcaacgacgacaaaaacacaccgcgcaccgccgcgaaaaaggcgccaaacgacggcccagaaacgaaccaccgcgcgagagccgccaagcggccgaaagaaacgaagagaaaagacgacggggcgcagcgccgggcccaaacagcggacaaagcagagagaggaagaagaaaccaacaccacccgcaccgcggggccgagagcgcgccgggggcacaaggagaccggcaccaacagcgaaaaagacaaagagaaggacgcacgcgaaggggacgaacgcggcaagaacgagaacacaacaccgcgagcaggacaagggagcaaggcggggaaaggg

SEQ ID NO: 20395 - DNA, 831 bp, Homo sapiens
  misc_feature (1)...(831): n = A,T,C or G
cccaatctcactcctccccctctccccacaacccccgcccttanagcaacactgaggggtttgggacacgtgaccaatggagacttggctggagaggccagcctggttggtctccaaaggagggccctacagatgtgtttcgaggaacaaagtgtccacaaacttcctgtgcctgccaggaccgtcactcccaatgtgaagaaaagggggaaagacctgtaaaagacatttacagcaaaggaacagttttgttagggcctgtggtcttcaggttccagcgtggcagcctccgaatggtactagtcacaatggtggcagcttcctgaatgcctgctgtgcaatcatctccataagtccctcctgagaagttggatgttggcatgcccatttcaaagatgaggaaactgacctcccacgaggttagacaatataactaatgtctgcaccgattacatccactcctctttgcctacaagcttccgtttccgcaggcagtctggaaacagccgatgcaaacgagagtaaagagagaggcaaagcaccactcccccctgcgaatggtgttgtctaacagtccagagccaaaaacttcatcaccaaatgcatcgaagccccctctatcacttcttacaccctcgacatcaatccatccttgaataccataccgatggccctgctgccaataacctccactttctcccacttcccattaataatccgccaggcaaccctcccatggccactcaccttaagatcatcccgtgcccagtagtctgacagagatatctgcgccattatcaccaaaacggctccgcaattcgtcggcacacc

SEQ ID NO: 20396 - DNA, 699 bp, Homo sapiens
aacacgggtgaagcagtttgaaataatataagcttgtggccgttatgaatatataaattgggacaatctatgatgtggaacataatatcgggtttacaaaataagatatgtattaacacgaaaagggaaaagaacggagaaataaggcagaaagcgtttgaggggagacaaagtagttaaacatataatagatccgtaaaagtgatgtgaatagtgccataagtggaaagggggggatgagatgataggaaagggaagttatccagtggaagtaggggcaaaaaagagtaaagtgaaagtaagcaaaaataaaaaatattaagtttaggaggataattcaagtagcgctcgctatgggtggggggttctttggggtgcgaagggaagatattgtaaaagagcatttgcccggcagcaattgcgttttgagggcactgggtttgttagggaaaaataatccaaaaaggtttggggtcatacacgataatggtagttaggcacacacattgactgtgtgcgtgtggttccaatacactagctaaaactggaggtcttcggctaaataaatttttttaacagcctaggtatttccatttatacagtggggatgttaaaaacagtaccttaccttttggtgatgtgttgaagactcatggttattacatacaagtggtttataaccaaacaaaaaaaaaaaaa

SEQ ID NO: 20397 - DNA, 722 bp, Homo sapiens
taaactagctcaccccactgttaggtatagctagtattgtttcgctgcagggctttttcagtaaatttgaaagttattgaaaaaggtaccagttcactttctatacaatagcttggaatgtgaatgtctgaaagaagaaaaattcaataaatgactatgtagttatttggtggaattcacaacataataacaaaaaaaggttttcagctttgatcataatggaaatgagtcatttaattttaccctcagtcctggtacacagtttcagcacctgctaagaagtcggcttgcatttaaatgacttaggcaattattaaaagcaagtttcaagaaataaatggcatttatataaaaaggagactgggctcaagctgctagtgctttaaatttccataaaagcaaattcaagttcagaacaggattcaggatttagtaacaattcaaaggttttcaatcccttaatctctttgtgataactatattcatcatgtagccatttttaaaaggaagagaataaaaatgttaacattgatgtctaccagcacttgtgactgaaaaattgattatatatggtaaatacttatggctccaaatagctatttgatttataattttggtattgaaatgtaatgaaatacttctattgcatttgcaatcgctggaagagtagtatgaatcatacttcaaataaaaatgcttctttttaaaaaaaaaaaaaaaaa

SEQ ID NO: 20398 - DNA, 928 bp, Homo sapiens
  misc_feature (1)...(928): n = A,T,C or G
caaaaactgctcgtgccctgtgtcccgtgttaacagtcccgctctctcagaacgtcatcggctgtcattacatggtttctctaagctttagctcctcactaattcttganccctccagcgccagcctcagattcaccaggggtggtcactatggcaggcatcgtaacacgggcagtagaaacacaggcgcacatacggtgcactatcaagaacacggggtagtacgtcataatcgtcacgccaaattaacggactgcgattgggattcgtcgaaacacgaagcggaccacgtgcggaaatgattgtcagtgcggtaccatatatatgccgcttaggtatccggtgccaacaacaaaggatagcctaatgaggctcatgcacgaatcagncaattggccatgcaaaatacatccggtcataacgtggccggaactaaacgcacggaaccgtggaagaggcgcggatcatcggcgtaacaacacgtcggagtgtccaacgcaggcactagtcacactggatacacgtgcacaccgactcaacgcgcgacgcatatgcgcgcggcgcgaaacccgcctggcggactatgatacgatgatatacgggcgggccggcactgacagtttacgaaggatccgtgaacacagtgcgggggaacaggacacctaagtgggggtatccccacctcgcaccatgactcgtaccgcgcggcatactcatctacactaagctttcgtacgagtgtacacaataaacaaacatggcgttcttttaatcagtgtgctgccttaactaaccactcttcaacattaccccctgcagcatgggtcctcgttccctgctaggggatagtcagtgtttgttcctttagtcctggcggtatatgccaattatcgcaacagtcatccctattcaaaaaaaaaaaaaaaaa

SEQ ID NO: 20399 - DNA, 1425 bp, Homo sapiens
  misc_feature (1)...(1425): n = A,T,C or G
tgntcatcatcctaagannaagattagtagatgaagnaagtgatagctgaggtgactatgtagtggngaagatgtgtgccatggtgatgctactcagtgacttgggggcgtgaccggggggtggactaccgctctttacactgtcgcagtaagnctgctgcgatggggttctatctctcacatctactaccgattcgtnnncctctttaccgtctatttatacgctctttgnnnncctcactcttcaccgtctcactgagaagtgcgtgacgttaacttcgacaatgnaccttgatattancacctttctatttgngtctctcgttatggcgactcatgacatatgatactttagtnaagtaatgtgangctatgtcatccggcgcagcgttcaaaatcgatagatcacttatactcattgtttatcgatattcgaacgtangcagccgcgtacagcgtactatacctgagcactacatattgtaaagcagatatcatactgttacagtaacaataatgganatcatcaccnatctcataactacatacagcggtgccgtcgtgngccttctcagccactccgcgnnnnngncantaatgcgaaattaactcctatcgctagagacaccgaggggnnggaatgaaggngcactatatataatgactaatatagctggaacctctttanngactgcaaacttatattatattagaacatatatanagggaccatccctcatcacatacatatctacgtantatcgcatcgcgtcgcaccgtctcgctctctcatacccacttctcccgagaagaggagatatatgatgtatatattataattgtgttgtgtgnatactgnacaccatgcgatgtccgagcggaaccaccgcggnnnngcaagtattctcctctcctcggatctnaaacatcacaccacactttccttatgattgggtcttcacctatactctcatgagtcgtannaactacattaattatgggacctctggcctcttggcctcgtacctggcgacgnggnncgtcgagatctcgagtgcggttctgttgtgttctctgtgctggnagttgttnacgccacgtgngctctaggcacactagtgcttcttatnnnncatattcattctcttaaacttattacacatatnactatatcatcctcttctgtcgtatctctgctnnnnctcctctctcctctatcttctgtgtcnnnnntctctcctnttgtcttctcttctctcttgttaaaaagtgtttttgttctcctctncgtgtctnttcccctcttntaaagntctttctcttttcnttnnnnncngcttcctctcttcnctctccncctcctcnncccttcttcctcnnnnnncacttctnnnncctctcttccttcttcttnctttttttccc

SEQ ID NO: 20400 - DNA, 889 bp, Homo sapiens
ctcccgcttcacctaacaacgctctaccacactacagccccctctcgcgttgctgggtactgctcctcggtggtgctccttcttagacaactgtgaccgctataatgtagaagagaatccacatagcacagtctatgatgattataaatttgtctccaagaaagaccttgaaaatttagggctcacccacctcattggatctcctttcctccgggcatatatgcatgggcgtcccatggatataacactctatcacaacgcgaaacctgatggcagatccatgtcgcccatcacgaatattcgattgatccattactaccacagaacccaaaaaacttctgcgctgagcaggtctgttaatgaacttagtcaattgcgtaaccatgtaaggctggcgctagaatgtactctgcggaagaagacgtatatccatgcctcctcgatgggaacaaggagagcggcaaagccctccctgtttgtcgatacaccgctagaaccggtaacagaatgactagacaccaacccctgctgtccccaaagagcaaccacacacactcgctacagtgtctcgtgttaccaaaaagagctttgactcgcgcaattcgcgcgcgagacagcgttttttattctcactaaccatggcgttcccatcaatacaattgactcgaaaagtaatagacgtggtttgcaatctgtttggtattttaatgtataggtgatagaggtacgccagcagagccggcactcccaccatgtcgtcggattcgtaacagcgcctgtcaagcagggtaaacaatcaaattccaatcacacacgcccgcccccaatgcgcgccgagagagtatcaattaataggactgaccatcacctctccatcattcctcctact

SEQ ID NO: 20401 - DNA, 794 bp, Homo sapiens
  misc_feature (1)...(794): n = A,T,C or G
ttcttagggacttactttgtcctcaggcgggnaactagtagtgtgatgatagctcactgcagcctagatctgtccaggctcaaacactcctcccacctcagccccatggggtagatgggattacaggaacctgaactctcagcaagaatgaacgtatagaaccatctcaaatttagcggctaaggactaggtccttggccagaacctactgaaggctctcaaaanatggaggtccatagacacagagtcccatataacattacatcaggccaaggtcatgggattagccaatcaatcacatactgtaacccagaaactgtctgcctgtaagaataatgaaatagtctcctgcaggtacagatgaagaccagtctggtgataataatgtaaagaatggggcaccatactatattcgaaactaattatcattgtatggtgtgaattctccaatatatttaatgcatgggtccaagaaccagataaacataggagttatttcacttgtcattatatctcgtaacccattggaggaatctgtgtgcactatccctgtaactctgagatttgtgagtttagagaacccgtttctcaaataagaatgctactattaggggacaaagaaagagtcccattaaacttaatctatgactgccatccagttactttgagctcacctgcccacagaccattgatgaagaaaggaatcaccattctgggaagagtcatcgactctgaacatcaggaggggatagagctggttggctcagaggagtcaaggagaatatgtgtttact

SEQ ID NO: 20402 - DNA, 1021 bp, Homo sapiens
  misc_feature (1)...(1021): n = A,T,C or G
atacatggcgcggcggatgttatctgctacgagcgtcgcgtgaacgcagtggcgtcgcgtactatgttcggcgatgacggggcggtccacgcaagattaccgcgtggtccgcatatgactgagcgggtgggggataaggaagggcagggaacccggacagagcaaacaggcatacacggtggcgaacccacaattgcggggaacgccacaaggcgtcggacacatttggcttttgtatggcgacgcaggagtacggatgggcgacagtagagtaaagactgagaagggcgggatcaaataaagacgtatgtgaaataggggggcacaaaaagacgacaatgaagaggggatgagtaaggaacatcgaaactggcgaggcgtaagaaagcgggccacgacgggggggggaatcaagaagggaacgggaaataggggagggaacgaatctgaaaaaaaagggtgcagtggtcgtgggaaggggagaagataatgtaaccggtgcatcaagcacaagcggggccgtaatggggggggcgggaccgggaacgggggcaggacatggctccagaggggggggcggggaacgaacaagcgtgaaggcgggggcccggaatccgatcggggggcaataacacggggagcacatcgcggagagccggcagatagacaagataggaacgatgttacacgagaactatggaggggggatgggaagaacggccggcaaacgcacaaaccgaggggtggggggtatcggcgcatctcgggacacggccaccaaccaaaaacaaaactttgaggagacactcgtacacggaccccatggggccctgnaactgctgtttcaggacaaaaaaccaatgacggagtctacgtgcaaaacaggacgatccaggcgcgtggacatggcaatggtagtgagtgggaggagcaacgtggccaaggagctatggcgcgtgcgacacgagaagacatacgacttatgatactacagtagactgatcttatgaggtcatactaa

SEQ ID NO: 20403 - DNA, 1390 bp, Homo sapiens
  misc_feature (1)...(1390): n = A,T,C or G
cgcgngtccttcgatcatctagcngctataatcgtcaataatgnacgatctagagagatgagtatattctagtatatggagtcactatantaactctatagagcgaatattacatctgttctacgttagacgtctcgtctanggagatttacagtatatagtatctctctctgtctgatatggtggttatgttattggngtgntgtttcatgtaatgagctctctgttgcgtgcngnnggagagagtnggtgcacgcggngatccgaaggnnnnancacgaaactgcacttatctcttgtatctagaatagatgtntgctagtaatgtgctctgataatgtgtngggctgcgcgangggcctgatggttgtanncctaaactaatcccgttcgttctatgcgtacttggnaaacgtggagatggtactttgatatattacttatnaanaatcatatttatctatattgtattactaatacaagaagatcgtatctggatgacttatatattatgtaatcatnactattcaattctncgtctctctctataataatacatattcaattacagatacttattacctattagactgtatacttatcatatattatttatttacctcttagtnnngaangccgaattgtnatccacatcttccggcgtcncaacggcgtgttnnattcttcgtnncctatactatcacatactcgtcanttgttgtggagtcgtccaattactattcatatnactanatatanangaacataagtgactatacactanaaacctctctactctatatatgcacaaatantatcgtctctctatctacangcaggaacctccacgactaaccatatactgttaacaagnnnnagtcattagagtaagaatatgaatagtataataatatagggagttgagcgactgttaggtctcgagcagagaagtagaggtnnanangttctccttacttattgtttctancactttactacacagtacaatcttagtgngcattcctattatctcgcctatactnncaatcaccaatatatggggcatgagcatatggcgctcggtgtttgtgnggtagttgctactttttggtctatttttattattctggagaaaccaataattgacataatgactattacacttttnntctatttcgttanttttaaacccatcaatattcatcattattcaattttnntnatttctctattcaacaatannaaaactactgtttccttcgttggtnaaaacagtcgtgtgctagnntggttnncgatttnaaatcttntcctctttnnnntactgttaatcttcttccccnctcacttttttcncncctccttnccctccccccttncccctcttcca

SEQ ID NO: 20404 - DNA, 772 bp, Homo sapiens
ctgacacaaactgaggactggttaaatgttgtgatgactgcaattcactgaaacgaacatggtccagttctttaaaatccccaaatctcaagggaacatcagggcaactggggctcatctcgtatttctctccttcctcctatgtggacttgaagcaagccagcaaacagcctgacatgataccctggatggatgagtgtgccctgttgacacagcttcgaagaacattaaccatatggaagcaatttcacccatctccctgaagacacctgggaatgatgaaagtgacaagaaatggcaccggggactccttctgtataccacttgccttcacctggtggaaatagtgagattagaatgtaaatgtgttcagaaagaagccagactttcccaaaggtcatcagaagaccacagctcagcagcctgtagacactcttcaatggttctgggctcacctacctgtcttaagtccagagtgattgtgacccagtgatattccctcccattctgaatgctgggacttcgccaccagttattggtgccatctatggcatgtgatattggatggcgttctgttgaaagaaataaaaaacatgaatcctctcgaaaaaaaaaaatcgcgctcatgggctcaacaggggagctcttccggcgcttcctttagggagggttatccatgatcctccctaactgactcgttgcgctagtttcttcggctgcgggaacggtataaactcacttaagagcggattaccgtattcacataaaaagg

SEQ ID NO: 20405 - DNA, 807 bp, Homo sapiens
aggtaccagcgcggcaagagcattgtagcacccgtcgtcacgctggttccctagcgcagacttggaatattctggagaatattcagaggagcatgggtgcttgctctgacatgagtctcagaggtgcagacacgcacctgcaacgtcctaactttccttagaagcaatttggaactatcaaccgcaatatatttatccaaagtccctataaactaagactttctggcattctttatcttgaagttgaaccaactgaaaacaccctttgacgcctcgtttgcctgtcctactgatgtctatcaccttcgcctgcctgatcccagccccaccagaaggtcataagcgaagtggccttctcagaatgcagctgctgaaggttcagccacacagaatccatccaggagcctcaagcagccagacctcaagcctcttgggaaaaacttctctttcaaaataaaggcacgagaatcacgttctgtcagcgcagtcgccactgtctggaccgctgcacaaaagcagacacgagtggagtgaggcccgcggcggagccctccctgcctcctggcggcgtgggctcaggccagggccagggcgcaccatgaacccggtcgcacggaggacgtgacttcggccggcggggcgagactgacgcctaagtagagcccatcttgacccgaattcttgagctcgctgctctcgggataggtgctctcttccgaccagacatcaccggggcacccgcctggcagaagagggggacacagaggaaagaccagaagcccaagcatgttacccatcaacaggcag

SEQ ID NO: 20406 - DNA, 807 bp, Homo sapiens
  misc_feature (1)...(807): n = A,T,C or G
cagggtcaagaaccagagggagagttcacggaccattcaaatcgctagtgaccaagagaactttactctcggtgacacttctgactagactctactgctctatacgacacctagtgttgggctgcgattcttgggagcgtgcctggatgattacatactcctgtgtataaaaaacatanactatgccttatgaagatatgatcgtcattgctgtagaggctaacatatgaaaccgggctattgggaagagatcctctttaatttatctcttagccgtctgttagcgacgtcttggtagccatatgtctgaacataattacgacgcggactcactggaggatgggaccttggtctcagtgaactcacatgttgagcgctgttctgactttcaccgaaatgaggggtttaaagcagctctctctggagactgtcgtcttcgccgtgatcacctgattgaaatggccaccaagctctatcgcacaactctcagccaaaccaaacagaagctcaatattgagatttccgatgagtacgttcatgtattgtttgaaaaccctgtttctctttcagcttttttgttttaggggagctctcgatctcattcattaatacaactacttattaagtaccaggtatgtgtctagtaggtgttccacatgataaatgggctgtgaatgacactgaccaagtctccgacctcatgtacctgacatcctagtggaagagaccagtatgtacaaattaaatgatgaaatagccgatgagaagttggctaacaagtgttcatggacgaagaaaagggtaaac

SEQ ID NO: 20407 - DNA, 1635 bp, Homo sapiens
  misc_feature (1)...(1635): n = A,T,C or G
gagagtggnnnnaaagtgnnnaaaggggnnnanagagngngnnnnaanngaagtaggnnnnnaaannnnngagaaggagnagagtnnagaagaggggnngnnngnnnnnnnnnggaaaggagatgagaagggnnnnaagngnnnagagagagtagtgagatagnaatanatagataaatgtgagnnnnaaaaanggaaatatgnnnnnagtaggatgtgagtgagataaggngnaganngangagatgagatgaaaagatgagagataganagnnagaagagaaggnntagagatatgtatagtcnccacagatcagcatacccgagtcatcgaatgatagacatgcacgtcagtatagatatagtctgacagtgacagtggtcactcatactgtctcgagaggntntnatatgatcatgagtaaatatatgtatacataggtcaacgacgctccacacacntcacacaatgctagtatatgtgtnactnatcgtaatgcgtatacatacacacacattatacgagttnctcacgtcnanatcgnnnnccagcgctcactatgaactagtagatagatagacgcngntagaactagttgnnncaagagantagcagtagttnnncgagagttagataagagctaccaatacgtgtaggatccccncacgcatgcgcngctaagagatattatacgagataatngtatgtatgatgtagattctctgtatcactcgtcnnntatcgnantaggataatngtcagatgangtaagatccantctcnnatcacatacaacncacgtacgaagccancgtaatangcncnnanatgagtgtacnncnacacgatacatctataagataagtacacntcgtaagaaagctnacaatatgncnnnagcacatctacgaccatagaanatggcncnagcgcgctagacgcacacgtccgtgcgcnnaatcgatctatgtantattcgcaccacgacgcagcatgcactacgtatatacgagtctctagacaatgtgntnctcgtccacacttacnagcgaacatgcagcacgcgcgtgtaaagtgtggagtcactgtannnacgagaggactgaacacgatcgatacgccaactctactnccaatcactccaccaatacggacagcaacgtagattactccgcgagacgtcnnnaccacgtagcatctaacgacatccacacgactcatgatcccacttactggtnctcatactatatgtaactctcaatatcagatcncccaaggacgatagtccccactgtaataaggttcaacgtaactgcnccagtataatctctntcactcagtacgttcctccaacagctcgacgacctccatagactnactcacgactatacaaacacttagatataccactnaatgtagaggcacagacagatagcaatgaacacagccacaaggctcgcgccacgctagataagagaactacncaacgaaagcatagaaagattcncngacggagtgagtgtgtcataggtccatacacgctctatgctgccctcgcttatctattnnnctcatacacgagcgcgctaaataatagaatagntcaatcgtacnccgacaagtgtacatactat

SEQ ID NO: 20408 - DNA, 793 bp, Homo sapiens
agacatagggcgtcctatgttgcccaagctgatcctgaactatcctcaagtgatcctcctgcctcagcctcccaaagtgctgacaacactcctctataatttgccaaagtatcatacatgtgtgaagggaaaacgaacagaaagacattctcatactggaaagatttagaaggcaatttacacatgtattcttcttaaaaaattacttgaataaaattacagtcttttaaaaaatgaatcaaaacaaagctcaaatatggaagttaatgtaatttttaaaatgtattaagcaaagaaaatggaatatggttatgaaaatggaaatgacaaagtaatgattgaaagagaagacagataacctaaaatgttcattatcaaaactttaaaatcttatattgttttcctaggtactagagcttaggagaagaatagaagaaaacaaagatatggtaaatttctcatttaacaaaggtaatcagtagaaacaatttgtttcctgatatttagggaaaaatcggctcacaatattagaaattgactcagtcatcttataattaaaaaagcatgaaattacaaaaattatgaaacaaaatcttgaatttttttgttaaaatatatcataaaattgaaagaaaaaaactggaaaaaatattaacatatacataaaacatcttaatatgaaaagagtagttataaattaatcatttgataaagtctatgtagttaatttaaaaggcatgtcagacttatgtttcggcgtttaaaattaatatatacctatatacacatacac

SEQ ID NO: 20409 - DNA, 1042 bp, Homo sapiens
  misc_feature (1)...(1042): n = A,T,C or G
ctttccttcattataacgttatacaactgatgttgtgctcgagtcattgtatcttcagtaggaaccaaacaatcatgatctcatgaaaaactccccaaactgcaggcacaagtgcgcattggtgggaaaggaactgctccgagaaagaagaatgtggttcatataacacccacagcatattaccccccacccactctcctcttaaacacaattacggctcaaccaatcattttcggcctttgaaccgcgcaccatcgccgcacacctttgttctctgtccccctttctttttctctactctactccgtttccttcacatacacataccttccttctaactacccctctcccctccctctactaaacttcactccactcgcctccgcgttgacttctactcctagctattttctctctctgtctcccccctttccctcgaccctttcttctcccccttctcccccctctcactcctctcttctcttccacgccacacctgcatcacctcgataatctactcactattactcgatctcgccctgtcgctatgcgtctgtgttacatctctctatacgtcttctcgtctaactgacacacttattaatctactaactctcctcgcctctcattacttctatgtcctataatctttattttgtccctcacccttctctatctatatttgtactacgatcgatcttcgagtcgacgaggctcgtccaacgcatccgatagccaacacaacatacaccacatcgcgttcaacacgataactatttcaccaacacaacgccctgccctctcttccgtcacgtcaccctctctcgtaccctacgctctaccgatacctcccgcccccgactctctgctagtccctcgtcttctgcgcgtcgcctccctatcaccacaatctcgcgcgcgcactatcgtgaccctccttgtgtgttttcgcgctacgaccgctactatcgcgctantccgcatcgctactgtactctactccatccctcgacctgactatatcgtctacatgcttangcct

SEQ ID NO: 20410 - DNA, 1292 bp, Homo sapiens
  misc_feature (1)...(1292): n = A,T,C or G
gttggttggtgttttgtttggttttttattgtattgtgttttgtgtttgntgggtatttttgtttcattatataaatataagatggaggaggtgtgtggtgtngataaagtgangnnngnnaggntagatntgttnnnnannnnnnanagaannnnannnnnnanaantnnccaattannnaannnnnnanntnnnttnnnnnaggnnngnnnnnatgannnanngggnnnttnagagggagtgggngantaaatataataatatattgtgtatgagggnatcaacaataaaacgtctctccgcacgatactggtcgtgtgagttagttggtaagtgacattctctatctatcatcnagttgtttatcttctttgtgtgtatangatgtgtacgagtgcgtgagagagagcctnacgcgtcaggaggtggagcgagtagcgtgtngnccccggtccgcatgcttcgtggtccggtgcgctgtgtgttgggcgttatcaggaggtgtgtgcgcggcgccggcggcgcgcaggnnggagttgtggtagccccccggtgctcgacggtatcgacgcaacggtgtggcgcgacgtgcggcgcgggaggaggtgtgnncgntaattagtgatggggatggttcgcggggtggtgttctggtgatggtgtttagtgtgtatattcganttattattaganctatggtctgtatcgcgtgtcgtgtcatgtgcgctctgaggcgcgncgccactgtgctcctctctccctccttgtgatctctttgtactcctccctctctgtaattcagaagactgtcgctaaaattatatctatataaagacatcgcgtgcgtacgactctctgtgtgtggatctcgtgctcctgtgtctattatttaggtatattatttataattctattcctctttatatagtggtcgactgatgtgtgttgaggttaagtagtacacgtaccgtgtaanctcgtgtcctgtgatagtagttaatggtgccgagttgattagttcaggcaggtgtggtgtatgtatataaagttgtgcgcgtggtagtattggnacgctgcgtagcaagaagcaggtgtgaccgcatcagcgtcgtactctagttagggaggntctattcgatagattcgttacttgcactaacggactgtgacnctagtgatgtctagatgcgttacagtactaatagtttcttatgtctatagtagagtatgagtgtgggccaacagtggcgaccgtagttcgagtaggttactatgctctcnatagtgctag

SEQ ID NO: 20411 - DNA, 745 bp, Homo sapiens
tgaggacacagccgtaggggattggataccaaactctgcggccagtgcaggaatatggagagaatgcaaggcggcagaaaagatttttctgagggatgcacggagcggcatcgagtggcaggattaggagaaagatgtaggagcgcatgaagtggaaaaaaaagcgagcaatgatggcaaacgtataattcgcattgggagtaggatgagagggccgcagtcttgagcgcggcgtagtgaggagagcgacggttggcgtgtgttcgtgattagagaggtgagcaaagaaaaatatagcgaagacagtaactatttaacatgtaaaaacaatcggggtggtcgagcggacacaagcgcacgacaatggcgcgggaataaagagaggtcataaataaagagcgaccgatggacacattaaatagtatataataatatacaaatagattaagtgattatataaagtgagaacaatcggacgacgattgagccatcagagaggaactacgccaacggtgtgaagcacggtgtgaagacagctaatggaatacatggaaactcgagaaggagaggtgacacaggaggagcagttagcatgcagaccgaacagagagcacgagcgcccggtgaggtggaggaagttaatagtggtccagcgaatctaagatcaacgaggtggagtagggagcgactgagatgggtcgaggggtcacaagggtttaggtgcgagaaagagagagtaaaggga

SEQ ID NO: 20412 - DNA, 770 bp, Homo sapiens
cctggttgacgagcagtggtgtgttctgggctcactgcaacctttgcctctcggattcaagcgattcttctgcctcagcctctggagtagcttggattacaagcgtgcaccaccatgcccagcaaattgttttgtattattagtagagatggggttttaccatgttggccaggctggtctcaagcttctgacctcaggtgatccacccgccttggcctcccaaagtgctgggattacaggcgtgagccactgcaccgggccaaccctctatatctgtgggtttcatgtccatggattcaactaactgcaaaacaaaaatattaggtattataagtaatctagagatgaaaattacttaaattacaatcatgcacagtataattaccttttctggccaaagatggacttcatacatgatagcggttccataagattacaatgcactatttttactgtatcttttttatgtttagatacatatatagttactattgctttacacttgtcatagtattcagtacaataacatactgtacaggcttgtacgtatatatatagacacatatatatacacatatatctcaaaccatcctttgctggcattaaactctccagctgtaggttcttcaccttgtcaagtgcagtgggagcactccagcactttgggaggctgaggtgagaggatcacttgagtccaggaaattcgagacccatctggggaatagagagagaccctgtctccacacaaaaagggaaaaaaacaatcggcc

SEQ ID NO: 20413 - DNA, 1276 bp, Homo sapiens
  misc_feature (1)...(1276): n = A,T,C or G
ctcacgngatggataatacacgtggacacattatagnaaacgagatgattcacataatatagaggtaagnnngaaacttcataanaacataccataacagnggactgggaggtantcgtagcatggtgggncttgttgttgnattattatctcttctctcgttgntctatatgtttgagatatcgaggtgnagagtgcttgtgtagatgatcagaagtaatagnggacgtcttctgttagagtgtgtgtgtcttcgtggggacaacatattagtactatangnngaggttcgtgatactcgactgatacagactattatatggctgcagtgtacaatgaatngggagatatgattagnggtgcgtgnaagttcgagcagtctttgnnnntaagcagggactggtggataactgcaaccacgtagcagagganagatatgagnaancacnnnnncacactataatgtgganaagagtaaactactaataatannaagagatangttatcataaaaaggaaataattggaaatatgtagcagtagngtgctcgttaggagcangnaatgatgtgagcggnagaagatatgaaatgtngggtggtgtgtggtttggtgttgtggttgggtgggatggtgtgggtaatgagggacgtggatagtcgaggngtgcttgtgtgcgacgatgagagaatggtngattattattnggcggtgtgaaattgtattgaaagtatataagagtagacaaatacataaagataatggaataaatcgngactcataacttgtganaactatacacacttacgtcgtgaaatctgattnnactttagtaaaatatttcatctataatgagtatttgggtgtgggaatggatatactatctgtntaattttacaataaactaatctatnnatatatnnacatagcaaaatccactcattncacattacatnnnctcacataatcatatactcgtcatnnnaacaccacttctttctatacataaaaatanaatttaataaatcctggaaatttgataaaaataagaacgaacaatnaaatccaaatcatcttttttnnaacctaatctcccaaatctatcctnctcaccaccttctnnncccatattgtaaataaacacatatataaattnacattttttacgttngatgacccacattggttcnatttnntccccccccncatcaatnacttntttctttatacctncttactatcttnncacctctccctcctccctncctttatcttt

SEQ ID NO: 20414 - DNA, 280 bp, Homo sapiens
  misc_feature (1)...(280): n = A,T,C or G
cctangttcaacaaccacaaagagattccagaagtaattcagatgcgtgtgaaccanatttccttttcttcgttttcttttaactgttggggtgtttcantaaaaactattttattttcctgtgagtcttgcgagggggaagtaatgattaaatactcatgtggtcagaaaacataaactttttttataaaaatattttggacaattcattaaagggtaatttatgaaaaaaaaaaagggggggggggaaaaaaaaagggggggnnnaaaaaaaaaaaaa

SEQ ID NO: 20415 - DNA, 766 bp, Homo sapiens
tctattttattctattcaactaacaatatatcgttcgccgatgacgagaacttaataaatactctccctaaagggccagtcgtcacatattttatggcgctaggtgtaatcctaacaaagagatatgtaccaaggggctcgtttcgcgaattatggatttacggaagctataaaactacccccgctcaagcactggcacagagggacggagcattgtctagtaggggaggtaaaaattataaagctgcagcataaagcgcgcaaacacgccgcagggggaaagaaccatggccccactcttccctgcgcacgcagggacgccgcttcttcctctcccccatgtgcgcattgtcaccctaagtaggtagaggcaacgaggtgtggtggccttagccgcgtgtaccgccgtgccgggcgggagcgaaaggggggggcggagaagcgaggcgagactggtaaacaggtggcaggggctcccccagaacgaattcgatcgcagtcgttgtttgttttatttttattttttttttcttttttggttttttttcttttttttttctttttttaaaaaaaagttttcctgtcgcgggtggggggtatgagtggggggcgggcgtgcacgaaaatagcgaggattatagatcgattaatgatacgttaacaaaggaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 20416 - DNA, 729 bp, Homo sapiens
  misc_feature (1)...(729): n = A,T,C or G
atttttgcntntnttaataaggagtgaagaatcnttccctgnatttnaannggaaatgggatnattttcccttcntcttaaatttggaaancttttggccaaaaaaaaaaaggtggaaagtnattggtgtaanagttccaagtntangcccncaagttgccctgtggactttccacntaaaacntctcaanagcccttnnntgganggangnanaancccnccatggaancanaaaaaggggttattccccnncnnaggcccnccaatagaccaaggcaagccctcangngtaccatgccaagnttaatttacagatgnaggagcaaancccctggcccatacatcagtctggaaggntagaaggttgaaaatcaaggtgttggcanaagccatgtttcctctgaaggctgtagtgtggtggaaaagaaagagagagctgaggcagccgatgtaagatctgctgttacttcttgctgtgtgaccttgggtgaagtnaagtgggtgtgcctgggatcacacacagctgtgcaaataccaagtgacatgggacttatacaaaggcagcgccactagtcatgctggaagtttccccaagaagcagggaaaattcatgacgtgatatataagaaaaagttgaattgcttgatatggaccattgattgaggtctgcagctgcagttgctgccatcttagaccgactgttcatcttgtaaacttacagaatcaat

SEQ ID NO: 20417 - DNA, 1656 bp, Homo sapiens
  misc_feature (1)...(1656): n = A,T,C or G
gtgggccgagtatgtattgtcccttgacgcgtgctgaactggacatgatgaactagacgagcgcctcgtgtatgcgtcctgtacggcaggcagagtaccaagctcgcagtcacttcgctctcctgcaccgcctgacatagagccgcgctcatacgantcagaatctaggttacgccgcgagcattccacgctcatatcctgctaatgatcgaggtagagaacgcgtatctcgcatcgccgaccgtaccgagtgatcagatacccaacagtactctgatacgttcttctcgaatccctcggcgaccgggcatctgctgcatcactacgntaataccactgtgcgtcatgtgacgagtctgacaggacgtgagctgtcgctgagtccacgagcgcacgagacatgcccacgaagagtcgatgagcgtntctatcgttcgcttagtctaacatatgcagtgctatattgcgacatgtttccattattctacctctcactacgggagaatgacatgagagctacgatatgatagcgtntattcggtatctacgatcatgatagctttgtgtctacgcggccacnagcgctagagctntgcgctgtgcacgtataggacggtaggcatactggcgacagcgancactcatcgatgcataatacngncncgtnagtggtgaatcggtatgagcgacggagacgacatctatcgtctatgangcttgatagntgaacgttcctctcatcgctagtgtgctgcgcgtctgcggtctgagtagtacacgagagtgcgcttgtgtcgtctcgtattcatgcgcgcgtccagtcgccgtcagcgcgacactactagatctgttatgcacgaccgttgtgagctgcagcattnatagtatgtgganagagtgnacaggcctcgttacgcgcnatataacacnatcgnagagcagcctagtgtgatcgtccagtctaggtctntctctgtcgtgacacgcgagccgtgctcgtgcnacgactgcagcgtgacatcagcatgcacttctanactatcgtatgaatctatatagaggtntatnatgtacgcgacgtcacactctgctctcagcacgtcgctactactngagcgcgacgtagacgcagacacgaatgatatgtaganacgacgcggaccatgctccngtacttntgngtacgctgtgctcttcgtgctctgctgacgcgttcatgcgatcaagatatggcngtgacatcgacacgatctcacactctactagtgtgacgcgcgctctgtgaangatgagctgcnacggcttcgtaatcgcaancgagtcgcctgctangntagtgtgntganctcgtatattagtgtacatatcgtatgtgngactgtntagcntagcgtcgacattgtcagtgagcgctacacgctatagtgcagacgctcacgcgaggcgtgtgagacgacacgcgtgnntgttcagatctgcagtagctgtctcatacactcanacgacgtgtgcncatcatctcgactggtgagactgatggactatcgactgtcgatagtagctgtggactcacgtntgcatnagtacataatcgatatacgatcgcgcagatatcctgtgcgccagtcctatcagatcaagtcatgagctgttatg

SEQ ID NO: 20418 - DNA, 181 bp, Homo sapiens
cctcttacatactttgtgtgcagcatgatcttcatcaacaagatttacagtagattgaaggcagagaagatatgaaaaatgaaaatccaaccatctgaagacattgaaagaatttgtaatatataatccagtttgggatgatgaataaaatttttctaatctcttgagaaaaaaaaaaaaa

SEQ ID NO: 20419 - DNA, 1092 bp, Homo sapiens
  misc_feature (1)...(1092): n = A,T,C or G
tgattaaataagaatttcatatcaacgaacaaacacaggggtcaggagcatcctactcagctactttcgacctccttcctaaacaagaaagagcttgatgtgaagcattttgataacgcatcgcatcgtagcngtagagaattgcggtcttacgtcgtcaattgataacaagccgaaccgtggcaaagtaaatgagtacaaatataatgcgaatctcagggagtctactctcatagcccttcgcgacttcaactgatcacatcgtatgataaacacttccgtctctacctatctgagccatactatcctatcatcaacaccggtcggcccatgtcccacagactgacctatgactcccaccattatacttatcactaccaaatgtgaaagccttcgcgtctgatcctgtccctccatcaacccttccatcactcccacactcctcgtccccccttcccctgacccacgtccgctcgaaaagcacgatcgcgaacactaatttcggcataccgtatagacaccctcaccttacatttaactttacagacttcatacctccctccttctcacccccccgccccaccctccgcgtctactccctgctgccacaccgcttctactctcccgcagataatgcctcggctccaccacactcttcacaccacaccccacacaatccacctactatcctgtgcacacactacacgtactcgtcagtaccctatatcaccgaatctcaccctatacctcttcatctcacttcccctcaccatcctccccacccttcaccactcctcctctcaccctctccacgctcccgtaccatcctcacatcatctcatcatcccacaacccagatccaccttcatcactctccagacacacccccatctaccctcactcttctcatcaccccaccccctgaccagctctctgactcacagcgctctcaccataccaactctctcacgctccatcactcagtcctcagcgccctacccactcactcaggccctctctcattcacacactccacgcatcacgcacaagaaaccaactcacatttcatctcacaacatcaataagcaattg

SEQ ID NO: 20420 - DNA, 744 bp, Homo sapiens
aacacctgaaggaaaatacaaactaaagaagttggacacagctcttgagtacggattgactaagcgaaccatgactgaactggctctgtgtttctatctgctgaaggttaaacagaaactcaactagttccacaccatttgggtccctgctgtttttttcttgcagactgtgctattaatttaataacagtgctgctggagtggcggtagtaatgtagatggcaccatttgcattttggacctggctatattagaattgtgatgtcaaagactgaacagtgggctgtagagtaggtttattaaactagcaagtcttccataattaagacagtgaatttggctgaagtctaaaataaatttctcaaagactgaactggagatcatcaacctgaatatattttttgaatacgtcaatattttttctttattagtactttgtcttagtagaaggaaaagagatctttccattactcccactcatgcgttgggctgagtgtacccattctattccccattttttgtttttatattttaccaattatataaacacccaaacttctttattatacgataaccctcggagtctattgttttctatattgtcatattatttataatggtattttttgttttgtttatctgttttagcagataacaatttttttattatattttaattttattttataacataatttttgtatattagttatcaagttttttgacatttgtctgtatgtttat

SEQ ID NO: 20421 - DNA, 771 bp, Homo sapiens
ggtgggggggctgtggcttgtgatgggacacccaaatctcggcttgcttttgcactaaaatacaacttagtcctggagcattacacctttgggaattggaacgatggtttggcagaatagctaaggattgcacaaaatgcccacactctccacgagtgcgtgccatgacatgacactccacgcgcgctcgtccgtccctgcgctcaccccacctcggttggactgtggccatgcctagggcggtagcctcgccacggcgtccccccctgccgcgatgctccgggggcggcctgccgcccccccgccccgcgcccccgcgcgcggccccgcggccgcggcgggagggggggtgcgcgctcggggcgccggtggagggcccgccgccggccgcacgccggactcccgcccccccccggccgccggctcgccgcgccccctcggccgcccccccccccgcctaatcgctcgcaccagcacgccgcgcgggcgctgcgcccagccgggcttcctggcacccaccagacacccccgccgaccgcccgccccccccgccccccccctcgcacctccgcgctccgcccgcctctcgcgccggccgggcccgcccctatctcccgcctctccccccatcccccccccgacccccccccggaggcgcgtaccgcgctctacgggctgccctcggcgctgcggtgcgcacgctcggcctaggccagcggtgtgccctaccgccgacataaagcatcaaaaatggcagacacttgtaagggt

SEQ ID NO: 20422 - DNA, 777 bp, Homo sapiens
  misc_feature (1)...(777): n = A,T,C or G
cctggcattacttcttgtnaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttgctttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagtcgggattgagtttcaacagcatctctgctgttgacaatggctctctggccaacacgcctcatctgagggagcttcacttggacaacaacaagcttaccagagtacctggtgggctggcagagcataagtacatgcaggttgtctaccttcataacaacaatatctctgaagttggatcaagagacttctgcccacctggacgcaacaccaaaaggcttcttattcgggtgtgagtttttgcagaaccccgtccagatctgggagatacaggcctgcaccttcggatgtgtattacatgcgctgtggcctgcacttgggaactattaggagtggtaacaaagcccttgtt

SEQ ID NO: 20423 - DNA, 803 bp, Homo sapiens
  misc_feature (1)...(803): n = A,T,C or G
ttcatattggcatcgccatggctccttggacgagttaccttgtcctcattgtagagatggcgatactaaggcagaatatggtaaggtaatttattcataatttccgagaactctataccctgtcaacttcagattacaaatcatagtgcacgctggggcatatgttgggcttccctttgattaacagggaggaggttgggcttgatgacctctgcaggaggcttcccgctccgtaatactaggatcttaattctgacgaatggtcctgatggtaactagaaccaagctactcccccaccctttagttcaaaacttaagacaaatcacacactcatgcaaaatattttttctccctactaattcatagggtaaaatatcaatttctgctaaacattgttatgttctgatttagtcattgagcgtgagttgatgaaaggacctatcttatttacactcgttgttcggaaaactctaccgggactttgcactgggggaaggcccacaccgcgaaggtttgggtccagctccctgcatgaccccctctggccccgcccctgccccacctacccctccctagctgccacacgtcggactcacccccctcctcccacaaactcatctcacgaccccttggtccccccaagcccattctccctgacgcctgcgctaaaccgccacgcgccctcgctccgctcccccctcactcttcactcccccatgcagcgcccctgcgcctcgcgcaaacataccacccaccgccacatcccacccccgantatacaacaacagatctcgacgagcta

SEQ ID NO: 20424 - DNA, 728 bp, Homo sapiens
aagtagctgtaaagggtgttgggatttgaaaaaggttactgctcctttccaattgtcttagtttttctggctcatcggcccaaaggttggaatcacgtctcatcttcgtgtatttgaaaatctaacaaatctagcagatggtgtgaatgtgcatatatttagacaatttaaaattttgtcaaggacatgaaagaaaggcatgttttctaacaaaacagaaaaaaatcaaaaataagaacagaatgcttttaacattgcttaaagaactacagaactatggtggcaaagtgagtatgtcatacaaggtaggctatgtaaatctatgtgtgataattgtgtactattcattgataggggatgtactttctacttaacacacgttctcctcctagataccttacctataggtacagaagtatctattatattggtttaggctgattctaagggatatttctcttaatgtaagctgaagcagagagaaactctattggcagatgcaagggacttttttaacacaatgagttactgaaggatggattcttaagctatggaatattgctgaaatcaaagctgctataatgcagttatactttcataagtctgaatagaaaaaaaagtcacatcatggaagagagaactcaatcaaatattggacttccacactatttatgtgtactatgtgtactatgtgttcttaataaatattctcataaatacctgcaaaa

SEQ ID NO: 20425 - DNA, 1227 bp, Homo sapiens
  misc_feature (1)...(1227): n = A,T,C or G
tgttgctgcatatttaataatgtcgtgatgtctcataagagattgggctccgtgaccgagtctnngatatacaagaaataacactctcacgtatgnngtgcagatatgggaacgatatacagtaacactaganatacacatagngggatcaactggcgagtgtaaggcgcaatgctgatgnggaatgtgtgacttgtacagaaatcggaacaccaatcgaagaacaagttggtncaattactgtngcncatagtacattatatgggaagtggagggaagtaatagtggggngagtgagtattgtagtggagaatgatatcgtggtgggggaattctatggtgatggagatgagagaaagcaatgcgaagaatgcttcagtgcctataggcggttgaagggtatgagtagagaagccaagaacgtgtaacagggtggatgatggtatatgaggaagggagatatataaattggactttactacgtaagaggtagttgggtattatgggagattgtgaggaaataagacgttgtcgcggataactgtagttatatgttataaagacatggaaataaatagtgattaaaggatgagaaaacagtaccatgagatataatgatcgcatanatanccataaatatagaagcattaatttattagaggaaaataacataagagngacatgggatatatgtataatattcgttaanaactattanaaataataacgnaacatccataacaatgntctattctcatatccttgcctcatgtcaatctataaatggggcaatactaatgggatggtagaatatgcttttgcagaaggtgatagaattcaataagggagagggaaaagagcgcggggcgaactaatataaaatgttgttaatattaagggcggtgttttggggngcgtggatcgcgatgtgagacggcactccatggtgaagtggcgttgtaggctgtgtatggtctttcacgatcgctatagctattacntatttattnnaatttcttgcacttaatttttttngnaacttctatgtcatgctttttaataaataaaaaaatnncatcgtgactctccgtctggacttacaccagtctgcnnacttttctcccgttcccaaacccactacactttcttctncctgctccactcnncacccctctcctccctnccacttcnnacttctctcnccctctctctctcccctcattttct

SEQ ID NO: 20426 - DNA, 717 bp, Homo sapiens
tccctaactaaaaatatattatataacaacaaaaattccatgtttaaaaaaacaaaaatatttatgcatgtacccaaaacatacaaagacaaatccaataagaataaggaatttcagcggtatctgggggcattatgatttcagagcttgttatatattaaattcaactagtcgaggccgtctctaaaaaacactaacatgtcagtcaaaaagacacaattggttatttggcacgtgtaaatttaacaccctgccgtttaacttgtaaccctccccattagccttgtgagcatttaaacccagccgtcattctctcccctataccacgctccccactcctcttgacacgttatgttacggcacaaaattaatttctgcccctgtgattgggccacggttgccaaggtaacagtggagctggagctaacttccttctttcatcctttccaatttttctattccagaagacagtcagattaatgcgttactgtactacaatctgccttttgaaacctaaatgagttttcgttgataaaatgttgccttctctgattcattcacaaaactgtggtggttctgaccacctgtgacgaggggggtcataatacttccagtgatccttttaatttagcaaaatatttgtcggtggagggaagtagataagaatgtattagtggattttaaagtaataatgattaaagaataattaaatgaaaa

SEQ ID NO: 20427 - DNA, 1215 bp, Homo sapiens
  misc_feature (1)...(1215): n = A,T,C or G
tgggttgggttgtgtggggggtngagaaggggtatattagggctatttaatttattataatttttttgtttgttaagcgggggagaggacaaagaagcgagatacagagtccataacaaatcgaggcaacaactaaaacgagtacatcctggccgcgccgagccacgggaaggcgtggaagggcgtcgggcgtgtaaatgaaacgagtgctgtgggtaccggcctctttatgccgcagcgttcgtggaccgcaccccacacaaggagcgtaacatacagtcatagaaatataatagatgctctcttgtcataaagcgtaaggggagatatgatgataggagtgagcacgtgaaatcaataatatttaaatagactactttttccctaaagtctcctcccatataatgaactcatcccccacaacccaaaataggttaccagaggagacataaagcaaaactagacaacacacagagacccgcagcacaccaccccgcgaaacaattgagacatagaaggaagacccccaccgcgcgagaatacggccgggctctccgtatctgggctctccttgtggcagtatttctttagtaatgcgttagaaaacttatattattatatggcaaagaaaagggacatcagggttaggggcgcataacgagctgacacaaaacagttctactttgatgatacttatgtcatgtacatgtaatgagcgccggcgcagcgtccatacagtgtatatccacttctacaatctacatagctacaacgaataacgagaaactatactccggagcgcacgatcggcgaagtacgatctcatatgattcgcacgtctgtgaaacgagacggatccgcctattgcgcacggtaagcatatggacagagcgaagtacgatacgaaggatcgagctgaccgccgtacaccgctcgccactancaagaatgatgacgcacgcgacgatagcagcgacgagtcgtctctcgactagcagtgcgactccaacngtgcacgcaccagatactccgctgactgttacgagcaactgtatatcagatgacccactcacgtggcctaatcgccactctcgcaccgagaacagaccgcgtcaacacaatgataggatgagtgtacagcaggacgtagttactancatatcgcaaaacagatattataccgtacgatctctacgtacgttctgtttatgcgtt

SEQ ID NO: 20428 - DNA, 745 bp, Homo sapiens
  misc_feature (1)...(745): n = A,T,C or G
ttctccancaacgataaaacagctagactttgtgaatgatacagagaagtccggagacacgtgtgaactcctgggttgctgataaaactaaagtccacaagggaacgaagaaacaccaccaacagcgtccacatggccttcacgacatggccctgtggacacatcagacgttgtcttgcagtgcctcatccacactatctgtaccactggggggctggatacgtcatggttttcatggtgctatcttgggcctctttgcacctgcacgcactgtgtttcctacatgggatatctgtgtttacaaccaaactcccaggggcctaattatatcctttgtaaaggacttcaaaccaccaggcatttgctggaagtttcacggaggaaaacaagcatttttcatcttttaatctgccttgctggtcaaagaggaaaaggagtggatggacaaagtggggcccaaagtctggatctagttctgaccaacaaggagaaattgatgcacaatggggaagtgaccttggtattttcgactggaagagccgaccttctcttgatggatgacccctgtgacacaaatggtgactcccgccatcagcttatttaaactattgggggaagagcgccactgaaggagacgtattcttctttccatgaaagattactctgacctgacctggtcttcatgcgggaaaaggtatcactgtgcccatatgtcccagcacttttgttatccaacacggagact

SEQ ID NO: 20429 - DNA, 733 bp, Homo sapiens
agtggaagagcaattgacagaaagtacacaaggggaatgctctttaaaccaacgaggaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcagggattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttggatgccaaaataaagcgtgtgcactggaaa

SEQ ID NO: 20430 - DNA, 1309 bp, Homo sapiens
  misc_feature (1)...(1309): n = A,T,C or G
ataactctcatactcactatcacttgnatggnanactctactcacaccagtatgnnncatccaccggaccacatatgaacntnncgctaccgcactcattctcgtgctgncgctaaacacactctgcatgagngtgcatacctatttacacacactacatatatggtgtagcggagaacaatgttaggcattgttcaccgcaactattatagttagatagacctagtggaggatttaacttctctctcctctctagtaactgcgtgtncactcatangtatcactaatctcagngacctactctcgcgcgnnccaccctcgccgcacatctcaaactacgnantattatctctatactcggcacctctggncacaccacaacctgagnnngcacctactccttcaccatcgtagnnaccctctacctctcgttgcatccatgcactctagtcacacaacagagagggagtctcgagangnanaacagccaccttcaatacaacacgtgcgcacgcgcacgtgagatcacacatgaacatnnaccttcaatactcgatagagacgacaccacacaactgggnggaccacacacgcgctctcctccacagngacgccaactccatacgcacaaaaacgctctactctagagtactgcgtctccgcccgnngcctcgcacctctccgcgtnggcccctgggnngggcggaaacaggaacgtacctggggggacatccagcacgaccatagccaccggcggncatcactccactccgaaggggcacctcgaaacaccaccaaggncggaccccgcacaaccgngngacaccaaaccggagagggngactcataacnaacatccactcatcacttgaagctcacatntcacccaccacattatccgccctctctcactcttctatcnttcatctaccatcccctcnnaccacacncccccacttnccttcatctctaacatctcctataatctaataccanntctatntcctatnctttntcatactttcctttatcttataatccttgctggtttaccttccttcttttatcttttatcatttcttactctttaacctaaaataattttcccttnanncttccccattactcctacctcnccctactcctaccctcttnnctccttctcctcccccccctcctannntncccctcccnnnnnccttcnnccctnnncnncctnnnntccnccccannnnccactcctnnnncccctnccnnnnctactcctcctctntccnnnnnnccnccctctcncncctcacctttccct

SEQ ID NO: 20431 - DNA, 1646 bp, Homo sapiens
  misc_feature (1)...(1646): n = A,T,C or G
gncacgactgnggcgcttgtgtgagcatactgtgcgcactcagtgtnagtccactgtatacgngnagctaccactancgantnagnnncacactangtgacacacagnatgnanacacacganggcactataatactatgngnncgcatagagatgnnacacgctactcgatcgatcacttcnancattcgtacgntaggatcctanantnnnnacataaactctacatnantgntctctactcgaaaacgtatctacactactgtnannacgcggtgaagtgacgctagcntcgacgatcgtctctacgtngnagcacaatcgctatnngctcacagntngttactatacactantngtgctgngatctctatcacctatcattanncnnacgcgtgcgcttatgtctctatgtgntgtnnccacgcatgtatcanacgctctnnnnncactctcccgcgcgcgattntcatactcattatagagaacatcagtattnacatacgtctatactctanctngacacctcgtacacacgcacacggaggncgtgcggngatganaatcactaaggacatcgcactgatgaactcgagaagagccagacatagncatgngngacacgtcgaccagtcactgcgcntcgtgactagatactgtnacttaggtatattctgtgatagtganntgtgnnaactcgatcagtgcgncttatctctctagctacgttgnagtctcgcgtgcttatcgagcgtatcgtctatgtggtggattgtctttgngcttctgcttgngtcgagtngcgtctagctgcctggctnangatgncagtgcgcggacagncacnactcancacacatcaacatnnnngcanacactatacctcatattactatntagacgcattgacagctcagagaggtacagtnntnacatgtanacgctcggccagcttctnnatacacaantactataactttaatttacaaganctatatagggatntagctatgtnnaagatggngctatatgatgactantggacatcagcgntaatcgacgtatactaatacaaataagaatcatanaaacaatatcacancncacaactcatacntacnacatctacatctattatanactatnacacacaaatcataaaattnnnaannnananaataatctnaactatnaacatatagnacaatctacacttctattncactactattnacctattaaccttatnaacttctatactataatatcacctagcaatgttananactcgnnaacatagacttattaactcttncgagagnnatataagtttactantcntcgctttattatttnnnntcttctcttttcttcatctctcctcttccccacncctctctctctccactttatacntatcattctctnnaccgcttcctacactacacannncctacnncctccgtgctccctccgcttgnngcctctnccaagcccgnctgagcnannccacttnnccgctgctcnggnnncncnnnnnncaattnncctattactttnnnctcttcttttttataacatntnnnntnactatttatnnannttcataaattacctatattaatattatattaanatacactata

SEQ ID NO: 20432 - DNA, 852 bp, Homo sapiens
  misc_feature (1)...(852): n = A,T,C or G
cctatcaatcactgattcatgcccctcgaacccagaaaacacgggctaagagctaacgtcaaanatttttctctacaaccacagcgctacatcgacagcaaagttgtgaaaccaattcagaaggcgaatggctctccttcgatgtaactgatgctgttcatgaatggcttcaccataaagacaggaacctgggatttaaaataagcttacactgtccctgctgcactagtgtaccatctaataattacatcatcccaaataaaagtgaagaactagaagcaagatttgcaggtattgatggcacctctacatataccagaggtgatcagaaaactataaagtccactatgaaaaaaaacagtgggaagaccccacatctcctgctaatggtaatgccctcctacatacttaggttacaacagaccaaccggtggaataagcgtgctctaggatgctgactattgctttagaaacgcgccaggatacttgctgtctacaaccaatcttctctgatataaaaggcatatatgctggagtggatacacgaacccaaaggatgcgacaccaatttctagagatggagctatgcccgttttcattggagttcatactactcatgtcacgcagggtttagagtttctataatatcctgcagttaaaagtgtcgtgtttcatccctagagttccagcccccaaatatacaaaggcttctaacctctctgtacttacttgggcaagataactgaaacatggtactaagtaatttattagcgcggtttcatgcgtgcttaatgcttctaaacatatttatgaagagttgcaaagatccgaaccgacatcgttgcgtgattt

SEQ ID NO: 20433 - DNA, 765 bp, Homo sapiens
atatggcagatgctatggacacccttgaaggaagaagaaacaataatgaacgtgtgtggaatatgatccaaaaggtaaaactttgagctgaaggaaaaagatctattattctcaaagaaaatgtccattttgggtcaaatctgtttggaggataaaaagaaacccaagttctttggtttgtttttttgtcttccttttttaattaaatgcagctctctccctggaagtgtgaccaaaatcaaatatggatttatttaatctgcttcttttccaacaggctgtgttcatatgctttcgtgatttttcttcattatcatgctcattttaatattctattttcattatctgcgccttcgttctcggttttataattctttaaagccctttcatcactgttttattcctctcctcaactatatttccactttttttatttgatgaataatgcctccatttcaagggaactaccaacacattagcacattgcatttttttatcgaggactaactttctaatttgcactaacatgacgaccattacgttatttgatataggtggtttattgctattatgtgcatcttgttctccaccatcaatatctctggaccttcctccacaactctgtaccctatgagcctgtgaaggtaacagattattgtccttcctgactaatagtaacgctatctcccgttatgctggcgttacacctctatcttccttctcactataacatgcggtctgtgcaatggccgtaccacggcagaa

SEQ ID NO: 20434 - DNA, 712 bp, Homo sapiens
cataattgcaccttggttctgggttaaatatttttttaagccctctcaacagtgttttagtcaatccccaacctatatttcccctttgttcatttcagaaaaaatgtttactttccaggcatttctagtatgctagctcattgatgtttttgtaaaggtctatcatacttatgttagaaatagagaaacatcccatcattggctactggcgtttaaatacaggaagtgccaagatgcacctggacccaagtactcaggagacttgtgtgacacaacaggaccctctgaaaatgtgaaagttagtaatcttggttctccagtcaaactcaaagtattaagttctgatcaatcaactccccattcatcttcctcccatcactgtaagaacccaccaggggagactggcatcaggagatgtgaaacaaacaaaagaaccttcagtttaaaagccaaccctaagggattctggagcacctgaggaaacacgtgtctttgtaatgaactcagaggccctgtgatatacagttgactcttgaacaacgtggtggttaggagcacagtcaaaaatctacaattagcttttggctccctaaaaacttaactaccaatagcctactattgactgaaagccttatggtaacataaagcgttgattcacacgtattgtatatatgtattatatactgtattcttacaataatgtaagctagaa

SEQ ID NO: 20435 - DNA, 995 bp, Homo sapiens
aaaaaacaaaaataattctcgaaaaaaatattaaaaataaataaacaatcgttataactgaacagtatactataatttatagatgttaagacccactgactcatttccttggaccaagtctagatttttttggagatacgggaatgaagatcttcacacggaattcggcctctaagatcttcggacatttccagccatacgagaacttgcaatctcaacataaacatcatctgtgctataacatcactccacatctcgtgcgtattctcgtcattaacagcagaaaagcagaaagagtagacagacttatatatattatgatgtggcctgaattagtgaccaaatacagacgaagaaaaatacctctatattacagtgaatagtgctctaacgaatgtagatagcattgtacgacataaaagactatggagtaatgtatgcaacatctccttaaataactatatacaaacatgtggctacagatcatacagaagctcacttagtttacatatactcgtctaaaagatatgaatctaaacaacttacaaattccttcaacccatctgtacggcacagcctatatcatacctagactatattgttcactcaccacgtgacatagcgcgccgcgattagcacttaccagttcgaatcttcaagtcccatctaactaccaatattcacatatcctaaaccgatatcctatacctcgatcccacaacctccactgctcatacatacgccgccagcaatatatgacacgctacatgaaataaagtactatgatcgaatatgataccagttatatattctcgattgtagaccatcttgtacacgaagcgataagcaacacatgagattgaagctcaatacatcactagcctatattaatgacgcatgattaaatcacataacctatatatcacttgatctccgaatattcatgtactgagatccccgccatattgaattaatcgagaatatattttatattg

SEQ ID NO: 20436 - DNA, 1216 bp, Homo sapiens
  misc_feature (1)...(1216): n = A,T,C or G
acaaaaatnntataaaaaannnnannttttgtattaanagagaatgggagggaggtaaggggaacttaagtaggacaccaaaaaaagaaccgctttggtgctggctgaccaccgggnacgtggaggcggagataaaaaaaaaacgagggaaaacagagaaagcgaaaaaggacaagtgcccccgcaggcacaaaacggcccagccaagacaacaggcccgcacacacggcgcgaacgcagggacaaagacagacagggaggccgggtggcggagaggcaagacaagnagggagacctaccaccagcaacacgggacacaactagcgggggaggcaggcacagacagccccacagaccgacggacaaaccgccgcgcccgcgcaggcgaagaacggaccgagccaggcggcgcgcggacgcaggagagtagctattaccccaangcgccgacgggcgccacaatgacgagtcgggcggaaggatgcgcacgcagttcgatngcgagcgcgaacgcgagcagcccagcacctcgcggtcaggcgagcgacagcgacgtgcctcaaatacccaacgcaccaccaaaccggcacgtaatacagcttagaacgcacaactctgccgacctcacacgcgtgcattcgacgtcagctgcgactgtacacccacgcgcggcgcgcgcggcccgccgcgcgagagcgcagcggaccaagcacccgcccgcactcgcgatagagccgcaagcagccggccgcgcccgcggcaaccaccggcgcgcccacgcgccagcccgccccaacaacgacacgaccgcgccccgcagacccgccacgcgcagccggccaaacgccacgccacacgcacaccncacgcagaagtggacggaaagacgacacacgccgaaccgccgacagcaacgacacagacatatcaagacgaaacacacatgccaccaaccacagcccgagccaccagcgcccgccccgacacccgccccaccacagaaagcgaaaatagacgaaggtaacacgacagcggctcagccctgaagcggacacgaaagctccagattaccccccccgcgacacacttaaatcgagacgccacagnacaaggcggcgagcaacgacagatcgtagggccggagagnggncacggatcaccaggtgcgccccggtccgacgcgccgtgacgcagagaccgagacggccaacaacag

SEQ ID NO: 20437 - DNA, 1648 bp, Homo sapiens
  misc_feature (1)...(1648): n = A,T,C or G
aaaaacaagagggtggtaagaganattcttacttgcaagagctccacgcgtgcgtgatcttacacgccgtcatcgtggagcttatattattatttttccaagtgtggaccggtgccacgatatacgatggcttatcggctggcngacactccatctatcttctactaggctattagttgctacaactgtgcgtgctcatgcgatattaagggcggtactgtaacacaatgcgggataanatacnggtgctcagaaacgacactataggcgnggtgtgcgaatgtagtgaagttggttcaccgcacacatagcatgtgatatatgagaagtagaggatatgctagcgagtanctgatgtatngtgtctacatagagtggtatgatactagatagcgtggaangtgcgtgcgcatcananaactatgtcatcgnagatatatatcgagatataccgtgtggggatacatcacntgtcacgtcgctaatatatanngattgnggangattgatacaatgcgattatacggcctaattatggcgcttgtggttatagtaactatgngggttaagacatgcggcggcgtgtatataatatcgaacgagatcatagcggactatcagcggtgatcctacctataggaggtatanataacaacgagcgttgaagtggtgactcttagcgcgacgtgtgcatagataagatagattagtgtgacaaacattgtgtggatatgcataatagttagagcatgtggtcgctcgaccgcggcatcatctgtagacgtgtcgtgcgggctgcgaacaagtggcgctaatggtgtgcgtgctatagtgcatattcgactactcgtattatcgcggtacgctagtgtggtgtcatacttcaatatcgtgttatgcgccgacgngttggatcttgcngactaatctgaatagcggcggtgggcgtcggacaataacaaccgcgtgctttgctaatcaacttcgcacggacgtgtcgcaggaagagataaagcatatctacaaatgacgcagcgcacgtgtgcaacgcatgggacgtcatatgngtggtgcttagatgagcgtgatgtgtgtggtatagagtgtgtaggataatactgggctggtggtaacattttgtagacaaatacaacagccgacagctgtgtggtcagtataatgtgagtggtacaacatgaggtatagaagattacaatacagaatcaaacaactcagatcttccgtgccggtacttgcccgcagcgtggtgaactcccaatcgacttactcggcgctanttagacatatctgacgtgatattgctcgtgatacacatatatcgtaattgatcgcgtccgttcagtgagacaaagggtacacgtatgacantcgtgtacgcacatactcacttcacgatgcatgcgtcactactatccgtcgttccgatatgcgtcatgagttctgtagnggggatatcgtctacgcatgtcgtgcaacaaacatactctgatcgccctatgttgcggcttctgaagtctcatacaccgagagntgtgcgacgtgatctntgtacattcggtgttgactattatagtagctactctgatgagatgcgtgatgtgtatcaatncagataatgaatgatact

SEQ ID NO: 20438 - DNA, 733 bp, Homo sapiens
  misc_feature (1)...(733): n = A,T,C or G
cattatgggttaaaatattaaccagcctagcctacctagtagtggtgatttagggtgcccaccaccgcccacaagataattttgtatttttgtagagcaggggtttcaccatgttgatcaggctgttctcgaccttgtgatctgcccgcctcggcctcccaaagtggtgggatatcagaacttaagccactgcacctgacatcaagatgttcttgatgcacatttttatgtactgctaataaaatagtgggattatttataagggtctttgtttaatgccaaatctttatgttaatcaggtaaatttaatgttttaaatgctaaaaaatgtcagacttcagcactatatgattcattcacgtaaccaaaaacacttgtacccaaaagctattgaaaaataattatttgcaatttacttgctactcatttaaactccagtgactgaaagataagaaaaataaaatgcctagtggaacagtttattctgtgatatctctagaatttagtagttattgcaccaaccaaataaacttatactgaaaattgaattttcatattacatttatattgcattatatatattgaatttatagttcgtaaagagcatatatacgattatagtcataaattcattaaaatgatatattgggttaatttcccactgaggtctggtagaaataaatgtattctaaatagtgaatcaaaagtttattaaaaaagttantaacaaaaa

SEQ ID NO: 20439 - DNA, 741 bp, Homo sapiens
aaatagaggacaagatccatttgccaagaacaaccatatggatttaactgctgctaacaaccgttaggaaggaacatcaataaaaagcaagcctgtgagacaactccttccccaaggggcgcttgttacagagcgcgggccccagcaggcctggtccatcctccacattctttcctctctgacttatttttactttctgtttgaattggcttggttttattttgccctaaactgtgtctgtagtcatcccccgacagagttttgagagtgaaagtccgatctgcccacgcttcacagaactcaatgcggagccttctcaggagtcacttgacgtcaaggctgacttttaaatttgccaaaaaggcattctttggggagcggtcggcaccatcactttccctctttagagagctgctactggctgctggaattcaaaacccacaaattgcatttttaaacttaattcgatacatagatgagcggaaagatcagacattgatgctattgttttcaaccaagatgttttactatatcatttatattttgtttttttcttcccccagtttttaaactttttgtttgtttgttttacaggccaagcctactgctgttagaaaacatatttagaaatcacttggtttttccttgcctgaacatcatctatttagttagcttgtgttgtttagatgtgcttcagatctcaaaaaaataaattatgttatttgaaaaaaaaaaaaaaaa

SEQ ID NO: 20440 - DNA, 942 bp, Homo sapiens
  misc_feature (1)...(942): n = A,T,C or G
gtaatgagctttttgtgatcccacacttccgagttttctgtgctaccattactgaagattcatgcatataccagctaccatcattccattacttgatggattcagaagctcaggaagacaccagagaatcctatgatgacaaccatgtggtcacagagatcatcgcagagatgctttcattccaactcgtgataacaactacttggctgggaaagttctcattttatgtggtctcgagattcgaattacttgaggacataggattgttatcggcgcatgacgccgggctcttaggccctccgtgatacgctatccntctgcagacaaatgccaacggagtatagctatcacgcgacaaaacacctgaattgaaacttggaccctggaacagactctatctttccatttgaggcaagatttactttgccgcttctgtgcaccgcccccgcctctctcgtccgactcccttggcacactcggccatatcactaccttgcccgcgcacacgccagcgcgagacagcatgttcctcgtcctacaagactatagaactcatgctaggagaagccacctcaataagacgagacatcatacagnctccttctaagtagtcaagtgagccattattagtagttgtcagtacgcacgtgtgtcatcaagattcaattagtctaaacgaaaatttttgtatcaccgcttagtatcattctcgaacgaagaacaccgatccagtttagccccttcgagagatcaacctagnaagctcgtattaagcgtaggtataattacgtcagagttatttcatacgtgtgcttgcttaccaggtagcagttgcganaatgtacgctggcctctattgtgttgtggaatatataggcttgagggaaatccccgaggacgcgggagcgtccctttatttatatggaatctatttcatatttt

SEQ ID NO: 20441 - DNA, 226 bp, Homo sapiens
taagactcgaactacatacggactcactatacatgaagttctcccactcgccaggtggtgagagtctgccattatgaatagcatgatcttactacttcaatgaaagcatgtaacatgtttctcaaaccaccaacagtcaagtggatttggtacagtgcggctgtctaataaataatcaaaagcatttgatagagaaaaaaaaaaagaggtgggctcgttggcctca

SEQ ID NO: 20442 - DNA, 1233 bp, Homo sapiens
  misc_feature (1)...(1233): n = A,T,C or G
gggggggggcggcggcgcggggccggggaggaaggggaggggggagagctttagtagctgcaaattttcctctgataggggnaaatataccctctattgtactttgttgtggaagtggggcatttccacgagactatnnnattttagatgcctacggggggcgcaataaaaaaaaacctcttctttcaccaggatggaaaagaaacaatgtaaaaagagtttagcacggaaagagttgtgtctgtgctttaaaggattagcatattgggggcgttgataaggaaggaattccatgtgagaagggggagaaaactgagagatgaaacaacgggggggggggagaatgtttatttgtccccccctctactataatatttatgatcgtatctgttggccgagaggaacatgttggaggaactatgaagcaggtgtaagaagatgatgttgtctctacgggagacgcagcgagcgggaggggtggcgcgggcgggngacgagaagatagtggggcgagagagaggacgcgcccacgaatgcagcgtgcgggcgctagacgggtgcgcgcggcggcgacgcggaacggcggaacgtagcgggggggcggtgcggcgcgggcagcggcaccgtgtgcggcgccggcgcgcgcggcgcggcgctgcgcgggccgcggcgcgcggcgcggtgggtggcgcgcgcagagcgtacgtagtgtgcgcggagtgagcgcgtggngaggagaggtggtggcgcgtggcgcgcaggtcgccgngtcgggaggcgtgcggtgaggcgccgcgcggacagcgagagaggtgagagctgctagggacggcgggcggcggcgccgccggcgggcggcggagcggcgcgcatgttgcacgtccggcggctgctggcggcgcggcggcgcncggcgcgtggggcggcgaggggcgaggatcgtgcgctgctcgccgcgcgagtggcgggcgagagccgcgcgcgcgcgatgcctgcgcgggcgtgaggcgaggtggattgcggtgtggcgaccgtgcgatantgtgatgtgacatgggcgtgacgcgngcgcgcgncgcggacgcgcgtgctcggcggcgcccatggctcgcangtgagccggcggcggcgcgcgcggaggaggcgcgagaggnggcgcgcgcgcgctgcgcgcgcgagcgcgncgaggcggcgcgcgtcgggcggggagagcggtgcgccggccgcgccgcg

SEQ ID NO: 20443 - DNA, 1791 bp, Homo sapiens
  misc_feature (1)...(1791): n = A,T,C or G
agaggaaggnnnnaangaatngnnaaaggnaggnnanaagaaggaggnannnnnagngagnagtaagnnannnagaannnnnnaaagtangtgntananngnggaagnaaggagannanannannnnnnaagaagagaaggaaaggagaagagnnnnnaaagannnnnaagagaatganaanagtgagaaggagagtgaagaggataagggnnnnnaaagggagatgaggaatnnnanagtgaagagtgnagagagagtgtgggnnaganananagagaggtatagtagtagagttggggtgntngnngannnagagaggagntnnaagagnagaggaatgtgtcncgagtgtagatggataggtgagtgtatgtatactgtgatgaggtnntngntctaactataggagttgtgaacaggatacggtgtgntatatatagtttcnaatgagtnntatatattttnatggaggtatgcttgtgaaagtggncagaagacgtncngactgagacagagaaaccganatatgataatgagtgacgagtattcttntattgcgagatatcatatggatggtatacgattaatagtntnnactgtcnaacgtagatagtgaagaacatgtagtagagnncgtagtcacagtgnncnatagtctgagtgtgcgacgnnccacaggcgagtacacgtgcgcaacangngatagaagacgcncngcagagagatcgtacagaatagcgagcnnccgcagcgtgggttgctcatcaagcaatntcgcagacgatgtgnnnnnntgagtataaatgtgtgagtgtgtatgaggttagttgggttntcaagagaggctgaggtgagagntacaaacgangcccnacagaatgtcccaccatatgttataggaaacgagacnngctcagagatcaccgacagagagntcnctctcgagaggatgagagtagtcgnagctcgcagaagtgcggagatcatgannnacgagagangtgtnaacacgcagaagagaagctagcgacaacaacacgcgcacgtaacagccgcagancgcacgcncacaaccggcncctcccatgagtcgacgcaccgcttatcatcactcatgtcaccgagtntcncacntnacagtctactagcgagaggtgtgtgcagagtcgcgcnncntcangacagctccacacagcgccgccncacacaacatcactcgcacgctagtgcgcgcnncctaacgcacatagtatcnccgcggcgcgagcagcgtgagttnncnctgtcgatgatgttnnnagagtagacagtagagtncgagagaaggagnntnctacatgtatgtagtcncnctgtagtctaagtgtacgtcaccgacaagacaccnacagtagagatgnagantntnatagtagaagacctcgagtgtcatgccgcgcagacggtagcaggagngncncagtagaggggtcgcagatgaatcgagacactcnccacntcgagagaaagagngtataagtactgaagcgagagtgagtgcacgntgtatgagaagcctcncntgtacgcgcacgccagtgagagtgctgaccgcataggtaagtnacgngtatagacgnnnntcaatatagagtgtagcatcgtcacgnctgcactcaggcgcgtcgaataagacaatcntcgctcggtcnttgtgtgngncncnctagagcatagagagtngaacgacgcatgaggtagnaggtnncncagcgatnggacnccagctgagatgntgagagatatangag

SEQ ID NO: 20444 - DNA, 628 bp, Homo sapiens
acaagtggaaaattccacatgagcagatgttcaatgagctgctcacgtataatgcgcctgatgttatgcaagacttggacacatatttaggggggagagaatggcttattggttactctggaacttgggcagacttctactgggagatttgcacgaccacacttttggtctttaaccctgacctgatagacaaccattcaaggctggtgaatttaccggaagaaaggccaagcccttccctgcgtcggtaactggataaaacgaaagccccaaacaatctttagctgatccatgctgccttcaagcttgtatttcttaggggcatttcatcatcagataagaacccctcctccgcctgcacaaatatcaacatggtcgcttcccagtccactagtattttagcttcgccattttctcatttttcacagggaaagtagcgtcagcgccctcgtggggttgtttttgtttcggagtacgtcctttacctcaacatcgccgcaatttgttcgtaagccgggaaaacgttgttttgatcagtcacacaatggcacaatgtgcgggccaatgggctcaaaaaccaatttttcccttcccccacatgtttggatatctagtaaaatattaatgt

SEQ ID NO: 20445 - DNA, 789 bp, Homo sapiens
ctggatctcctactacagtgtgataaaaataagagaagaaatggaagcctagaggcaagatgacagaagaaactgtagtggtggtccagataagacattgaagagctaaaccaggattttgggaaaagagaggcctgaggagaaggagagagatggagaacagcctgttggtggaggagtcagcatacaaagtttatagattaagtttgtcatcctatatggacagtttttgggactgcggggggattataaaagtagtatcaaagaccactggtcccagattactatgacagatataacaatcatgaaaatgtttgaaatattacaagtattaccaaaatgttacacagaaacaagcgagcacatgctactggggaaagggaccctctagatttgtttgcaccagggttgccacaaaacttcaattcataaaaaggggcgcttctgcaaaatgcattaaagcatagtgccaaaaaatgaagctttccctgcattgggcgtgctaagtattaggggggataagattactcccttccttatcgccagatttcttgccctgggaaaccttggttttgggtgatgccccttttcactttagtgcccgcggggggccctgtcggaggggggggaacagttccttcttccctcgctgggctggggtgggccggcgggcttccggaacagattcccctggacgccctgataaagggggggaagtcacgaaacgcgtctggctgagtggcgcacgctgggacctacgcccgggggccttgggtgggacttttctgg

SEQ ID NO: 20446 - DNA, 931 bp, Homo sapiens
aataaaccgcccaccccccatcaagaggccgagcgaagcagttcagggcaacatacatatgggtaaagctattgacacagatctcggaaaatggtaactgaagatcaaagtttagcaacagaggaatgtacttctacctaataactttctaaaattcaaatatgtataataaaataaatgttttaaatctaaaagacacacacacaactcaaagtgacaattctacacatatctaaaaaaaaaacacaaaacacagcaaaacaaccctcttttccccccccgtgcaagcgccacactaaaatcatcttatatcttattaacccacccatctaccattccattccaccctcttcttcttacccgttaaccgttcgatccgacctcactataaatcaaacaactttctcacaacaacaaattcatagcatatatatcaaaaatcagtattacccgtatgtccgcatcacctccattacaagaatactaacgtacacaaaacaccacctcgatactgctatcacccaaacactaataccgcttccactcctgtatgcgaagatccagataacactcagactcattcgtccgggcgagcaagtgcgttatttggcacttacacccctaatgtaatcaaacgtgctgccttacaaggatatattattctcaaaatcatactccaccaaaggaccgccctcacctcaaccgacaaccaacgtgtaagaaacgaacggacaactacagacgccaaccctgtttcttccttatcctttatcttcttttcatatccttatgctcatcatcagatagtaccacatccccctcccaccacactatacactgcactccgacgcgtaccactcagaaataccccacaccacctctcacctcccgtctaatcagagatacacaggtccgaactctccgtcctccg

SEQ ID NO: 20447 - DNA, 803 bp, Homo sapiens
cttagagaacacagacacaatgaataaacattctcaaatgagagaatttggagcacctcagttttctaactctgaagatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattacttccttcacaactatttgaccttggctttcatgtggctggagcgctcaacaactgggtctcccaagaggaatcagaactccgtctttcacacactgataaccacccagtgccttcacagagaccaaagaaactaccaagatcccccccacgtgcggactacgacatgtgccgacttgatcaatatggttgaagacttggatccactttcaattccattacgctcttggacactgccatcatccagtccttactgctagactgcacccacactgtccctccacgcggccctgccaccatacgctcacaaacgaggtccccctgcccgcacggcatcctccaccgctcccctctactcccaccccggcgaccgcaattattgctctctcctcccattctcattaaagaatgcgctactatccaaaccagcaatacgcacactcaccttccatactctcacttgcatatatgcctatcactccgtccatctgtcttacagccatacgcgatgaatacat

SEQ ID NO: 20448 - DNA, 829 bp, Homo sapiens
gcctaggtggagcagcaaccacaaggttaaatgaagacagctgaaacaacgcaagctggttttatattagatatttgacttaagctatctcaataaagttttgcagctttcaccaaagaagtcttgctcatctttggttcacttccttcccagacacacacaaactcagaaccacacagccagtctcaggagtccagtaatggagagccccaaaaagaagaaccagcagctgaaagtcgggatcctacacctgggcagcagacagaagaaggccaggatacagctgagatcccagctcggcgacatggaaggtgatccgcaagtgctgcatcacccacacccccggggataaatgctggattcggggtccgcggcttccgccacgacactacgctgaaacggccactggctcatgccccccgcgggcctcgaacgggcccagtccccatcgcacccccctacgacggcggcgaggagggaagagcgtaccaggacaccagtcccgtacgctctcaggccgcgcgccgcacgccatcgcggaaaaacctcgaaccacccccccgaccaccacacgcaagaaataaggagacgatgtacgaccagacgagaagcaaatataggagcgcctggccccccccccgcgcaccgcaagaagcgcgctgccgcgagcccccgaccgttacctcgcggcgcccgccccgccgtacccgggggggggacatgcagcgtacgaccaggtgttgcacacaaccgcttagccgtgtccctcccgcattgaagtgactcgcggcgcctaactgtcgctggagactggcaggacgcactgcgt

SEQ ID NO: 20449 - DNA, 922 bp, Homo sapiens
  misc_feature (1)...(922): n = A,T,C or G
cctagtaggtcacgggaagatgtgcttcggagaggaagcatgtcttaaatctggaaatgatatgaagagggatgtcagcaacacttgatactgggccactaatagggagagtttctttcatctggtcaaactgctcaatggattctaccctttctcctggcgcggacacctcctttcgcaaccctccaacctctgtgctcactcgaaacctacccactcctcccaccctccgttttttttgaggaaagttgaagtcttttttatctttttttaatcactatttacatcatcgctcccttcgctattcttcatattgcgctactgcatttaattatattctatacccccgtctcatcttacaccctctcccctctcatgctttcctgcgcacccccccccccatctccactgcctcgtacccctcacttcatcgtgcttggttagcagcgcatcaaccttgtttgctccctatatactcgccgctgtattctcgtcttgcgagttctagtgctttgctcgtaccttgcttcttttctttacccgttgtctctccctctgtcctattccgctgacagctgcgctgtcgatgttgtagttctctctcttctcaagactactcgctgtttcgtacgctcatcgaaagcacgtttctctctctgttccgtatatcatcatagagggtccacaaccccccgacacgcacctctcaatcgacccaagtccacattaactctacgccacgatcaaacgactcgatcgcatcacatctcgccacatcctgaagtgtccatgtctaccttccccgccaccgtgttcgcttgcacctcatatatctctttagtgtccttaattgataatgaatgatttacaatgtaaaanacgcacattcaacattttactatcaccactccctcgctcccct

SEQ ID NO: 20450 - DNA, 775 bp, Homo sapiens
ccctggagtgtctgatgggatgggtaattacagtggatccttcacgacaggggtttgaagggcatggtccactttggtccacctctgccactctgagacagaagcaccaacccctcttcttcctcctcctcctcagtctactcagtgcgaagataacaagaatgaagaactttatgatgatgcatttccacttaacgaacaataaatatattttcctttccttgtgactttcttaataatattttcttttctctatcttactttatggtaagaatcagtatgtaatacatataacatacaaaatatgtgttaatcagctgtttacgttattgataaggctctggttgacagtaggctattagtagtagttctgtttggggggactcaaagttatacatggattttcagttgcatgggagctggcaccccaatccttgcgttattcaagggtcaactgtgcatagtttcagtggtaaatttgaaatgcataatgcggggattctcaaacttgaaggaagtgatatggtgcaaatgaatcaatcgcaatgtggatggcgttacttgggacccgcgcacactcgctcggctctcaccacggctgtcccccgaataaaaaacacaccgccctctttgtctctattccttgacgctccgactgccctcttctttccctgtgggttcactccctactcccctcctcctccccccactcatttccgtgcttcctgtctccccggatacgagtaccctactaatacaaacgccgaacgccggt

SEQ ID NO: 20451 - DNA, 881 bp, Homo sapiens
catcgataataaccaataatcatacaaatcaataaaaaaggaaaccccttaaggtttagccacagaagaggcttttatccctcaccacctgtttttgttccagcaccaggaaccaatgaagaagatggtggggttattctttctcgggcgatcactgcgaccaaaatgaaacgaaccatctcctaaccttccctgcccgtattatcaaatacatcagctctattctacgccacctgcgcatacacccattcgtttccactcatacacccattctcatttttttttcttcacaaccaaactacagcccctctcattccagtccgcgtacctcagccgccccgcccacctcctacacccccccctccacaccccacaatgagcgatctgcgaaaatatcaaaacaaaacttcccccacacccttcacactccttccgagactcttgtcgccccgagctatccatctcataagatacccctcgcccccggcctctcactattacaaataacacatcaatataaactttccccctcaaactacagccccccctaaacctcaactcgtgcccaaccgacattaaatctaagcaacctgccccctcccgagcttttacacagatcatttctcatcatacttcacttttcgccgctccccgtacaacataacaaactcccaccacaccatccacctctccctcaccccgcccacacacttagctctctatactccccatcccatcgctcccacactccgacctctcctcatcgctccgttttgtccgattaccgattaaacacatgaattcgaaaccactctgcctctcatcacgcagacccctcaacaccctcgtcccaactcacactcttttctctctttctcctt

SEQ ID NO: 20452 - DNA, 896 bp, Homo sapiens
  misc_feature (1)...(896): n = A,T,C or G
aatacccaatataatataaccaccacacaaccacccagaccaacaaaaccaccctcnatgagtggacttagccatggctcttcacaaacagcaactcttcgtcctcattgtagagatggcgatactaaggcataccttggctagcctggacttcacttctgcaacattttattgatgaaagcaagtcacaagaccagactgattcaaggggtggagaaatagaccctacttcttgatggagggaggagtacagctaccttgcaaacggatctggacaaaaaaaggattgaaccattacagaagcatgacctacaatccacccccatccccctcgcacccgcctgactcctggatccacacatgtctaccaatacccgaactgccactctcgacttcactcccgatgctatccccctcatagcgatcgctgcctccactcccaccctaccccgcaacaccgcatctacagccaggtcagcatctctatacatacctacccattanttaatggcgtttccataggtctttgttcgactatagcgaacgataagccaccactcacacattctccgaaccgacgcgagcatctcatcactctacgccctccacagagcgctttcgtacaggcatctcttctatcaaacgcgcctacaacacccacccacccgacaacacccccgcccacccccctcccccttcaacctccctcacaacctccactccaaaccgcctacaacgcaccaacactcacaccccacatcgccctccccttcgtactctccctaactatatcatcctctacacacccgtgagaggtccagtctatcaacacgcccgcctccaccacgcaaaccccatccacctccataatcacaccccccacacaacagctcacc

SEQ ID NO: 20453 - DNA, 251 bp, Homo sapiens
gcctccccccccaacccccaaacacaacaaaaaaagcctggtgttgaccacacagtgctcccggtgtaacaccaaccgaaaccaaaaattgaatcaccaaactggaaggaactccaaatggcccaaatattgataaaaaggaagaagatttagaagacaaaaacaattcttggcgctgaacctccacatcacactggtgaatgttaccctcatgagacaaactctgccactacggacttcgcactacaccc

SEQ ID NO: 20454 - DNA, 314 bp, Homo sapiens
ttgaaattgtgcctcataattgatattttgaggattccacgaagtaataaatttattatgtgctaagaaatatgtgcctggtatgttgatttttctaattattattttatatgtgatatatacacatacatgtaggtcatatatataaagttatgattcattctaaaagtttataagaagctgatttttattgtattgtaatttaaaatctgtaatttctgtaacttatgataaaataacattttacctttgtactctcttaagaatatagaatgcttataaaaatacaataaagtataatacttaagttaaaa

SEQ ID NO: 20455 - DNA, 956 bp, Homo sapiens
  misc_feature (1)...(956): n = A,T,C or G
atggaaaaaaaggaaaggaaagaaaagaaagagagnaaagaaanaaaagganagaaaaggnnaagaaaaggnaagaagaaggaagaagtaaggaaaagnnaatagnagaaaaaaatataagtatgaagaatgaaggnaaaagaaaggaagnaaaagaagaaaaggaagaaaagataagagagagtggcaaagnaaaagtgctaattaaagatattntataatactacaataattaaagttacaggtaagaacgtaaataaaatataataaaacatgatatagatgaatctcgtagtgtttatttttnaccacatatactgattnaatataattnatatattaatanantattcnaagtaaaatccaacaactttctatctcccactcaacaaaagcaataaaatattatataatgtcctcactcgccccctcatctcatncccctgtccggttcccaccccaccatacaaatcaagccaccctcaagtcccccacacgctaccatccatggtccagaagacagtccaaacacgtacaaatcttcacttagactctatatcatagccactctacacataaatcatatatataattaatacgtaaattatatcatatatgacgaatattttcttcgataaatagtactgtaatnataaaataaactacaaaaggtctaaaatcacgcataaacagtccaataagatcacgcgcncaagagcaacaataacgatcaaatcaagttccacacgcctaccccgccagatcatatgattccacaatagcccacattagccccaatttataatctcacagccacacccncaccacatncaaaaaaacactaataaaaaaatataaacataattaatctccattatttacaagttcaatcgtgctgcacaagctcccagagccacccgcacactccaaagccaagatgtatatccaatttataa

SEQ ID NO: 20456 - DNA, 1215 bp, Homo sapiens
  misc_feature (1)...(1215): n = A,T,C or G
agaagataatctgttaggtcagtgaaagcgangnacgnacaccaggagaagngacagggnaggnnangagctttgtacttntnntaaagtattngctgnctaaagcgaacngntcnatctacaagagacacacagaacacaatacagcgaccatccgccaccgaccacagcacgcgcgcgcgacagngatctacacactcagtctacatctcatcatatgacataggngngaatgtgaggtagtgaagtaatattgagcagtgagtgcgtatgtncaccangcagaanattgcgctctactacnacgcagtgtcactacnctgcgcacaccagactgcatcgatagcgcctgataagagtntctgctacgacgacgctgcgtagcagcaacagcacgatcgatacgcgagagcgcaggactcgcgcgcctcaccaatctcatactccntcacttcaactcttnctacacaacancgccgatatgatcctctatttcttaagggggtgtgtgtgaagaagcatcagcaagcactgttactcttctactgtgatgcagcctcaaatctcataaaaagactccataccgcaatacnctcttgctaagacactagcataagtcgctagtagcgcgcaaccactcagataagacgactagtacgctctctcngcgtcgtcttattatggtcttcgggatcaatgagtagtcgtaccgatagatataacctttagaccgcatccggaaggtacggtctcctatgtcatattccacgtctctattgagatacatctaccgcttcagacactntaaagcaactataagtnntgcagccactacacaatcaggtgagcacggctgatgatgacccgtgccgccagcacatcaccgaacaaattaaatctagccacagtgcaccctatgatgctccaagagtggcgtatcgcacgctcatctttgagttctatgtcctgacgctctcagtgagtgtttcgaatccacgcatgcggtgctacgagaaaaataagtacaataccgaataaaataatatcccttncagccaagataaagatgaaattacaacttcactctatagcaaagcttacactcccgaaacgatgtaccagcgacgatcngacgcacaacagcgtctaatagtgtaatatcctatgtaaggnatgtcatactcgtttaggattcctgtctattctaccatagtt

SEQ ID NO: 20457 - DNA, 480 bp, Homo sapiens
ggccggttggagattcatggagtctaggtcctgccgctgcggaggggccgatcgcattaggggcggctggagatttatcacggttacgatgccggccgaggaatggtgctagtggaaatatgaatgttaggggtgatgtgtttaggtgtatggatggtgtgcactggtggtgtcggttagtctagaaatcgagaggggatgatttttcggggcccaccggagtggttttgcggaagggagaagatggggacgggggaggtagggaacctgtcggagttgatattgtgtctgtgctaaccgatcgagtgatgaaatagtgtgcgatatgccggtcacgtagtatgatccggtgatcacgggcttgagataagagacaatatgcatgctatcggttgagtggtgatttgacatgaatgagtgtggagtggcgaacgggagggattgcatatctggcgagactgccgtgtcctggggctatgg

SEQ ID NO: 20458 - DNA, 780 bp, Homo sapiens
  misc_feature (1)...(780): n = A,T,C or G
cccnttntgtcccatnangaataaagnnaaaaatgnntnccanaattgttcncngggattttttaaacctagcgccccttataangggacttcttttgccataancattccccnnttttttagattttttatttagaattttatccatatacntgttntttnanaantttcaaatctgggaaaaannnnttgttgacccaagnncccaatncttnaanatttcttttttttntgtccnccaanngtaaaantaaatatcnncttgtagaaaatgtcnattttaatctactcacanattncntggggnnanaaaaancaaaatgtcagtccctagcaaatgttgccatgtaaaattggaancaaagtaatgattacacacccagaggattaagaaatttttgtaaccngaaaagntntatgtttnaatttttnatatacaattagaataaattaancattgtcaggcntaataaacctttgctntctnataaagttaattttaacatatttctttatctccttnattgtatcatcaccattggtttcataatgtaaatacatatatgttgaacaaattanatgtcaaaaattttttattaccatagtccatgttaanagtggggctttcaggtgtttananatttttttatgttgttgttaacatntcanttgcaaaagtactagatggtgtatactctagagttgaattttaagggattccctaatangtatngctatcttttaatctnaagttataaataaacatcgatncggcccggc

SEQ ID NO: 20459 - DNA, 897 bp, Homo sapiens
  misc_feature (1)...(897): n = A,T,C or G
taatttaatttaagttgtgacaaaaaaaanttttggaaataaaatgttcaaattcacggggccaccttgatcttattttcgatttagacttcctttggaaactacctaattcccttccttatttagtgggcatctgtctcatcttgatagtcgttttcatgatcacaaaatttgagcaggatagacatagagctataagaaacagactttgtaaagaccaacttaagaaacttcctgtccataagttctataaaggagatgagtttgatgtatgagccattacggtggatgagtctgacgatggtaacatactcggagatctatactgtattcatgattatcattccaagctgtgttctactgtttgcttagctcatcttgtgcttctcttgtcttttgcgatttcacctatcctgcttctatctactagcgagcgacgagtttagacttttatttgtattgcgttatgatattcgatatatgccttttattttctctttttctattgctttcttttcgttttgtgatggttatgctcacgtcatcttatgttttttcgataaacttttctactttcactctttggattgatagttttcattttgcttgcgatttatcttttgccgtctctattggacgtatatttagtagatgggcggcgcatcgtaatcgggttcggtgcttgggtttgcctgtatcctttttttctcccctcgttatttccgctattgtctccagtcctcatggatctcttcgattcgttttatgttatttattatactctgccattacgtggtgcgtcggttttcagcattttgggtcggtttctcgtcacctcttggtgtggaaagtttgccgccgtcggcccactctaacccatttacgttctacgaaccg

SEQ ID NO: 20460 - DNA, 1301 bp, Homo sapiens
  misc_feature (1)...(1301): n = A,T,C or G
gaaaaaataaaatattttttattatattttattataattatattagtattangagtttatatattataatttattatttttatattattatataaataagatagtatcttttgtnattaattttgacgtctatttgatcctntganttaacgttctattatatattaattaagattgatattacggagtgggtcaatattctcttcagacatgtacgcgcnacatcctcgaggatgatcactacgaaccagcgatgacgacanaagcaccacgaggcaggaagcacgcgtagcccgtaaatatgagaatacgagccttacagtgtgcgcaacgtgtgctctgtggtgttgtgcgctgtaggagtagcgcagtctcgccataccatgtactgctctgtcgacgccatcgcgcctctgcgcgccacgcaagagatacgcgcagcgcgccgatcaatgatgcttagatagagagagacattgagagataatcaaacgtcaatataggtgtagagtcaagatgaanagcanacgagagtacactcgacctatctgccactacacacccacgcacctactccaaacgccccttcgctacattcgacactcgtctcaccaatctcatttctggtgtccgcgcatctcaccgccgcggcgacggcgtcaggcgtgtcgtgtagtggcggaatgcgtagcngcagcctagtgccactcgtccgccgcgtaagtgacgcaccacagtatagatctcgtacggagtcactgcgagatcanatcgcgtcctncgagtatgacgcactacacgtagtagacacggcgcgtgcagcgatgttaacaggacgggcgcgtgtcgagagncgcgcacgagtcgtgttagcgtnggcgtacgcctatcgcgacacaacgccgtgctgcttggcgcgcccgcctatcacgacctcgcacgcacaaacgggccgtatcgccgtcgtcatcgcgtataatcgcatatacaatagacgcgcgagtgcgtcacctgactcgatacgcatgaacgttgcagcgcgcactcacgtagttgaggtatagtagctactgacgcgcgcctcatcaccgtgctcgcttcactctgcgcttatactgagtgactgtctctcanatcgctcattgcgtcgcgaccgagtacgcgcaccacgtgtctcatgtacgctctatgcatactgcgtatcccgtacgcctcgtccagccgtgtcgacgctcagacggagtactcgccactctgacgcgcagcaggcgactgatcgctctgcggcagcctccattcag

SEQ ID NO: 20461 - DNA, 1811 bp, Homo sapiens
  misc_feature (1)...(1811): n = A,T,C or G
tctccggttctcgtttcgcgccgtcgtggcgcttgctgctctcgcgccgcgcgtgttggcgggcctggtggctcatcgtggtccgctgtctcctcgcgtgtgcgtgatctgcggttcggctctatcgtgcgtctgctgcgtgtctgctcgcgtctcggtcgtgctcatctcctctttgcgcggctcgctatgtcgggtgttcgccgcgctctncgcgctcgnctctccgtctctgcgngatntcgcgggcgcggtcattcctgttgcaatgctcggntcgtgtgcgtcgctgtgcggtcgtnatgtcgctcgtgcgtctcggcgcgntcgtgtattcgtgtgtctatctctcgtcacgtgncagtcttcgcggtcacgccctcgtatctcgacatngtgtctgtccagcttcggctggtcgcgccgcncgctcgcgttggtcgtgcctgttctctgacatntgctcgcgtcgattcngctatcgctctctgcgtctgtatcgcgtgcgggcgcgcgagcgagcgcgtcgcgcgctgtggtattctngtctgcgtcncatcgtgcgcgtcgtgagncgctatagtgtnntacggtgcgctcgtctcgtgctngncgncgcgcttatccctgcgctcgtcggctccgtggacgatantattcgtacatcggcgctatcngcngctgttctgtggtcggtccgctctgctcgacgcgtcgtgctcgtctgcgcgtccatcgcgtccgctctcgntgcgcnttattttgttgncgagtctgtntctgtcgtcgccgtgcggctgtcgcgtcngtgtcgacggntggcgtctctgtctgcgctcgccgcgncgcgctgcgcagtccgccgtgtgagtattctcgtcnggcngncgcgcgtnggcgcgcgcgcntgtgcgtcgacgctttgcgctgcgtctttgcgcggcgcgttctgctcgcgcgtgcgcctctctccgcgcgtcgcgctcgcgncctccttctcgttgtgtcgcggtcgcgtcgcgtcggatctccttgcatccgngcggcggcggctgtgtctgagcgggtcgtcggcgccgtatctgcgtcaggantccgggtctgtgggcgctataccgacatctgattcggcgtcgcctgcgcgtgcggtgtcgcnggggtcttcgctctctttctgtcgccgcctcggcggcgtctgcctctctctgtgctcggtacgcgtcgcagctgcgctgtgtttgttgactcggcggctgcccctcggtggtggctgcgtgtgtgtccgggtccttctcgtgcgcgtcgcgcgcctcgcgcgttctcctgtcgctcctcgtgcgcggcgcggcgaccgcctatcgggtgctgtgcgtcgcgttgcgcgtcgttctcgcggtgccgctcatcctggctgttgggcgttattcgcgtgctgcggtctcgcgctgcatcgttgttgtcctgtcctcgtcgcgcgctcccgctctgtctccgtcctcgcttgggttgtggcgtnggcttctgttgtcgtcgcgctgncgttctgtctcgaacacaactcngtcgcgtcngctcacgtccgctactctgtctcgtnctctgctgcgtatgncccgatctgtgtangttgctgtcctctgccgngttgtgtgctcgctgactacgccgtcgttgcgtcatgtttgttttcngcctgcaccccgggaacggtcttcttccctctttccgctgtgtcacgtcttcgctcggtcgcgccgcgcgctgcttctctctctcgcctcgtctgtctgctcgccactccttcgtcgcgc

SEQ ID NO: 20462 - DNA, 719 bp, Homo sapiens
atttgatgagtgaagaaaatgaaaaagaacgaggaaaagatatgagctaacaattgatagtggtctggaggaaagcggcggaaagcaggtggatgtgcggggaaaacgcacgttaacgatgaacaaaaaggcacaaaatgttgatgacaatgaattggaataaaagaaggtagtaaaagaggatattgtgtgcccaagagaatcaggcggaagtgtaaaaggccaagtgaggaggtgcgcgcattggagaaggggatgttaagggtcgaaagtacaggcataaggtggcggggcaagaagagaccagggcttgagtaaagtgggtgtggatagggtgacaggagcagacaggcagacaataagacggtgttgggctcctcagacgggttcagtgctgtgtgcaaggaattttgtatctgagcaaagacgtgagcggcatggccctacagcagaagacaagggaggcaattgttcatcatggcaaaatgaaaggcatggaggcagagagtccaacaaaagggacagacaacgaaagggatggaaaagagacaaggatgggcattgtgaaggtgaagaaaaaggcaaggtaggaattatccatatgcctagtcccttggccacaaccccaatccccacctaccagaaacacctgcaataaactattagatggataagaaatagcttccatagtcaagccattgaaaaaaaaaaaaaaaaaa

SEQ ID NO: 20463 - DNA, 788 bp, Homo sapiens
cctgtctggactgtggagctcggttctgcaaacactggccatctaactgctctgcatgaaggagagtaaagggtggaaaagacggttacttggttttgagtaagccaccacacacatgatgccgaccacaaggagggcgatgcagatgccgcatatgaaatgggcaacccattgagcaatccctgcagctcctacacctcgcacccgccacacccatttttttttccggaacctacaacacgcccacaccggcgatgagttcttttttttccaccgccccccccgcgggattccccgccattctggaggtcgccgccaccacccctacgggccactagatgcgtccgcaagcaacgacctcccaccccacaacccctccaccgactcgtctcccaatttccaccaccacacattcgagccgccaccataacatacaaaatcccataatcccctacactcctccaccctcacatacgtcgtcatatttatcacaacccccccccccccccgctcgcccacactagcttttctacgtttccacctctaacacgcacccagccccctaaacctacaagataccgccggttgatcgcgaccgtcaggacaaacactccccacactgcaaccctgccagcagacccaacctcccgcaccccaacccagccacacgttccccccaccccactaaccacccacacatttccacgccatcccccctctcacaacataagcaacgcactaacaacaaccaccccctctcccctttctttgcatcccgcccataccag

SEQ ID NO: 20464 - DNA, 1150 bp, Homo sapiens
  misc_feature (1)...(1150): n = A,T,C or G
agggaaaggtgaggagaagaaaaagagnnaaaaaaggnaggaggnnaaagaatgnaaaagnnnaaaaatnnaaaagaaaaaganaaagaaggaagagnaagaaagggaaaaaaagggaaataagnatttnnntatttgtaataaatatgtgagtaagagtnnaagaagggaggnnctaaagatagagatagatgattagaaggaatattatagttaagaagacagagataaagaattaaaataaacccgagtatagacattagnctcggtagtagatcacgcccagcagaatagctatcaagttagtccacgagaatagcctgcaccgatttcnctattgcaacacncctatcaaccacccccacaagaaccccaaaatccctccaatcacccaaccccacatataaatcaaaattcattcacaaatcaatatagtctaaatatttgatatatgccatatatatcacaccattcccccgtgaatttactaatattatcaacgagccaataagacaatagataagtnacaagagagtgatatcactaagaggccaaagattgtccgtgagttncaactcattttgcaatcttaattataggccnaacaacctggccccataagatagatagttccatagaaccacccaactcccccatataccaatgctcncacacaacccctctaaccacaccagattatcacaattcacttccgataccctttatagttctgcccaaagctcgaattctcgtaatcccaactacatacaccntacgttaccaagctctccccgaaacttatagaagtgacgttcagtgtgaacgtataacacacgacacactatccaataataagggtactacacaaatactatcatcattactcaagattcgccaagaccgcgacgaaaggaagagaaaaanncacacgatcactgtcatataatccccgcaaacattatnacataaaagagaggagagtcaaagaagacgagaagtctcaaaagtaagtannacacaatagactcagacgaaggagcncaacacggagagccacatcgaccattaaggtcactaagagatagacaccatatataacccaacacaatgaaaaagaagaaacactatatcccaagaaagtaaagataag

SEQ ID NO: 20465 - DNA, 854 bp, Homo sapiens
  misc_feature (1)...(854): n = A,T,C or G
gcttgtcaggagactaccaggcaatgaaactgactcttctgtagacctggatagagcaataaaacactgactgtgaatgatgtaaggaacacttactcctccctagaaggaaaagtcagcgaagataaaagcagagaatcccaatctcttctaaaaggtaaaaatgacacaaaataaaacattcacccagcaacacagaaaacattttttttcacgaaaaccccccaaccaaccaaaacagaaaaatttttttttttacccaacaccacaccccaaagagacccaacagaccggcccccgcccaccaacaaacaacaaccgcacaggccagaacaaaaaaaaccacccaacccccccccccgggccgccaccggccccgcacgaaacaaccccgcgaccaccccgacccacacaaacccaacacgaccgcacgccgagccacacggagcgaacgaggagcgccgaagccaccaaaacacccccacagcacgacaccgaacanacggcggaccgcacaccccgcgcaagcgcgccccacacacagcaacaacaagacaacgccacccacccaccgcctccgacaccagcccacgcacaccccaacccaacccacacccgcacccgcaacgccaacgcacacaaacccccacgaccgcccacaaaagcacaaccaactgcgccngaacgaaaggagacccgcccgcaaccaacaccaaaacaccacaccacaaccacacgccccaccgacgggcacccgcacggacgacacccccacgagccaccgccgccacccccacgcctcccactcaccgcgtcccgacacgcacccctcgacccagcaccacgccccagcg

SEQ ID NO: 20466 - DNA, 1193 bp, Homo sapiens
  misc_feature (1)...(1193): n = A,T,C or G
agtctgcgtatatgtatagcgcggctcgcatgccagggtagtcgcacacgctcattcacgcgaaagcaagaatagggatacacgacaacgcgcgcggagttatggcgccggaaatcgggggcgatgcgcggacgtcatagttaccggacttcatcaatcttattggcgatcgatgcgcgcatgtcgaggttatggcggtgttgtctcgcacncgctaaacggcgcctgcgacacaacgatagatctatactgtatctccgccggtcaatgttcctccgcgtattgccgacgctgcagcagataatatacgctcgcgtatcgcgagcagcaggtaaagtatgcttggtagaggcgagtgtgagtgatgcgcgcgcagagctcttctcgactctatttatacatattgtgatatcgctgaccactacgccccgcgcgccgaatatatttcctatacggtgcgcgtgtatggtaactcgaaatatgcgatcggtgaggtcgatgcctgctgccacttactattcgaatgggtgcggtgggaccgacattccgtgcttgagcgccggggaattgcggcgttttatagtatgcgggggcgcgcggaataagcaagtgccgcgcgagattgacatgaatatagcgtgggcatggggaggaataacagatacgctcgcatagtcgcggtatcgggcgctatctatatactgttgcgatcgtactggtgcattaatagaatggcgtgcgaccatacaacgagcgcggggaaacagaacgatcgcggtatacgtgtatcagtgccacgcgattgcgatgatcggcgatccctgggggggaatgtaaatgggctctcgcgacgatttccttctgtctgctctggcggaactctatcatggtatatacgatgctacatacctcgcctacaacgaccgacctctgcatcaacgcggtactcggggctgaaataaacgggggaggaaggacatctgaaccaatatctgggacaccaacgcacatatccgaccccttaaatagtaagtttgtcatctttttattcgcacgtacccctatatatttcctcccctaaaacatctcatgtacaacgccaagcccgctagatagtacaaataatattgtagggacccccaattagagagatgtcttcgagcgtgcaccgacccgctgtgctttgtgtcccc

SEQ ID NO: 20467 - DNA, 746 bp, Homo sapiens
cgttgggattgaaaccaatgggaaaggtaaaaactccaattaagtggatgcctcatgagctgagtgaaaatttaaaaatcgcaagtttgaagtgtcatcttctcttattctacacaacaataaagaaccatttcttgatcggattgtgacatgtgccgaaaagtggattttatacagcaactggtgacgaacagctcagtggctggaccaagaagaagttccaaagcacttcccaaagccaaacttgcaccaaaaaaaggtcatggtcactgtttggtggtctgctgccggtctgaaccactacagctttctgaatcccggtgaaaccattacatctgaaaagtatgttcagcaaatagatgcgatgcaatgcctacagccagcactggtcaacagaaagggcccaattcttcttcacaatgtcttgactgcacattgcacaaccaatgtttcaaaagttgaacaaactgggctacaaagttttgcctcatccgccatattcacctgacctcttgccaactgactaccacttcttcaagcatcttgacaactttttgcagggaaaatgcttccacaaccagcaggatgcagaaaatgctttccaagagtttgtagaatcccgaagcacagatttttatgctacaggaataaacaaacttatttcttattggtaaaaatgtgttgattgtaatggttcctattttgattaataaagatgtgtttgagcctaaaaaaaaaaaaaaaaa

SEQ ID NO: 20468 - DNA, 995 bp, Homo sapiens
ttaccatgacgacagagatgatgttgtggattattgggccaaaagaggaagaggtcgtggtacttttctttgtggcagacggcgctttaacttcaaaaaatcaggtagcagtcctaactggactcatgacacatacacaggggcatgggacttgcacgcacacacgccaacatcacacacctccctacgacacacagatcatcattcaacactacctccagctcaatattctgtctctagtactttttttatacctcacataacacaatgtatgtcatccgtctcactacacttatcaatcacaacacactacaaaacaataactaccccagaatataaacaagaaataataatacccgtcatccaaactccactaaatctctatctcgacatcaacgcatcacccttcatccgccattatattaccaaatcacacaatattaccaacaattaatatcctatatcatatgcccccagaatccatattcaccaatcatccctatctcatatctcatattccacacccccctatttaacatataatatgatacatcgagaattaatgccattgccctcatacccacaacccacctaccgatattcacaattacactcagccccccgctactttatcatctacatcgaagtcatctcatactctaaaccagctcgcattacagatcgttagattctcaaaccacccttactttctctcttacacatacattcacacatgccgtatcctacatcatccaaccgcgagtatatccgcacatatactcgtctacactccactatattttgtcgcgtctatattcgtccctcttcgcatccatctatctttccacccacatccccatctccatttacagaccaccatcgccccacatactttatccattcattaccccactaccctattctgttgtccgccagctgcaaatccgccaagaagatatcactcggcgatgtatatcaaataatcatacattatg

SEQ ID NO: 20469 - DNA, 998 bp, Homo sapiens
  misc_feature (1)...(998): n = A,T,C or G
tcttatctgctaccttgtggcgtcnnntttgccacgacttgccaatttcagcagctgctagagaaaccattcctaggaaagtgcccggcaggacgagggtaaagaagaggaacctgtggctgaccaagaacatcgcctgaactctaagaaaaggctgtccacatccacaccctcccgtctcctagagcctgtctctccctaccctcacctccaactacactctagtagttccttgctcctcccgcctcaccgatcgtcacaaccaacaacttcccacaaaacttccatgatatcgacgctagacgaagctctggacacgccaacgtacaacaacaacccacctcctgtactcgtctacttatccccatcaactgcattagccgcctcccccgcccccttccgccctctctttccttactttcttccccatcccctacttcctccttccttttcccgcaccccctcccttcctcccttccccctttcccctactccatccccgcgtatcttattcccgatcacccactcgcgataaccggccaaccccccccactatagcggaactttttattgaaccgatatgttgatgtctgcgccgctccatctcccccccgtttcctcctctctcgatccaccgactcaccacccacctgccgcaggtataagtcccattccatttccatagctcctctttcacacctacccccgcgcacattatcctactatccatactcctccctctatccacgctccgccgccttcttgatatgccggcactcactccgtagcaccagcagtattttttacggagtcatatctcgccctgacgtgatactcctaccttatcccacaccgacaccgtctctcgtttccgcgaacctgcgcccgcagtcctattgtctatcgcgaancntcattcaccgttcctcatatcgatcactacctcacacacccctctctcacccctatccccatctcgtaactcatcatatataatg

SEQ ID NO: 20470 - DNA, 1109 bp, Homo sapiens
acctgccatgccacgatgagcagaagaaccaggggggtaggggtatagagctggagatgataaggggtgcgtggaacggaggagtgaaaagcgggctaaaaattgcacgtggaggcactacgccgcgcctacgtaatggtgatatggtactgcaatacaccgcacggaactcgccaggacacacccggaagtatagaacaatactaccgttatccacctctgaccttgcccggcgtcgtcatccgtccgggaagcgtccaggcctcctagggtagcgtaaatcgggacgacattaaagtgtacatggtcggcggaacaatgggggtggggcagtgtggggcagaaacactaaaactgggtgagacagactcgaccgatagatccacaggcacgtgctctgtgctgcacaccgtgtcgacacatcttatcgtgttattatattcatgaattgagcccttaagtttgccacgtgatcgttgaatcatcactgctatgagccgattgctactaggcacgttatctagtggctatatcatacatccaccatgacttatgcttgctctagcgtctgcaccctagagcgttaggtaaatggagtggtacggtaggatccgagtgtccgccgagcactcctcataggcaaacgctcactaactgtttggaaaattacacagatgcatgggtccagcggccttgcaccgggcagtccgggtcttagcgatacaacgggcatacctgaatctatgatggtaggatcttatgaggggatcagaatatgacctggagtttagattcttacttgatccttagatcatattattgcgagatacgtatagtttggatacaaagtatgcctgtcctcgagatgcacggctcgctgcgccacaaagcggagtcatgtgagatgcatttcgaaatgatgctacgtattgcactgcctgtgtccggggcgggctaacgttctacgccgatgtggtcggtaattgatatcctgagacgcaactatccgtcacatgtgaaccggcaatgcgtgctgatcaagaaatagatgctatattcccacttaacttgtcccgacgtttacgtccttctcgccacttcatttaccg

SEQ ID NO: 20471 - DNA, 174 bp, Homo sapiens
aacaacatgggaaacaataaaacaagaaccagaacaccctgcgtctcaggcagaagaaaatgatgatattagaagctccgcctgtgaagataattttacctgcagctgaaataccatgacccagatattgaacacacagaataattaaacttttcgtctagaaaaaaaaaaaaa

SEQ ID NO: 20472 - DNA, 914 bp, Homo sapiens
  misc_feature (1)...(914): n = A,T,C or G
aacccacccagacacgagtcgggggngnagnnntttaacaagcattggcaatcttggcaaaaaccttattgaaaactttcaatatccaagccactggcaacaccgaaatgtaggcaaggatgcgaattagcaggagctctaatccattgctggtggaaatgcaaaatgatacagaccctttgcaaaacggttcagcaactccataggaaaagagtatgctgacgtgctgttctatctcattgttgctatcatttagaaccactctaaattcacataattgttagaacatccaacacaataacactaaccacctcccttatttttcacatatcacccaccctccgtatataatactctcaccatatacttcctcccccaaaagaacctcaaacaccttacgcaatgataccacaagctctccacttcaacatctatcattacaatactaatcaccatccaccatatcaccccaatattatagtcatctattccctcaacactgcattactatctcattaggcctcaactacacattgtcatcgcgcacgtccacactaaccacgaccccccgccctatattgaaatcctcgcgctactcttttataatgaaaaatgctttatattaagagtaacaatacatcaaatctaaatacagtattaacaatctaccccgtccttcacgtttcccttgcaatacttcataccattttattcatataactaattagaacaactaaaattctctattccacaccaccccctcctcaactcttattcacctctaattatgtctatccattattaacactaactcttctagtctaacccaactacgatactaccaaccccagactaacaatttgtacatatcaacccacaaatgcacccattaacgaactcaaatcatactaaag

SEQ ID NO: 20473 - DNA, 1267 bp, Homo sapiens
  misc_feature (1)...(1267): n = A,T,C or G
actgtcgagtggctatgaataactagagaggtgggggacacacgatctgtgcagggcggtggcgtaggctgtgaagtgccacaacaggagatatgcgattgtagacatgtgtggtgagctcggtggtatnttgatggtggcagacggagctaactgcnatgtctcggtatgactactgtgtatcgaatgtgtgtactgatagtgtgtgctgtatatacatcatatccgcgcgctaangatggagacgcgtgatttccagctatacctggaatacatacgtgcggttggacatcatgagtnctggatcatgtngtattggaacgtgatatggcgatggtggaatgtggcagtacgttgggcgtgctcgttcttaccctcatgtgttgtattcgattgaacagtatgttgtgctttacacgggtgaactatctatctatagacgacgatggtggtgtatagtagtgcgggtcgagcggggggccgatgacatgtcgtacaaccgcgtccatgtctcgnggacggttcttcgtcacgctggcatcaatacagtaagcgcccgttccataatgtctgtccagagctgtgattcgtgtcgtcctcaaggtagatcggtggctcggtactaagacataggtgtgatgtatcttcagctctatggcgcgcatggcagtatgagcgacgagagcaaagctaatatacagtacacgtcgcgtgacctgacgtgatgcaccctcggtgtatgtgagcttaaaggcaaagcagaggcttgttgtgcgaccgggtatactaatattgtatatgtggtgtgagtgtgttttaatgcgtcctctatcattgatcgggaggcgatgattgtggtaactgggaagatgcgcactacggtaagacaaggttggtggagtgttggtgatactactccgaatcagaacagtctacacttgtgtatccctccgtggcgacattgcatgtaattggtgatgtgggttgtgaactgtcaggtggaccgcgtggcgcctttggcgtatttccgccgtacttacactcatgcccacttatgtcccagtaacacatgatcagtctatctaccatatctgtgtgatggggggggacacatgttcgtgttctcctgtttatgagcgtggcgttacgtggtatgttctctctcgtgttcaaaactggcttgtcgattggtactcacactcagggtatggtggtgtggtgcgttcactgcactggcggggcggtcgtaagctaaattgtgtgacgt

SEQ ID NO: 20474 - DNA, 885 bp, Homo sapiens
cggccacactcgactgcccccaaacaaattgaaaaatagaaattttcagcaactcgagagaggaggtcttgtaaagctgaaacctcatgaggaacctcttcgttctgagattttcagtggaaaattcaccatcttagtccacctaatcatcctgtgaaagtggattctctatggaaagctctgtttgctcactacaaatacatgcttattccttaagggatgcgacacagtccctgtgcacctcaccataacaacccccccaacacaaccttgtcagggccctcaatacccctcttacagaatgcaaacctattcatctcccacaatccccattatcctcatttaaacaccctaatccacccccccaccccccacaacacctacaaaacagcaccacgaccccacccccacacactcaataacacccccacctctcttctctccacccaccccatcaaagtaaaaccctacattcattcatatcacaaccaccttcccacaccaccccccccccttaaacactgataaaacgttatatcccacccccaccccaccctaaccacaacacaccaccacacccacgctcaccacattaacccctacgactccgcgacttagtacacataacactataataaatctcatctcagcgaccaaatgaaatactatcccgctctacacgcccctgatccatcgcgtgcatctgtatcgtgccccacgcactcctcctgtcgatctttcatagtaagccaatcataaatcgtcttcactgccctccactccttctcaacattacaacaacagaacactcttagccccaccacgactattattcgatatacccaagatcaccatcgcaagttgtatagtttagtaatggtgagt

SEQ ID NO: 20475 - DNA, 774 bp, Homo sapiens
gctcagtgtaacaaatatgagctcatcttgtgaccctagaagaaataaatgataccaccttgaacacattataatcatcttgaacttttatataaatttctacagcaattctgttattaaaaaaaagaccaacaacgttggaaggaccttagtccaactttctgaagggcaatttgataacagtcatcctacataagctcctggactctgaaatcctacttctaattttttgtcctaaaagttatagatgttgcaaagattagctgtaaggatgttcaccatagtatagtttgtaatataaacaaaacaaaaacagaagaacactaatagcccaataatatctggtgcattaaataaaaaatggtatcattgtgtaagcgaaatacctacaggtcttaccaccattagaaataaaaaaaggaagcactgactaacaatcgcgaaatccttgtcttttaaaaaagaacttttttacttatccatggatggaaggtcatgtcgtcatttctacgtattctttaaagtaaaagcaagatgatcacttgcccttgcgattttgaaggcaacaatacacttttgaattgctttctttttctatctttgttttctcattttttcccaagatttttttactaaaatttacccaccttagcataaaagattaaactactatggtcctccgcttgtaatgattataattaaaacaccctttccctccaaaaacttatcattaattccatggacataacctattacctttcgtatatatgcagt

SEQ ID NO: 20476 - DNA, 181 bp, Homo sapiens
  misc_feature (1)...(181): n = A,T,C or G
aaaaaaacaacatttaacaattcaataaaacaaaaaacaaagttgtggacaacaactgnagcgcttaacagggcaaacaaaaccgccgctcaccctcacgccctgctaagctcccggggcgacgaggctgctgcgttcacactaataaaatccactggtgcgtctgtcaaaaaaaaaaaaa

SEQ ID NO: 20477 - DNA, 309 bp, Homo sapiens
  misc_feature (1)...(309): n = A,T,C or G
ttttatatgnanttccccagcgatctcaccctgncacccattctagagtgcactgacacaatgatagcttattgtaacctcaaacgctccgggctcaagggaccctcctgcttcagcctcccaagtagctaggattacaggtgaagagaaatgaagctcacatgttgaaatgagtggccccaaggattaccagaaaagaagttaatgttcagaaagagaaaataaaagttctctgtattttattttctctcagagataacaaaagttgacttttgttgcaaaaaaaaaatattgggctcgttggcctca

SEQ ID NO: 20478 - DNA, 818 bp, Homo sapiens
  misc_feature (1)...(818): n = A,T,C or G
ataattgctccgtttaaccnacncnntttttttttttgccaattcatnctggcagtttctatcattaatctttaaacccactgattctttccttggccatgtctgatttacttgtttgttcaatcgaggctcacctttattatcctggagctctgttagtgtagtggtgatagggaatgaagatcttcaccggaattggcctcttgatcttggactttccagcctccagaactgtaagccaaataaacatatcgcgtataaataatccaatctgtggaattctgttataacagcaaaaagtgaactgagacttttttattctttatgactctgcacaaagttcccacaacccaaaataatctttccagatgtggtctctcaacttcagagtcctcaccatatataactgattacagaatgagactttgaactttaaactttttacttcgttctgtaacgtgttcagacttgtgggcattgtgatacatgagtttgataagcaccgagttttaattggctaagggctgaagtgccctacttaaatatttgttccttcgatatggctggtgtttgtaatctgaaatttgcatattttgaatgcaatgtatttcatgtattcgttcttaaataacctctctacccgtccctctttttttatcacgcagtgtctgtagcgttcccggtaagtggtggcaattcaaaacatcataattattatcattaataatacactatttttcggtgatgcccaacatttatttatcggacgactcacaaagtttcagttgtatgaagatttatggaagttagtatattta

SEQ ID NO: 20479 - DNA, 1338 bp, Homo sapiens
  misc_feature (1)...(1338): n = A,T,C or G
gaaggaaaaaaaaagagagagagggannggnagggganganggnnnngaacagagcggnnanaggaaggnnnannaggagattggtgcgaagatannnannaanagagtggnanagnagcgtttgagntgcactnngngacagggnnatgagngtnnacagtacagcgattannnctactgtnanagaacacacgacataggnangtccgtgtgtncacagtggagacgacantngatatataggnatntgtagctaagtctgtgnagagagcagagtacagagagagatgtacaccacgtagacataanatncacgttagagacacctagangtaaatgtaacagtttatgagtaccagatgggtgtcaaganagaactctatacttccgagcgtcgtgtctccgtggcncgcgcgcgtnactacctccgtgtccgctcaacggcncacgaaggacgacnccctcgggccatccgcctctccgcctcaccgtcgccactcgatccaccctcctnctcaccatatacacacttaattcagttnctcactcgatcacgacagtctaggtgtctttagtagtttcatagtctacgacgtccctgataatgtnttgttagtgcctgcactgttgaaggacgacgtggtgagctaaggaagtgtggncgcgaacgccacatatcctgacatgttctgactataacgtaggtacgcgatgcccctcacggtgccccagagacactatgccgctgaggagcttctgcgccctcgccggtactcacgtctcttgccgatgcatcaacagtgaaccgtatgcnctacacatttcnagacgtgatattgtctgatcgagttgtacgtcttgcagtgtgggtcgcagtaggttaccgtagtgagcagagacgatgtgtcatcaggtgataacgagtacagcttagacggtgcatatatatgagtggcatcgccgttnagtatgtattcgacttcacatatatctcccacagttgttatatgtacactacgatctctagggcattatatttacactttctacccctccagcagcctcggcatgtcgagtacagtctatgacacgccgagtcgccagtggtaccgatacccccgcacgctttncngtacagctgagcgtccgccgacaagtgcgaanactgaagcncacaggaataagtccacccatgggcgctcgacgtggatgtacnntcacagaacagtccagatactgctcctcgtatagtacattctccgtatcgttcaatcatgatatctccctgcaggacatcaggtaggccttccgtggacaccaatcatatggtacagcag

SEQ ID NO: 20480 - DNA, 839 bp, Homo sapiens
  misc_feature (1)...(839): n = A,T,C or G
ttgctgctttnnccgggtncatggcatgtgncgacctcttggtcgagaggctcctgttgtgtccgacactgaggccaccttctctgggttctggaggcggaaggcctggctgtaggtgaccgggcgtacatacaccccttccacctcgttatccacaatgagagtgcctgtgagcagctggcaaaggccaatgccgggaagcccaaagaccccaccttcatacctgctccaattgatgtcaagacatgccctgtggatgaaaaggccctacaggaccttttttttgttttttggtggagaaggttgacaccgaatacaggtttggggggcggcccgggtcaatgaatctcccacaactgttgttgagaaaagagtaggggagggcatagcagagaagagtaatggagagagcggtgtaggggggatgacggcacgataggtaatatgagagagtgagagtaagagtgtgagtgtgtgaaaaagttgcgagagagaagaaaagagtgtaggttaggtatacggataactgatcgacacttggagtagtatgtagttgagggacaggacggaaggtgagggcggcagactgagtaattgggaaagaaaggtatcaatgattagtgtacggtgaacacgaaactacgaataagacacaatataactaacggcagtagttctttatatgattacacatgttaaatacaggaataaaggaatggaaggagaagagattcatggtggaacgactgagaggagtagaagagaacatgaagagagcgttatgtcgagaataaatgagaaagaataaatgaaatatagtattgagggaggcggggtgt

SEQ ID NO: 20481 - DNA, 790 bp, Homo sapiens
ctagggaaccggaagaagacttgtaacaggaccttgcataattaatcgattgatcactgaacttcattgtcatatttctacggtcaaattttgggagaaagctgtcgcaaattcattagagtgtagcaatgcccgagttgtaacagagttccatctggataaaaccaagatagaaattgtgcctcataattgatattttgaggattccatgaagtaataaatttattatgtgctaagaaatatgtgcctgatggagtcttgttctgttgcccaggatggagtacagtgacacgatctcagcttactgcaaccactgcctcccaggttcaagcgattctcctgcttagcctactgagtagctgggactacctacaggcttgcgcttccatagctgactaattcttgtatttttggtagagatggggtttcaccatactagccaggctggtgttgaactgacctcaggtgatacacctgcctgggcctcccaaagtgccgagattacaggcgtgagccaccatgcctggcctattttggtatttacttatatttgaatattcttaactctgttattggtttatgtaaacaaatagttaagaactttcaaagataagtgtattttcacaattagtttcatgataatttttgctgcatcttatccttggaacaaaatggtatataaccctcagggaagaaaattatcttcactgacactttatcttctaaaaagaattttaaatgaggtgtaagcaaaataaaacatttaatctcaatgtacaagctggggagc

SEQ ID NO: 20482 - DNA, 678 bp, Homo sapiens
agagggttttattgtttcttcattcctttttttttttttggagtcacagtccatctctgtttctcttccagagtcattgcttttattatcactaaattacctgaaggttaccaattactataggagaactttcccttcaggcaagtcaagaaaaggaatgtgtcattttaataccaatggatcaacaggaaaattattgtccaagaaccccagtccttgattgaaatcttcccacttcttaaggagttgccccaaatctgttggtacttaaaatttcatctcttcaaaatggaagtggttagttgtttgaggccagagggtatgctgttgagttgtatgaggggaattcagatataaaatcttaggaagggagacagaatgggaaggaggaaggggaaaaaaaggataaggaaggggacagaagagaaaaaactctaaagcaaaaacagttttcattaaatgatgtaagtaacagcagttaactgttaaacaagatattggaacacacttgttattcatcgtcctctcctgtctctaataacatatgctgaataagtgacttttacttccttttattttacagaggtcagaggtcaactccgctcacccatgatggacagccaaaagaaataccgcaggctcctgtacttatttcctgcgctgtccagtgaagcgcct

SEQ ID NO: 20483 - DNA, 1555 bp, Homo sapiens
  misc_feature (1)...(1555): n = A,T,C or G
catatgagctactatacggcgctcgatcggtcggaagacagagagcgacancanaccagagaagcccctccaatatgcagtgatcngacaagancaggagcagcgagagagaggagacgaatgtatatagtaagtatctacangcataaggagcgattctcttgtgncgtcaganacgacgcggatcaggagaatgtagnagcgcgtcgtggtgcgagtctgaaatgtcgcaggagatgccacagcgtatactgatacaccgagcagagtcacgagtacattgataagtcagagttagaagcgcgagacgacacccgagacctcgagagcnagtagagtacataagccgatgaggagaacgaccgccacatgatggtgagatataggacctttattctaagtacttgacgcgcacgatacacaaccaacatctcttatccttttgtatctatggagagntagaatctctcaatgangagcgtcgantgcggtgacggtagnatacacantgcgngactacgagnctctcatctagctatcgagcggtacatacgacggagtgagtcgcgtatggntacactatatatctggtatatatacgttcacgcgactagatgtcacagtacactataaatagtctctggatacgctagtatctatgatccacactacagcgagtgactgttgacgtagtctgtgtatgctaagagacacatctagacgtcacacgcnagatgtacatcagacgtatattatgtgatgncgtatntcatgctatatactgatcgtatgcgntactgcnagtgtgaagatgagacganacgctgtatgatatacatcgcntgtagctgcgctctcacgtagaactactgtntctctggatgaagactcagttagntgagagtgacgcatacgtagaatggangcagtntactngtgcatatataggcacaaagcaacgaacngctcgagcacgcacgtacgtnctacagtctatagcgtcagtaccgcntgcactcgccgacgaanatacgcgctctngnctatacgcgagcagacatctcntgtctcaatgatctgatctacatagagagataggcagcacatgacatgtctcaagtatgncaatgtgtcatgactattgcatgtatacatggcagctcnctatacgctgganatactagttgngatggctgtctagangatagagctccnagcagcgcgctagtactgcgcgtgtatcatganctcagaantaatcaatgaagcatgcactgcgtgctatgctaatgatcgtcatactatacntntagatantcagccatnatngtnatcgtagcngttgcacgcgatgtcagatcgntctgatagctcatagacgncctntctagtatgatantanatcgtacgcantccgtncgccgacactccgcgacgcgagtgacgagtgcaatganatgacgcgtncgcgatatcagacanactacnantaccaccggcgcacatactagacgntcacacagtactacnacacgaatctactatgcgaaggctg

SEQ ID NO: 20484 - DNA, 502 bp, Homo sapiens
ctagggtttcttctgtcccaatgctggagtgcagtggcgtgatcttggttcactgcaacctctccctctcggactcaagccatccccctgcctctgtctcctgagtagctggaattatagatgtacaccaccacacctgactagttttttaattttttgtgaagacggagttttgcagtgttgcctgggctggtctcaactcctgggctcaagaaatccacctgcctctgcctcccaaagtgctgggattacagatgtgagccaccgtgccagccttagttaataattctttactctgttcaaagaactggtgtgggtattgtctccttattgaacctgactgataatggacaggccttgagcccccaagttgctgaggcccttatggtaaccacatgtgttattttgttttagttaacagtgtacacagagacatgaggaaattgtaaagttgattttaaatcaactttaaatcaataaagttgatttaaaaaaaaaaaaa

SEQ ID NO: 20485 - DNA, 861 bp, Homo sapiens
  misc_feature (1)...(861): n = A,T,C or G
ataatccttatttttttcacaaaaaaanattttaataatagttgaaacttcggcactattctatgctcctattaggagaggacagctgtctgcagacatctgtatggaaacataggataggaaatttcagagatgcgtcatatgaagaagggtgtatttcagcgagtagtggcaatttttatccacttattgtgatgtcaatggagagccagttggagatgactacatttaattggtcctcctccttttcagctatttatgtcagaaagctagtatggccatcctagctgtcagagtgctccacaaggactagaggcatgcaatttgttaggttctggctcggttagcttttttgggaattgtatcatgttcatcgtaattgtgtactattatttgttcatatatgatatacatcgactcctgctggagttccaactttattcgctattatgttacgaaggccgttatcatgttttattagcgctgtacttttatttcgtctatttgtagtgattttggtgtaaagccatgtggcctcgcgtcccgtgtcggttttaccaagcgtttgatcctttatttatctttgagaagatttttttattcatgttacattaattattagggacacggtctctctcttttatacacttttgttttcgtcggtgggggagtatataacttctgtggtagacaagattaatcatatcgggacactatttttgtccacaccacccttttatttcttctgcctccttattctattatattctggcttattgtgtttttgcgttacgcaaattatctatttttatctcttgtaagttttattagagtaattaataattgcgagttccttcttcg

SEQ ID NO: 20486 - DNA, 388 bp, Homo sapiens
  misc_feature (1)...(388): n = A,T,C or G
tattacaattttataaacatataataatttttaaatanntttttcaacacaaggtgctactgtcttcccgtcagtctgtgttaccccagaaccatctctgttctaagccaaggtgtggaagaagcccttcccataattctgctaagctttgtcatgcaatctcatggtatcttcatcagacatctgaattgagccttgaagtgtgagtaggagttcatcagggctgcatagtgttccatggatgcttagaccacaatttacttagccaacccctactgaggaacactgaagttgtttcctgtttttcaaaagtataaataaagtgtgagtacctgtaaaaagaaaaaaaaaaaataaaaaaaagcgaccctggccttcgttggcctca

SEQ ID NO: 20487 - DNA, 567 bp, Homo sapiens
cctaggtcaagcacccagtatggaatggagaagtgaaaagttgaagaaaaatccacacattgcatgaaatacaatgtgaaagctcctttgtatatcttggctcataggtggaagggacttgccttgctcagataagactttggacatggacttctggattaatgctggaatgagctaagactttgggggactgttggaaaggtgtgactgtgttttgaaacgtgagtacatgagattcagggggtaccaggatgaaatgatacattttggctgtgtccccacccaaaatctcatcttgaattgttatccccataattgccacatgtcaagggcaggaccacgtggaggtaatcagtgagtgatagtgagtgagtctcatgagatctgatggttttgtaagaacctggcagttcccctgcttgtactcacactgtcctgccaccctgtgaagaggtgcctgcttctcctttgtctcctgccatgattgtaagtttcctgaggcctcccccaccatgaggaactgtgagtcaattaaacctctttcctttacaaataaaaaaaaaaaaa

SEQ ID NO: 20488 - DNA, 710 bp, Homo sapiens
ccggttcttttagtcaggaggatcactcctgtggcctaagaaaatgaccaaggctataaatatccaacctcaaatctcaacaaagcaatttccaggttttaccttatatgcacatgtgaggcattccattttatttgtaaatgttggtggcattggatattcctctgtttccttctaatttcagtatggttttaataatgttggggtttaatggtctaacagtaatataatacatgttaatctcagtcatgtaagaaatgtcacatttatttaattcaaatcctactctggaccctattcttgctttggtgggaaatgtggcctaagtaattattggaggaccctctgcttctttggaatctctgaagtattaggaggccaatctggtatggggaaaatgaaggaggccctctctccttcagttcatcacggctgctgctaacccattcctgtcccagctgatagggtatctgagaagatgggtgattcttctccctccaagccaagcttgacaagactagaagctgtgaggtatctgatatggcctttgtagatgaacaattgagccatacccttgagttttctcacctccccaatgtattgccatgaggataaagacaggtccctattggtcatgacatcccttgctgcctcacccctgaacagagagagcctaaagtcctacctactttcttggaaaaaaaaaaaaa

SEQ ID NO: 20489 - DNA, 438 bp, Homo sapiens
aggagaaacgaatacagcagggatgacttccaccagctccactttgcagccctgaggtgtattaaaaatgacctggaagaagtcatgccacgggccagaccttaacattcctttcggcttaccccaggatttcagacgaagcttcactttcctaaccagtcacaaatcagagaatttttgattccacctatgacctgtgagctcctgcttcaagatattccaccttttttaggccaaaccaatgtataacctccaagtgtcggtttacactttcgactgtaacttctgctttcctgagatttacccctgcctttaaaaacccttgcttgtaatccctcagggaggccgtgtatttattaatcatgagctgcccaattctccttgcttggtgccctgcaaataaacaccctcttttctcccactgcaaaaaaaaaaaaa

SEQ ID NO: 20490 - DNA, 795 bp, Homo sapiens
agatcttggagacatctcagctttaatgaggactttccaacattccagactgccgtcctgcaatgaagttctgagtcacggtctgtgaggctaaggtactggcaacggtgtgaaccccaggacaactaacctcactaaccttcactctaagcagaagcccaaagtgagtctggcctgaaatcagagcaagcactacagaaagacatctttgttaatggaaagaggaaagaagaaaagaatttccaataagttacaacaaacttttcaccattctaaggaacccactttccttatcaaccaagctgggcttctctctagtgactcctattctagccttcccccagaaacagagagtgttaatcctggtgaaaatataaagacagacactcagaaaaagagacctgggactgtgatactatcaaaaccgtcaagtagaagaattatatcggaaagccagcttagcccccctgtgatcccggcccgcaggcctggattccgggtatgctatatctgtggccgagaatttgggtcccagtcaattgccattcatgaaccccagtgcttgcagaagtggcatattgaaaacagcaagttgcccaagcatttgaggaggccagaaccctccaaccacagtctttcagcagcagtgggtcctacagtctttaagcaactaacgaggctgcattttagagggcccaagctcagctggtgccctgggaatcctgtggccgcacattcttgccagataatcttctagttcatacagaagctgcagccaaagggtggagggcccag

SEQ ID NO: 20491 - DNA, 809 bp, Homo sapiens
cgtaggtgccactcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggctggtgagcaaatccatgtcagtctccccttatcacagcgagtagccaatgagagccgcctctccatgtcagagtctgtttctgagttctttgatgcccaagaggtgctcctctctgcaagttcgtcagagaatgaagcttcagatgatgagtcttacatcagtgatgtgagcgataatatatctgaaaacacacccgtgttgcagacaatatttctcggcaaatcctgaatggggagctaacaggaggggccttccgaatggggcgtcgaacctgcctgccagctccttgtcctgacaccataaccttaccctgggaaaatcctgaggaccacattggtaaagacctgctaaagtctctttgcctgggaagctaaccaagccgttaacaccctgcagcacctttgtgaggaaatgaattccgcaagctccctgaccaagcttcggaacctgatgaccctttgacccgctggttcctcgttgccaattggcagtttcaggatc

SEQ ID NO: 20492 - DNA, 729 bp, Homo sapiens
ctcccattgtcaagtgaattatggaaatctacaataatggagtccagggggtggtatagatcagaagggaaggcggtgtaccggctgtttggaaagtggcatgaagaactctactgtggtgtggccccttctgcaaagtgcattggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcgaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcgactgaaaacctaccatttgcttttctattcatctttataatggactttcagaagtgcattagacaaggcccctaaccactttgggattctttctgttttgctgcaaccatattccttaaaa

SEQ ID NO: 20493 - DNA, 175 bp, Homo sapiens
attcatggtccaagtatcagtggttctcccattttgggtctggagggcagtggccctcttctcacagctccactaggcagtgccccagtgggcactctatgggggctccaaccctatatttcacttccacatcgcactactagaggatctacatgagtgctccacacctgcagct

SEQ ID NO: 20494 - DNA, 815 bp, Homo sapiens
  misc_feature (1)...(815): n = A,T,C or G
gcttaggtgttcactgaaaaaaatgcactaaatcctgcctggccggaataattcatgaagaaggggctggatccgtgggtcagagaacacaggaccagtttgccatcccaaggccgaagtcgagggacaaacgtcctgaagaatgggaagaaaggaggttctgaaggcacagattccaataccatgccagaggttgaggacactggtgcttgaagggaaactagcatactctggagccccaagaagagctggagctggaggcatgcggcccacgaagggtagaagtaccagccatgaccaagagcccttcacatcatctggcaatccatccagaacccactgaatggaggacagcacagcgaggtctttctcattttgtaactgcaaaagctggaacaagagcctgagaagccaaagaagcagtacaagtccaacagcttttagaataaccctgagaaaatggttgaattttgaccagttttgcaattggatactatgagaagagaccttccctcctgcactggatttcatcatacctggaggccattcctcatgggactttggccatctcatatccacctttaagcatgttattcccatttcagctgtggtagctctgggtatccttccctangagaaaatattaatcttttctccctctgagttctggattanactgtcttatctgaaactgggtcactttaggctagaagcaccactagacatttctgttctcagaagttgccaggtcatggcatatctgtttcattgttaacggnatcacttctgcaagagctngcttgccagatcagtgg

SEQ ID NO: 20495 - DNA, 727 bp, Homo sapiens
aggtgtctctggtcagctccttgatgcccttctcccctcccctgcccaatcccagccaagacttgcactgtggtgactctgtcccctcctggtgctttgactggatgtgtgagagaaagtatggtctgtggcaccgacatctttgtgtgtttggaggtgactggaacacggatccacccctggaggaaggtggccgtgaaggaggccagcctcagctcagcgttctactctcatcgctcttactcccgcctttttagtgcctgccctactccaggataattgtgcttttcttttttcagttaaatgttagcattgctatttttcattattgcaaagcagcacatgcttgttacaaaaactttggaagtgtagacaaataaaaagaagaaaaagctacttccaaatcctacttaccccaaaggcaagatgatcatttagtcatatagtatcatacatatataatatgtacacatatattttaatgtaagtgtagtgtcacaatatcatgtatagtctttcataaaacacgttggcacttaatatcttatatgaacaactttctagagcaacaagcttagtttacagtaattgtaatgtaagagtactcatttacatagctacagcatcctttgtttacctcatctcttatggtttgatgtttaggttgtttccaacttttctccacctaaacagcattaataaatgtggttttagtttcctcttaaaa

SEQ ID NO: 20496 - DNA, 2080 bp, Homo sapiens
  misc_feature (1)...(2080): n = A,T,C or G
gcgacacacaccccaaagaccccgacganacngcacggacacaggcgccacagctgtttttactctggcgctncntgcataggaagccactacaatgaatgttttttagattanacagntccctccctgagcgctccctctggagtacatttcgaacacactatatcgagacggccatggcatctgccaactatatattgtagtcatgcgtgtgtacggactatctcattgtgttgcatgtncgcgtgtgtcacctctgttgcacgatatagtcacactcactgcncaacgccgcgcgtgatacgagcgtcgttgatagcgcgttgccatacacacgccctagcgaccgtgacgcgtcgtgtatcttgcacgccgcttcaacgctccaaccacgctaatagtcgacaccctgtaaccccggactcccacttcacaacantcaccacacccacacccgagatcgccagcccagcgtatacttgtacgtatacaagtatatttatttatatcaccgcatcntgttagtataatagcgaatgacgagaacgaaagatagagtactgcagagcggtgagaggatacgttgaanggatactagtatataacactagcgatactatactatcagatttatatattatatcgcgtncagcatattgtaacaacattatatgcgacgccagnagctgaacacggtagtcttcacanctcncgctccgaccactctatcaccttattcacacacacagcacacagtacaccacaacaagcgcgcacgactacgaaccgacncagtcgagaagccgaacacacgnacgcacgcgcaactncgtcacacgccaccaccgacgttcacgctctcatgactacaccaccgcntattcaccacacacgttgtntcccaccacacnttcgacaccgtntntctagcacgccttatgtgtatcgtaccacacgtatacgtacaccccacgtcagcacaccgaccgctacgcaccacgcattgaacttcnataacatntgacacagatnttgagttacatccngaccacgctagtgctgactatagagctntgtgtgtgntacgcagaccgacggcagttctccgcgcgattatntcaccctatattaccatccctgttntcacgagcaattatctactcgcatctgtagtatgtcaactccgcacgacactaatcacccgcgccgccgcgctattatagcgctacgatgagacgccgcgcacatatcacgatgcgtacttccgcccagcgcgcgcgagatnatcacgtcacgtaattataccacccactaattatatattatacgcgctccgcacccgcccgtgcacgccaggactgcgccgtaatgcacgcgccacgtgtctcacgtgcctacgcgcagacgccacatcatcgagcgaccatcgcgtatttcatcccgcgcgttatccgcgttcgtcgcaccatcgccccgccactgagtgcaccgattacccgacccccctatagacgagcgtaagatgatctccgacatataccaacgcgcgcgantattatcttgcgcgtcgatgccagagtgcagcgcagcatgccncagtctccgccctntattcatccgcgcgcgcacgtngntgtgtcgtaacgctatttcgacaccaatantgtcacgcgtctcgtactacacacacacagatacatctcttagacgancgtgacggcgcacagcganacacgtcgtcgaagcgcagatctcagccactnagacacgcactggacatcanagagttcatagtntatcgtgaccacgcacccantctaccatgtcacacaccgagcgatacgtcaccgcgattaatcagctgcngacgctcaaccccancgacctgtatcgtccgtcagntcnatctgcaagcaccgacttgtatgtattcgcgtaatacatagactatatntcgccgactcgacttacgcgatnacgtctacgaccgatanatgtcgnttnctgtacaccantctntccgacgtcgntacccacgccgngcatatgtataattctcaaccgaacntcanatcgcnac

SEQ ID NO: 20497 - DNA, 1354 bp, Homo sapiens
  misc_feature (1)...(1354): n = A,T,C or G
ggcgcgggagccggggacgagctctggcggggagggtnnttgaggttgttataaaaaaacccaagaagtntttgnggaaaaaganaagaaaaacccccggagaaggagaggggaagggaacgggaaaggggttttttgggcgggggcgccaggcagcaagggcagcgacaagagacgacaggagggggacggggcggcaacgaccgtgtacgatgtcttagtatgcaatcgtcggaggtcgtgatatttgtgttgtcagttagcgtgagatgttgtgtgcgttgcggcaatctaaggatcacacgcaaactttatcgatttcatcttaaaatgagagagggagagagttttttttattggagtagcgtgaggggagtagcgcaagtgttatgggttacggtggcagtgtacgctactgtgtccgcggaatatgactttgtgagagggttaggattgtatgcgtgctggggttgtgtgttcagcgagtggaggaacgttaaccagtttggcgttaatttgtctgatgctcgcacgtgttataaacaacggttacattctagagcgcggtgttcgcgaggcgttgtggaggtggacggttatggcaccgtatgatactccgttgcacggcgtgtgtgccgcgcatggcgccattatagttcgtatcgtttatattgccagcggattgcggtgcatcgtgtgtgcggacggacgttatttgctgattaccgtttgtactcggaatagcaatatattgtggcgtgtttggccggcgtcgttattacgcgcgcgctgatttgcgttctcgtatcagccgtatgtatgttagttccgatgcggcgcgtggccgctgcgcaatcgcggcgtaagatatatacgtcgcacccagctgtgcggtttatgagtgtggcgcggatacttcgggtccggacatcgatatcccgcagccagttctggaccttatccgttcgtatgtcggcggggagtggggntatggcgccggtaccaggctggatagcgcgtgttagattgcgcgtagttctggtgaggatgtagaaggagacgtttgcgggtttaatcagcggtgtttcattggttgtggcgcgctctagtaacgtggtgcgatcgtgtctacggattgagtccggtagagagggttgtttcactgtcgtggcgtgcttagtcagtagtggacgcggtttggtcgggggttgatcttcggttttattggggtcgtgccgcgcattttcgtgtcggtgtcncgcgcagttgtcttatttatttatctcaatatacgcgtcgtccgcgattgttaagacggtgtttagattcgccgccgattatggacactatcgcg

SEQ ID NO: 20498 - DNA, 779 bp, Homo sapiens
ttagtgtgaatcaaggatgtggttcactatactgttcttaccattgaaaaagaagtgctgagccaccattcccggcccagaatactttttaaaagaagagcaggttagaggaaagaaaaaaaattgatgctgaatgtggtgatgaaagcatgtttctaaaatgggaagcagatgcttaaagaggaaagactaatctgggattttgccccattcctctggtttttcactcctatatttaattctcacaaacgtgtcgtcacatagtgcaaaaaacaaaattcttgtaaagtccccaggagtttatgcttgggtgaaagttttagcctgagtattttcttcctctaaaaaaggtgggaaatgagacattgaggaattaacatataaatgtctgctatgggtttaagagaactggcgtatttggaatgcttcttacactaacactgtctcattgtaaaatataaaaccccttactctaactacatttttattcctctggtagtgtggtatccaggcaacatatcacttctgctatgtaattctaagaattctcatttctagagtacctgagccaaacaaatacacaacggaagctgcagctgtatcatcactagcaatttactcatcattatttactacctttgaacctaaggtttcctgcctatgcttttgaaagcaaaaatcagtctcctttgcatgaaaaagagccttagattttcaaacatgttagttaccagaatgctaaaataccagttgattacccaattatttttgaaatctat

SEQ ID NO: 20499 - DNA, 1390 bp, Homo sapiens
  misc_feature (1)...(1390): n = A,T,C or G
gtctctgctgatcacgacccatatgtgcactccagcgatcgatcatccagagaattgtctccacccgatccttgtcctaacatccgntactacattacgaattatttcgtacacacagtgaacgccgtgatacgagatccatatgtcaagacgcgcgcacaaatcaaacgcacaactaacgctacgcgccctagcaantgtgtgagggagcgtcatagacaatataaccgcgtacgggcanatatagactatacagtcgattacaagcctctacgcacccttctcgatcacagatgctagttcaccgcgtcgatctcatagtcacatgcgcgacgacacagtctgtcaatctaggtatttagtacgatgaccgncgacatacatagatcacgcgacacanagatctcatacactgctccgacggcgatctcggcgagtttcntcactcacaattgctacatcatgtacggatctagataggcacgtcgtgttcccactcatcttagcaagcgccacgacgccgacaagagcttatgaacacataggcgaagcagtgtgaatagatagaagagctcatgtaatggctcacgtgtatgccggtgtcttgtgttgtctgctggattattcacggtggtattntatctaccgatgtgagtcgcctactaccatcactactgataccgcctcttactatctgttacacgcagctccgccaccgcgacgactcacacgtcgtcgctacgaattctcgcgacgccgcgnacgcattcggccgaccgccgcatccggccactatcgctcgatgcgtgagtatgctgttcgtcgtcgatgataagactttctatgtgatatacatgctctagacgcgacgacgtacatgatacgctccttcataatatctatgcatacggaaatgtcagaatgtgtgcaagacggagctgacgaccgaacagcataatttgtatcntaaacgctgctgatgtgcaaatatgtatgtaatcngctcacgtatgctgcacgatctaagcactgatagaaccaccgcatcatttctcgtccgtcatgtctcgataacatgcgctctagccttaactagtctcagtttatcantagtgagtagtatcttctcgtgtggttcgtgtctgcgctacacactgcagtncgcacctgtatcgagttgtgctcatcncgtgtcatatgtatataacatacatcccacaccttccacgctgaagcatcacccacgcacacgttntggtgccgcacacaagcaaacgacctattcggataactcgttatatgtctcaatgtcgcctctccacatacttctgttccgctctcaccacgcacagtcgcacgtattgtgtatactcactacacgacgcgctcg

SEQ ID NO: 20500 - DNA, 813 bp, Homo sapiens
  misc_feature (1)...(813): n = A,T,C or G
aggacatgggtgtggaggcaaagaaccatgaagtacacannacagccacaggaagaaacattaccaaggccctcattgcaagcggaggagaaattgcctgcagggcgatgcgcacagccaaaaaactgggtgtacagactgtggcggtttatagtgaggctgacagaaattccatgcatgtagatatggcagatgaagcatattccatcggccccgctccctcccagcagagctaccggggtatggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattgggttcaaaatgtgaggacatgagatttaggagggatgaggagcggaatgatatggtttggttctgtgtccccacccaaatctcatcttcaattgtactctcacaattctcatgtatcgtgggaggaacccagtgggaggtgattgaattatgggggcaggtctttcctgcggctgtctcatggccatgaatgagtctcatgagagctgatggtttaaaaatgagtgtttccttgacaagctctcttttgcctgccccattccatgaagactgaattctccttcctggctcccgcctggatgcgagcctccccagcctgtggactgggagtccataaacttcttctttcgaaaaaaaaaatcggcttgttggcccagcggggaactttgggccgtttcctttatgagggtaattatg

SEQ ID NO: 20501 - DNA, 745 bp, Homo sapiens
  misc_feature (1)...(745): n = A,T,C or G
cttggtcgtgtcgagaactttggctacgagagttggctgatagagatctgatggaccgggagtgggggaagggagttagattgtagatctctttactgngttgttgatcgtgggcttatcggtacctctgcatgggactgctgggctgtgtggggggattgtgaacgtggggtacgaggcgtacggaaggtaggaatcgtgaagagagcggtggttgacgtggccttattcctgnnntttcacttttttgctaggcgggagggtgttggtgttgtnanaatctatacttcttttacctcgatgtaattataggttaatgctaatatatgggagacggggaggctgggagngtacggcgagaggcagttagtgggttcggaaaggtagtgcgtaagaggtagcgaggtatgaggtnggcggggtgatgtgggatggaaagtgtgtccccccgccaatctagtatccaataagaactatcactattaccatatctagtgggaggtgctcacaggtaactatatttactataggggcaggtgtatttggcgttgttntcatggccatcaaagagtctcaccagaactgactagtnatactaatcagtgtttcccttcacaaactctctctttgcctgacacaaaactatgtaatgcataaattcctcttccctgctnaccaccatgattgcgaggcctccccacgccatgtggacttgtgagtncaataaacttctttcattcgtaaa

SEQ ID NO: 20502 - DNA, 670 bp, Homo sapiens
gaccgtgccgctccactctgagaggaccaggatggtcctcgcccagctgtcccgcccccgaagccacttgggcaggagtcagagcctgctccgtctctttcaggccttcccgccggtctcctgcgtccaaacctgctgcagcagccgcgcggagcactcagacaccagtacgtccatcctcccatcggcgtctcactcgccaagtggacggaagcggaaacggtcagcctctcccggaagcggaaaccccctccggtccgctgtcccgtcagactgggtgctggcgccactgctgcctcctggcgggatccagtagacactgcgaggagaacccgcggggatttcggtcaggagcgaggccgcaactcaggggcgtttgggcgaggggagaggaattgagcagacactaaccagagctgctctgtgcttggatagactaggacagtcactgacctagagcttctggctctcaaaggcctcactttgcccctttgtgaaatgggcacaaaactaacaaatccattcatttattcaacaaacatttattgtgtactttaaaatgccagacagtattttaggctctgggggcacaaagaaaccaaacagacacgatctcccctctcaccgcagacacattttagaatggagagagaaaattgaccaacaaagg

SEQ ID NO: 20503 - DNA, 451 bp, Homo sapiens
attcctgatataaacacatttcatttagggcaactttcatacatgagtcagatcataaacaccaaatattaaaagagcacatacctaatggagtgatcccgtaaaattctgcttcatgcctgagaacattaatactcactcccctacaaagaaacaaatgatgtaaattctctaacactggaaacctgtattatcatctgacatgaaaggaaaaaattctaggttcttcatgtatatagtcataaggctttaaaaattattttcctcctaatactctttatttctattatccttaatcattaaaaagtgtaaataaaaactgcatgtgaacaaaaatattctgttatctacttaaaaaccattcatatatatacatatatatgaattgggtcactaaaggagagattagggctctatcaggctagtacaaataaattgtctagaaggcaaa

SEQ ID NO: 20504 - DNA, 156 bp, Homo sapiens
aatcacaggctgcctgacaggattagcacgttccaggttccaactaaagccgtctttagattgcaattgtggtgattgagtctaggaggaaaacacaaatgaattctcagccctgggattgagtgacatttaataaaaaatactatttgtttaaaa

SEQ ID NO: 20505 - DNA, 362 bp, Homo sapiens
aaactttgttgacagcggtgtctggatggaccagcagagggcactctcacccacggggaaaatcgtgcgcccggcctcgtccaccgtcagaagacgccgctacacaatggagtctcgctctggcgaccaggctggagtgcaatggtgcgatctcggctcattgcaatctctgcctcccggtgagaggagaagcccgctagactttcctgggctagtggggacttggagaacttttctggctagctaaagatttggaaatgcacctataatggttgggtctagctaaagtttgtaatcgaaccaacagcacttttgaaaagagggcccattagtcacttcgtaaaaggaccaatcaccactct

SEQ ID NO: 20506 - DNA, 707 bp, Homo sapiens
  misc_feature (1)...(707): n = A,T,C or G
attcacacattcaaaatcagctttctaggacaggatgtggtggctcaagcctgtaatcccagcacttcgggaggccaaggtgggcggatcacctgaggtcagtagttcaagaccagcctggctaacatggtgaaaccccgtctctactaaaaatacaaaaattagctgggtgtggtggtgcacacccattaattccagctactcgggaggctgaggcatgagaattgcttgaactcaggggacggaggttgcagtgagctgagatcatgccactgtactccagcctgggcagcagagtgagactccctctcaaaggaaaaaaaaaagttttctaggatcaaaataggaaaacagttgtttcagaactcatgatatgagtcatgactacaacccaccatattcagtaaaacctcaccttgtcctgttgtctgacattaagtgttctacgagatccatacctgtgaaatcagctcctctggaatgacagatgctggaataactggctggggctgactgcccaaaagcccagaccctcgatcccgtcctgtccgaataactcgagtctgccggcgggaatctcgagctccagctgatgacctaccagaggatcctccaccacttccacccactccagaactccagcggcttctaaatattggagaatttataaaattagcattttaaacaattnnnnaaaaaaaaaaaaa

SEQ ID NO: 20507 - DNA, 874 bp, Homo sapiens
tgtaaaagaaatattacatactattataccaaacgcaacgaaacaaagacaaaacacgttgataggctacttactgccgaccttactgaggtgcaccggcgcgatcttggctcactgcaacctccacttccccagctcgagtgattctcctgcctcagccgctggagtagctgggactactaggcgcgggcaaccacactcggagaatttttcgatgttttgtagagatgaaatttcgtcgtgttgtccaagctagtgggagctaaatggtacaatctttcacttcttgaagctaacttggtaatatgtatcaaaagccttatttaatgcacatattctgctggtatagcaattctatttctgcaggttgatcttcaaaaattaatatcacgcatacatatctattagaatggccaaagcccataacatgacaacaccaaatgctgggagaggattgtggagcaacaagaacactggctcattgccggccggaatgcaacagggccacaccacttctgaacatagccggacagccgcttacaaaaccagtcatacaccgtactatatagtcccacattttaactctctggtgtttaccaaaaggaatcgcaaacttatgcacatacaaaaacgtgcccatggatgtttatagcatctcttatagattccttaacttgatagccactcggaatcggccctcatgtaagtgacatgaaaaaacctgcgatatccacccattcattacatttttcgtttgctaaaaacgaaaaagttgtccaagccttgcaaagtactttccgcgaaccttttcgtcccaatttcttatcgtcaacagcgccacggcatatcttgcctgtttaatcattacacttcg

SEQ ID NO: 20508 - DNA, 718 bp, Homo sapiens
aaaattgtagaccttccttcaatttcgatgtgtgcttatccctcttctaagaaaaaaaactattcttaataaaaataaattggaataccatcaccctccataaaaagaaaaggcatttattgactttgtattaagataagtgtccagatatgttcattttaatcctttattggaacaaaaaatattgtaaactctttagaatacaccataagaccagagttaatttatggaatatttgtacaatagaatattccttgcctcccacatctaagtcatcagagcaagttctcccttacttccagaatggattctgattctgttcaatactctccatttcaatggccaccatttgagaacaatgcctcaccctccttcatttggatactaaacatcttcctaactggtcatcctgctccagcttctactcctttgatccattcttcacatagcagtcagagctgtctactttgctgcctggctagctagctagccatttgtttaaagtattaaaagcacccataaacctaccacattaggcccctacccgtaccatgccctaactcctcccatgccaggcagccatcaacctgaatccccactcccttgctttcctttttatatagtgttattgtatttataagcattcctaaatatgcatatttaaatgtttttaatttaataaaaaatatcatgtggcacacaaaaaaaaaaaaaaaaa

SEQ ID NO: 20509 - DNA, 242 bp, Homo sapiens
aaaagtcttttaagtgcagctgaattaatcaaattaatcatacacctcagatgatggcaaactatcactttcagttctaagtcactatcctttttaattctatttttcattcttgttaatgctattccctatttctgttcccagcgtcacaaatcaacatgatagtattttcagtatgtttattttgttaatatccttagaaataataaagtatttttacacatgtaaaaaaaaaaaaaaaa

SEQ ID NO: 20510 - DNA, 735 bp, Homo sapiens
  misc_feature (1)...(735): n = A,T,C or G
ctcgtaacctgtgcgatttattaaaaaaagtgcgttcatgattaacgctcatatctctcgaacattctcattaagaaattattctnnagncccccgttgcgtctaatgaagcattcacgtattgtatgtaaatgcaggagaaagnnatccctactccactgtgaaatacgctcggtggtatatccaggtattctattgtgcatagagtcctcatganggaattgtcttacgtttaaaagataaatttgcacaacactacacaagcacgggcatcagtattcatggacaacaaaaaaatctctgattcctcccaaaaggcgagtgggtcantgagctccgaaacaggctgcatacaccaggtctcatttnacgttgtaaggctccagcgtgggtcttgtttccttggctttcccccatgtaatcccaaagccaaggtcacaacctcttaagcaatggggtgacaatctcatatagaggtgcaatcaacaaccattcttgccaagctgatattaacatttcttttttctttttgatgttacacacaatcctgtccttgctgtaccagaaacccatttcacccatctgtctgggaagatgatccaattttggtgcttttatcatcaatgctttcagcaactttgttctacttcccctactgtaattacttttgaatcatcaacgcacccagacagccttaaacctcagagaacagaatgctaaaaaaaaaaaaaaaaa

SEQ ID NO: 20511 - DNA, 904 bp, Homo sapiens
  misc_feature (1)...(904): n = A,T,C or G
caaacgcgagaaggacgagtctgaaagaggacgagaaaaacaaagggacaaggcgttgcnggagccaacnnagcagaaagngcttccacgcgagcaaaacgagnggcaggagnggacaaagaaggaagacncgagacgttgaagccagggcacacacaaaccgccggantgggcactcgccgcacgccagacagcagaagacccagccagaccccgagaacatgacacaacaggcaaggaaaangccaagaacatgcaaaccaccggccgagaagcacatgggcgcgcaagacggccgagaaatttttgaaaggggctagatcttgaaaaggaaaactgcatcggtttttttttttttaagacagtccaactcacatgtataatgaaagatgaatatcgctggaactgtgactaaaagggctgcacatgtaaaagcctcagcgaagcatagaggaagtggtgctcagattccgtaaattggaaacaaaagagggggctgagaagaaatgcgaatagataacccatcaacctgtgactacctagagtccgcgaaacccagatgaaaccctgtaaactataaataggaaaagcgcttagaaaatgagtactaaaagaaagatggcataaggggtatgaaggtactgatacactcgcaagaaatcgcaagcgtaagcaggaagaacattagattagtaaagaggacccggagcgggaacattaactaaccactggatccgtagaagtcatgtgtggctggagcgaatccacaggccaagagatacatcatcggtttgaaaataaaaaagtccaaggggggaggctcggcacttgtccagcgacggggggcatccggtacgagaatgaggaaagggcaaccgcgatgagaaacaagaaaaagctaaat

SEQ ID NO: 20512 - DNA, 900 bp, Homo sapiens
  misc_feature (1)...(900): n = A,T,C or G
tattaaaaattataaataatttataaagttaatatgatttgttaatttaggatgcacctctctgtcagtttaaggtactatgagttgcatgtggaaccctcacctgggctacattctcacctgcccataacaacctgggcaccgggctgtgggcaggtgagcataatcaagctgcccaacctgggcaagcatgataagtgctcggaggtgcaaaagcagctgccactacacaagcgaggcacaggcgagagtaggaacactgttgcggtgggtagagtctactacgactacaacgctgaagcgaacgagctttcataggatgatatggcgctaaaggcgtaggactaaaggaccctgctcatatattatggaacacctgctcaagcattgctaagccatacaataagcttagtgcctgccaaaaatttgaaagaataaaataacacctaacgccactctcttttcattacctattcacagttgctgtgataaaaataaacctatcacactaacttaaactcttatttatctaaatgatcttaaaattatgatagagaatattagttatcacatttttattaatctcatatcagataccatcaaacaatatttccgccattatataatataatacaccatgaacctcgggctcccgcaaaaaacataaaagattcacaacgtaaaaactagtnggtatcaccaagttggtctatagaatgaaaagacaatataataacgacgacacgcaaacaagagcgaaaaataatttattacttatttccagggactcttgtatgggagaacgtagagcacgataataaatacacaatgtatgtattatttaacctaggcgtaattttgtttactcccaatccatcgtttcattcatgcagtcaccag

SEQ ID NO: 20513 - DNA, 743 bp, Homo sapiens
attcttgaaaaaattttagtgcaacaacaaatgtcggcacctaattaaacggattgtaaagtgggcgtgttgggaagggggttccgggggcagacaatactcgtgctttagtatatgcccctataataagggggctggattaatgctctcttcgaatagaggggataggggttaatggggaaccatcacatgggagtacatcaaaaagaggccattcaaaaagtgatccgatctgagggcaggtgtgcatttcaagctgcacaacctgggccaagcatggggagtttcgggagggaggttaaacggttgggacttcaaaatataggcacagacggtgtgaatacgaatccggtggacggggtctttaacgtctccaccgctgaccgcctgggctttttcaaaggtggatatggttcaaatggtggtggccgaagtgaacctgttcatcaagatggaacagcggttggagcagggccaggcctattgagttcttcatgcctgcccagaaataaagcccggcccccacccgacaccagccctgctgcttcctaaattattgcctgggcagtgccccccatgcacccctgatgttcgccgtctggcgagcccttagccttgctgtagagacttccgtcacccttggtagagtttatttttttgatggctaagatactgctgatgctgaaataaactagggttttggcctgccaaaaaaaaaaaaaaaaaaaaaaaaaaaaaaaaaa

SEQ ID NO: 20514 - DNA, 724 bp, Homo sapiens
  misc_feature (1)...(724): n = A,T,C or G
acatcttgttaaacataaaacaatatgtttttaatactaatgcttcttgactaagtataagtagtgcatggccttatgnggaattactcttcatttncgttaggatgttttaagatccctgtgnncagttacagtagttcatcttccagtgttatattgcagttcgagtagaattcttgtattcgttactaaggtgaatattgnnagagtagattacacatggatgggtgcataggaacaccaaagctttgggcacacaatttatcctaggctttgatagaaataagcaggaggaattctattttgcccctatttggtngtgaaaaccctttatttctcagtataatcatcaaaggtgaaggggcaaggtgggggctgagccagacctttgcctatcctggattgttcagagctcaattgcagcattgtttccagtcagtccagaaaaccacagaacacatagtcatggaaaaaagaatatttgaatcccaatgttcctatcagtaccaaaagcacctaactgtgtgtcaagaaatgtgacggcagggaaaatgaacactatgatagcctgtagtctagttgtaaccacaaaagaaaaagaagcctatctagaatagcctactcaagtaacacagatcaaatttatacaaggaaatacttagctaccttgtaaaggtcattaaattaaagttaccnttttactcctaaaaaaaaaaaaaaaaaa

SEQ ID NO: 20515 - DNA, 717 bp, Homo sapiens
agagggggccgcgccggttcaaagtgggcaaagggccctgggaggggcctccataggacgcgcctaggggcttggggcgccccccaaagggggtatgacgacaatggaggtttccccccccccatggaatctttcctctgccaacaggaggcgcgtccttatcaagcgcccgtcgccgccaatttcccctaaagaacccaagccccccagcttgtgggagagataagtttaggggtaatctccgggttttttttagggcccggggcggggttcaattgagcctctttttctggcaaaaccagggttccagggagagggtggatttggggggcagggggggaaaacctttccgccgaatacctttggccctaagtcctttccgcgggggagtccccagggaaattaaacttttgaaaaatccccacgggatcccatttaaggggggggtcccctgtggggcaaaggggaccccctggtttttaccgggggggaagtttggatcaagagcccggggggggaaaagggttttgggtttgtccccccccgggtatggggttttggaaaaagcccccccccccttttgttttcgggccccctttttttaaaaaaaaaaaaaaaagggggggttttttttaaaaaaaaaaaaaaaaaaaaaaaaaaaaaaaaaaaaaaaaaaaaaaaaaaaaaaaaaaaaaaaaagaaaaaaaaaaaaaaaaa

SEQ ID NO: 20516 - DNA, 855 bp, Homo sapiens
  misc_feature (1)...(855): n = A,T,C or G
ttattatatatcttattaataaaaattaatttataaatatgtatctatcactnaccgctttttatgtctataattagatttattgtattagacatttcgagcgagcaaagatggcaagacagcacaagataagaatggataaaagaagaggaaaagtttatccaagagaatcagagaaggatgctgcattatataatcaaagcccaaactcctttcttatcttgaccatactaataaatataatttataagcattgtcaaacaaaataaaataatacagaaattattaaagaataaactttactataaaacaatttaaaacagaagaaaaaagaaaaaagtggcctcctttggctatagaggaagaagatttattgnccgtcccctttaattaaggataacctaacacaccatttacacctataattagtgaatattgtatatccgtcattctccagcattataaataaaataaaaagggaaattacaggataccacctacacccagcctaattccctaaaatacacttacacacatcgcactattaagtctcgattccgaaaatggcaccttaatttcgacgcatatcataagttccccgccccctatacatgtactttaatttcccttttaataactacaacgacccaacctcgccatacgtataaaaatttttatatttaccacattttgtcccttccactccacctaagcactacattcgattgcccaaaccctgaccaacatatatataacgaattcccgccccctctataccaatagcggagttttaacatccataccttatatttaccaaccaagctgataacccacactgcaaactaaacactcatc

SEQ ID NO: 20517 - DNA, 643 bp, Homo sapiens
acgttggcgggcatgaggatggattattcacaggggtgagtgagagagatagggttcactaatacgaggttgggacgatgtaattacccatgtgggataagggagtgatatcaacgcggggtatagaggggtttattgactggcaaacggtataaggggattatgttggcagtcaacaaaacaggggggagtgtgagatttggcgtttgtataagatgaatatcttcaccgtagtgagcccggaaattgttttcaattcccgatgaggtggtggtgggggggaaaaaaaaatggttttgtgagaaataagaaagtcgcagaatgcgaggtttagtggaaattagttgtgcacacatttacggggggtaggatctgggttgacggtacgggatatgggtgtcggtgaacaactaggctgctggaggaggaaatggaacttcccaagggggggccggtctttttggctttttgtgagagctgttgggcgaagaaaatggtggcccccctatgtaataaatggagaaaaaaaaaggaaaagtcgtgcccaagaaattcgagaaaggttgggtcctttttttgcatgagccccaccccctttttttttttgcccctgctaataaaaatatttttttagcccggcccc

SEQ ID NO: 20518 - DNA, 844 bp, Homo sapiens
ccacatcccattccacattcattttctagacttttccccatacagttatctcagcactggtatctagcaggttcaactaacacatggctcactaaaaacattatactaataccttctctgaaaaacttattttctcctgcctactaaatatttatttcatcaacatgggctgcgttccactgtgtcaggattctgcatgtgggtggagcactgttccagcctgagaaagatggttctgaggccacttatcaagacattcttccaacatgagcaagtttctctcgcgcaaatagcgacacctgtccttggtgtgttgtctttcctcaggtaacttaaggggtccaaagcctctgaaaatgttctttatgctggttgaaacctcttatgtcgttgtacttataccctaccatgcaaattaaaataacgggacttcaaactctccaccaaattatgttggcgcccacccaggctgaaagctgcaccctttctccgcatatttctgtcttcaatatgtatcaccttttaaaccctgcatatattattgagcccccttctcctacaaaaatactaaaactagtataaccatcatttactaaatcattacactttctgtataaccaggcgactcacccatactgttttccatcagtttacccctctattcctgaatttcagcgtcacctgcgctgtcctgtctactactcataacaccgcgtaccccccccgtactattgtattactatcgccaaactatgatcaccatatctactgacacctatatatgaacccccccccgcccgctcaataatattcttatacaatatactatcctagttaatctcct

SEQ ID NO: 20519 - DNA, 1261 bp, Homo sapiens
  misc_feature (1)...(1261): n = A,T,C or G
ctattatcatcctcattctatttacattatacccctatccgtttagccgtggagtagcctggtgaattgtaagccacggagtcaaatggtggactgggattttcaggagaccatttatagagcaagatcttaccaacatccatttagatcatgggcactcatattaccgttcgacacatacatcatatgagttagactcacgtcgctgtacagagtcgcanagcacacctatatagcacctcgcgtaacgatgagatatataagcaattatgcgatngactgctccactagcaactttatcgcgcccgcatagctttaatcacctgcactcacgttncatagcgcgatagtatatattgtcgtttattatnatcacactaaagcttatgttgtcatatgctcgacatatcgtacatctacgtatcgtagctcgtggcttgtatattactattcgactacctgtacatcccagcgacactgcacgtatacattgttgcttcagtccaatatatagaaaatatataccactaatattatctatgtatgaacggatcatacatattgatctaactcattctgcgcgttgatacaganttacatacaattgatgtattattcacacttccatattaatccgaaatacactatatatgttaactatgnaataggctgtgctcactatctgtgtctagtgcgactcgagacctatcaacttcatattcacaccctccattctcattcattataagcgcgccgctgattactacttcatattaccttaacctattcatctccacactatatacactctcactattatattacatgactatctcatctagattcctgagacagtactatctctcgcataattagaacacatagtaggacatacactattatcgtatatcaccctcaccgtctacgtctccgcataatttctagtntttcatcgctatgagactactccatcttaatatatcatctcctctttattatctctacccaattacctattatgaactggatctcaagcatataccatctatacgacctacatacattctatcatgatctcatgttcaccgaagctagtcacaacatatctagatactttacatagttttatatgcacgtatatatatgtaccacacaacgctctatcctattatgattcatacttatctgctccccggctaccctcacacttttacattatttcgcatatcatattaattagtcgctcatctcccatgttgcg

SEQ ID NO: 20520 - DNA, 216 bp, Homo sapiens
ttttgtttccgtctgtgttcgatacaatagggcgccgggagggcgcacgccctgggcccagaaacgggcggacacgcaagccaagcggggccggactcacgatgagccctgtcgggcacgcgggcaggcgacagacggggaacggcggcggagggggcccgggtagaggccggggcaggacgcgcggcggagggccgcagaatgtcatcgacgaga

SEQ ID NO: 20521 - DNA, 1188 bp, Homo sapiens
  misc_feature (1)...(1188): n = A,T,C or G
acacaaccgaagaacaaaaaaaaaaaaaccttcgtggggagcacccgcccgacccttgaagagacaacagncctcgcanggaccgccaaacgcgactaacgataaaancaacactaagcacgaatactccaaccccagaaccagagaccaaccagaagagaaaaacgcgcaccaacaccgaaccaaaacacacgggagaaggcccgccacgaccgagcgcagacccaacgcaacaccgcaccagacccgaagcccacgcccgaccacgcgaacgccccaagactcttttgttttaagacagaggagcaacgacccaaggcgccgcccgacgcaccgacgacccggacacccgcgcgcccccacaccagccgaccgagcagccgacccgcgccggngcgcccacaacagcccgaagaagagacgcacgcaacgacagccgcacgaacccaacccaccacagcaacccgccacagccccacccgcccgcacaaaacgcgcgcacagagcgcgcagagcgccacgaacgacgaaccccgccgcccacccgcgccgcacagaccacacacaccggcgcacgaggaacgacgccacgcacccacacaaccacgcagcacaccgaccacccgagcgcgaggccgacgacgcgacggcggccggcgaacgagacgagccgacgcgaagcaccggacganagagaccagaaacgccgacgcgcagacgacgccagangcgacgccgcgcggcgcangagcagcggacgcgcgcaanccacacacagacgccgagcacgacagccggccgcagcggcgagaacgagacgcacggacgcaccgacgcgagggcgacagccggacacggcgcgacgcgcggcacggcgccgccgncgcgaagcagnaagacagcaccgcgcgagncgcgcacnggcgcgacacgcacgcggcaccaccgaacaacacgcacacgacacccaacacacgcaacaacacgcacaccgacgcacgaacggaaccggaacacacgaaagacagacgcagacacaccaaggagccacgacccgagcagccgccgaaccacggccgccacacccacgcacgccagcacaccaagacgacagacccaacgcgancaccaacgcccgccacgaccaacagagcagacgaccgcaacgaccaccgacgacgaaggagg

SEQ ID NO: 20522 - DNA, 1742 bp, Homo sapiens
  misc_feature (1)...(1742): n = A,T,C or G
acgtataagacacgacgtcatgcgacngagggangtcgngggatagtactanatncatgtacgntgacagctangcatatgagacgnaagaagcgcatgacgtggctacgcgtaggcgtggacggacagtgtagatcangagcggcncgatgagnctancntgctcgntcntgcatcatgatgtgttgnttctgtcactctatacacactataaacnttacagactaatagngntcgcgcgtgcaggggaatatagactgnatacgnctgtcnctgcgnaaggtgtagtnagagcgngacatagagtncatatagatatgcacanntgctanagctcgcgcgctcatattgctatctagatganttgtgcntgttatttcaatagactgtagcgtgtacntatgatcggtagcgagcacgcacacntcgaaactcatctactangatatagtcactatactacgactntcggtcacagactanagtcncgttgcagtaatccagtcgtgatgcgatgncgggtgctgcatcgtctgttcgttctgtagcgtctctacatcgtacgtgcaagcgcgtttgcagactatgtagatcacgaggtctcagtacntgtgatacagcattacantctgctntgttgcntgcgacactctacgtagaccgcgtcntctccaccgancatcatcgnancntatatcgtatggtttgtatctaccaatatgatccattccgttaccgtaatcntagtgtaaacctatagtgtgcgtctatatcatacgcatcaacgaaaataggatataaactgtactacacatcgtcgagatatgcgctgttatcaaattacgtgatcatatcaaataaaccgatctaactcaaacaggtactctttaccacatatataccatccatctctatctcactcaactcagtactattaaaataactctccgtaaacacctcgtcaccactcgttcgctcgcactactcaatgtaagacacgtcttagacatatcactccactactcactcattcagcgttcctcatgcatatagggagtggtgacanaganggtgtcagttggtcttcggttgnggtgtggggaagantgtgaagtacatcgctggatcctgtgtgtgttagcgtatggtaggatggcgcgancacggcaaccattgagtatcgcgtcgatcagattcatagtatagngatgacgtatatgtgtatgcagtatggcaaggtgtcaggttccgcgctcgngncacgacacagatacagcgtcataggagtgtcatcggtagcgctcgtcagcacggtggagacatgttatattactgatgaagcgtgatagtgatatacgccatcaacgtacatacaacatcaagtaggataaggcgcacggaatgtgtcgaacgtacgcactgattcgctaccgcatcatttccctgcctgagtgccactctagagatacggtgatgttcaatctgccgagtagaatatccgcggacaaatgtaggaggcgatgcgtacgggcaccgatcactagattgatgcagacgtgattgcgtaggcttgtatctcgtaactgatatgataatgacgatgtcgganagcagatatctagggaagggtgagcaggtggagcgctgttatgtgctgcgtattagactaacacantcatatatatatatcttgtgnatctgagngcgcgtctgatatctcagcacaacacaggcttctcgcg

SEQ ID NO: 20523 - DNA, 435 bp, Homo sapiens
ctaggactttcctaatttttctacaatgagcatggcttttgaaatttaaaaaaagatgagaagactttggccaagatagattaagtaactggcccaagattccgtggccagcaagtggcagagctggaaacctcagagttggacctcagaatttgtgctcttaatcatattttatagcctcacaataaattagaataaattaaccgttccaagcagaggattttagacttcatgcaacatgacagtacttctcaaagttgttcagggaataaaacactcagagaactcttattaatatgtttaatttcatcaaccagattcagcaaaatcaccaacagaaaacaagactatgatacatgtggacaaaaagaatcacagatataaatatcctgtgctttctcaataaatgatgctgccttaccaaaaaaaaaaaaa

SEQ ID NO: 20524 - DNA, 1557 bp, Homo sapiens
  misc_feature (1)...(1557): n = A,T,C or G
tgatgctaggcatgtcgacgtgngnanatctagnacgtgctctcactgngactcattagcatcacgnagaactctcantcacgcgcgctgctagaactgatactctacgnagagctatatcgaatagctaccaacnatcacagcatactctacagagatactactctacgcatgtnancgacatnatgctgtacatctagacnctgactcgttctctagtaactacagacgcgcgctgcngnactgacgtcantgtgtctgtccctgtggcgcgatcaggtctggctgncgagcagtgcacagncgatntccaggttcgcgctagtcacacagcacgacggctcactgtatcgtcactcggngtgtctgactgtaaggctgtcttacacgctgtncgcacgtgcgtgcagtcgccactgctagcggatccgcgcgtagtattaatcgcgacagcgcgcaccgtgaccgtncgtactatgcgatacgcgcgtgcgcatatctaacagctangcttgacgcgtgtcagatgtgagcgcttggataggtcggccgtgtgcttctcgctcattgaagtgttttgacttgtcgtatggatatagcngatacacgtagttaataagtgcgcaggggacacgggtacgccgccgacgcagatatgtgtatggtgtgtgacgcgcgatgccagtctatcgaccacgctctccggcgcgtnctccgagtgtccactcgtgaacagcgcgcgagactgcgctacgtacgagcatggctgacgngcacggcgtgtgagataactaggatacgttcgtggatatagcgctccagtctactagatctgtatgntctcagcatcatgactgcgcgctccggcactcgacgtgctgcagatggtgtagtgtgtggtattgtacggcgacagcagaagagcgaggagagctgtgtgtgcgctcgcaggagcagagtgtctagtcgtaccgtccgaaactccgtgactacgtcatgcgtatgacgatgtgatgcattgctagaggaggagagcagtacggtcgagtagtcgcaccanagtctaccgncgacgcgcatgcttgcgaccgcgccgatgtcgtctatgagctggagacatgcgctcgtgcgcgcatgctcctactacacgcatatcatcgcggagtatgcgttgcatttacgcattagtataatctgaccgagacttctagttactacacctcncgaggcacacgatgcgcccggggtgtcgagcggaagtcgatcgcggaagtagagccatgataccgggcagnacggacagcgacggtcgtcgacgctacgcgggagtgatgatgatgtaggtgtgatgtacaagtctgtgctacgcgcatacacccacaacgaactcgcgaccgctcagccgcgcacatcgatgtaggatgcgagtgctatagcgcgcgcgaacgcgcgtgacaggctgcgcgtattgactgttgctttcgatcgcacngacaccgccatatgtggatatcgatgtaaatgagactggctcactgcatgaccagtacgccgtac

SEQ ID NO: 20525 - DNA, 1628 bp, Homo sapiens
  misc_feature (1)...(1628): n = A,T,C or G
ctgatcagtgagagagtgaagagtatatagacgtagagagaagtatctattcgctagagtnatctgcactggacatnttgcagagtgttgtggaagactgtctntatatgtccctgacgcgcaccggtaagagtgtcttgatgactacatgtgtggnacattggctatatcgcgcatcgtctggtntatggaccctgagtntggacgacgagacagatcaccaagtacagcgggacaggtgagagcacgcggagcgcgcaggacacagccactcttaataacgttacctagagaagactccttattgtcatcntgcgacgttgtagatactcgatctatcttacacgacaacaaatgtaacacgtatcgcnagcnagctatgctatgtatatgcgtgtacgcgcntgtattgatgtactcgcgcgcgctcgcagtcatagtcagaatgctgtcctcatatctgtcagcgtaataatgatatgtcgtacacgtctacgtcgacgattatanatctcaattagctgaacnagcgtgctcgtacatatatttagagttaattagagtcgtggtcgcngtagcaagcgatcacgttacacgcgcacctcacgccacgtacacgcacactctcgctctatattgtgatgatacatgtgaccccgccgtgtcatgggatcttgacgtgtggacncagagctcggaactatactactgcgcttgnacgctgacgtaggtagatgtagtcactacttagctgatcgcgctgctgaggatactgagcgatgtatccatatgagctgtcactgcagcatatgctacgctggcatgggctactctatatcctaatgctagacctctgnacaacgaccatcgacacaacgcgtagagtatgctataattatagagngacgaccggccgacagagctgactcgacgcgtctacagtaagtaacatagatatatacactcagcacactcacgcgcgagtcattacgctgacgcagcgcgctaacgtctgtcgcgtctgntcgagagaaatgagactcgcgaggagacgtcacggctactcgacgaggctggtgctagtacgctgcgacagaggacagtagcgagagatgtttattgttgtatatctggagtatggatgcgctgaccgactgcgcccgnccgcactgacgcgctcagcgcagatacgtgacgcacatagacgcatactatgactgaaatagcggtcnantcgtaatataactgaacgatcgacagtagttcgagacgcatgcagagagctagaatgtagagaatacataggtaaagtaccctgtagtccagagcgacgacaagacaacgcgtagacagcagggcaanagtcctgtatcacgcgagttatatatggtgtgagggcaaacgtcgcccaacgtggagtgctatatgtagtacgatcgacaccgcagcgtctancataattaccgctctcgtgtgaggtaaaggatctgagtatgngcagagagacagagagtcattcacagccgcacacgttgtagtgtctagtgtggctcgccgcccgcgctcgttgatatttatatgngantcggcacctcagaagcatgtcgantatacggatgtcactgcac

SEQ ID NO: 20526 - DNA, 807 bp, Homo sapiens
ataaatatctttaaaattcccacctacacactatacaacctttctcaaacgttaccatatatttaacctcagaacagcttcagatgatagctcatctctctaaaagatgagttctattacagagccgacgcgctgatcggcatctatcctgagtacgaagactgcatgttcagccgagttttgaccctagatctttctaagtatccagacactgaacgacaagaaagatacacgagacacggagagtcccgctaggggcaaccctgacacagaaaccttgatcctcgtcagaaccaactctaattcttacactactcctacacaggatactccctggagcacatcacgaccatgcctgatgcacccttaaaaaaaaaacttaacccgtctatcctaacaggcagctgcttacttacttatggagttcaaacctcattatagtcagcgaagtactaaaagggaagtggagatatgctagcttttaactaccatccataaactaccatccactgatatatttactcatttctatctataataaatataccttcgctggcaaaataataaatgcccactcgacataaaaaatggcatgtcatcaaaccataatacctttcgagcggtgacttgtttggatcttacgtattccctccagcgaccgcgttccagaagagatattattacttttcacgcaaatctttgctgtgaaccgtcatgacactaacaatcctaatgactaaccctccaaattaataaataccaaaatgagatttagcgactattagcacgcaccatgttctaatattt

SEQ ID NO: 20527 - DNA, 735 bp, Homo sapiens
ctagaccccagcacttaatgggatcatgctgtccccacccagatcaataaactggctcatctgatcttctggcccccaccaggaacagactgagcgcaagaagacagctcggactccctatgatttgatttctgaccaatcagcactcctggctcactggcttctccccacccaccaagttctccttaaaaactctgctccccaaatgctcagggagactgatttgagtaataatagaacgccggtcccgcacagccagctttgcgtgaattaccctttctcaattgcaattcccctgtcttgataaatcggctctgtctagcctaggcagcaggcaagatgaaccccttgggccattacatttatgacctgtatcttgtgctgacctgctatctcatcctgtgacagagaatgcctaaccatctgggaatgcagcctagtgggtctcagcctcattttaaccagcccctattcaagatggagttgctctgtttcaaacacctctgacacagctagacagactcttgtcacaaaccattgtctgcactgcaggcccaacagactttgtcccaggcctctgtatactcttcaagcccactgaatcccccttaaaaatcatatactaaccccctaaccttatccacactttggcatctccctttcccctaagaagaagggtatataagcatctggtacccatggtggcaggggaacaatcaggcctgtgatttcccc

SEQ ID NO: 20528 - DNA, 1081 bp, Homo sapiens
  misc_feature (1)...(1081): n = A,T,C or G
aaagggattttattggataataaatggtgggttgggagggggggggaggaaggggagggagagaggaaaaggggggaggggaggggaaaagaaagagggaaggggggttagggaagggngaggacagaagaggggcagaaagaagggaggggagagaaaaaaagttaaaaaaagnannngnaagagcggggggagaaaggggcgcggggaggcacgcgacccgagcggggccggcgcggcgccgcacgcttcgccccgccgccggccgcacgcggtgccgagccccccgccccacgggcacgcaccgccagcgatgagcccacgagagcggggggcggcggcgggaggccgccgccccccccaacgcggccaangctantaggccgcgcggcgaggacggccgggcgcaccacgcggggcgcggcgccggcccggccgcacggccgccagcatacgcgcagagcgcgtggccgcggcgcggccacgcagacaccgcaccccccgcgacgcctaccccggccgcccacccccccgcaccgggcccacgccgccggcgcccaggcgggcgccacccgcggccaccgggggggccgggcgagcggggcgccgcgcgccggcacacgccccccaagacacgcacggcccccggcccggcccccgccccgcccgcaccgcgcccgccgacggaggcgggagcacggagggccgcacgacgaaccgccacaccgacggcgcccgggagacacggccgccccgcaccacggcgcccccccgcccccaggagcgcgcagcggcgccgcgagggggcgcncccgacgcgggaagcggncacgggccgcgcgcccccccgcacgaccgcacacgccagcccagcgcgcccacggacgcgcgccgcgcgcagccgaaccgcgcgacgacacccccccaagccgcacgaccgcgcccacaggacggacccggggcaccacgaaccgcgcaccgcgcccggcggcccgcgccgaacgcgccccggcggcgccacgggcgcgccgcgcgcaccacggggccgaggggcaccgccccccacgcgcgcccggtggcg

SEQ ID NO: 20529 - DNA, 1560 bp, Homo sapiens
  misc_feature (1)...(1560): n = A,T,C or G
aaagtttccnnnntcgagcgcagcgaggaacaaaaaaatagagacccactagggagcgatcccccgangagacgagaattggaagcgcacaacagcaaaacacagtgcttagccatgggtgagggccggggcctgcttatatatgagagtatcattttgtgtgngtgagatccgtttatgagatagtatcgattacaagcgataggtgattaagacacccccaatgacccctttaggcattatcngtagtcccatcctatcgcccgttctctacccatttcaggagtcccgcctccgctgtgtatactagtcttagagtatcacccgagagtcccccccccgctgcgatgagataggagtcngcgagaatggctctccacaccctcagagtcgctaacctgagggcgggccacggacgccaccgccgtcgcgtcgatccctaagtgtcgatgagtgagcgatgcatcgcaacggcatgccatgtgttatcccgcataatgattcagcctcgttcagncatcagtttgtcatggaaggatcaagcaagatgtcgcgccgntgatgatccgctncacaccagcaacagcacatagtgatctcttacagcatcgcgcaagcagaagnaccatcagactagcagtgagcatagctcatcnctctaactctcccttcaattcgtcgcaatcatcagcgcgcacncatcataacgactttgaaagattgtcggcgccaagtatatgtatatatcatatatcnncgctgcgtcagtgtgctacgcgtatatctagtcctgataatagcgtctagcacgtgcgatgcataagtgataactgtccatcagtagtctctaatatcgtcggcgatgngncgtcgtagcagatcncnacacgtcagtagattcgtctcanagtactnngcntcagtctactatccgccagacgtgccgagaatcactagcacgaanatacgcatgcgtacactcgaatcgcccatgtcgtgcaccgccgtaatgacgcgntacntggtcancgcacgcgtaacngatagcgagaaattaagaagtcaagcagagcgatngcgtaagcgagnnntagacgatagtgatcngtgtgnnnncgcaatccgaggagcgcgcgncgccgatgtgcgtatgccgnagatagagccgctatggtctangcagacncnnnnatatngacgatgcatctatagctcgtagtgctggctacgantnatcgctggnccggagagnctatcgcgaggagcgagcagacatatcgtcaatatnnatacgcctgcactntgcgctgcgcacaccgagagcanagcgtcacgcatagcagctctgatgcagagtagtcgcacnatctatcacatgtcntcnagcnccacanatgccgacgccngcatgcanngtcatnctnacatacgtcgcagagcgcntcgccntgtggncncagatatagctaaggagantganagctgaagacgagagantatctcacnccgacaatagaccgatgagggcgcagctgagagagatgacntatggcgagagag

SEQ ID NO: 20530 - DNA, 887 bp, Homo sapiens
  misc_feature (1)...(887): n = A,T,C or G
cgatgggccgggcaccccgcgccggggcgcanccagcacaccgacgcgcgaccagcccacccgagagagnacagccaagaggagacgagcgcacccacggagccgcggcgcgcgcccaccgcgccgcaaccgccgcagcggcccgacccgccggcgccacgagcagcggggcgagcccaggccagcgcgcacccgccaaccccggagcccccccccgcttcccaacaccagagcgccaccaacggcaagagcggcgcggcgggggcggggcgccncacgctntcccgcgagggccccaaacgcccatcgctagcgcgacgaaacgctgtaccacgagcgtcgtacggggcgaggggcgcagcccccgcgncgccgccaccgccagagcgcccggacgcgccgcgcccccccgggcggtgatagcgacggggcgcccacaggtgcgcggagtgtagcgcgctcccgtctccagccatcccgcagacgggtgcggggagggaacccccancagcccccccccagggaggggggagcgcncaggaggggggcgcccacccgccccccacgccccaggccaaaactttggccccggccgggcgccctcgtggctttatccagaacttttgttctccagattcccagacagagcaccattttggccaatggcaaaagttccttaggnatatagtcaaaggtctttgaagaaaaagtanngncagagatcaaagaacatggcccttggttaacaaaatggcggggggtaaaaacaacaaatatcaggggngcgggctttttcttgtgaggagaaaagcgnntttgcaggaattgtgtttttttaacacgagcaagagggggtttttttgtttcaaccaggagcaaaaaagttt

SEQ ID NO: 20531 - DNA, 1069 bp, Homo sapiens
  misc_feature (1)...(1069): n = A,T,C or G
tggaaataaagtgagaaaaaagtgagcgaattaatcttaaagacacaattgtanacctacagtataaacagcagagcagcaatattgaacaatagagaaaganatctcaggatttcacaccagtcatatgagaaggctgcgaacacaccagcacgtgcactgtaacgacactgcacccgaccccagcctctacaacccagcgtctacatgacaagccaacaagtgccacttgcaatcacacaggacccgncactaccaccactcccaccacactccactccaccaactcccctcacctcaacacaatcccgtgccgcacccgcgacatgacccctcaacaccaacaccccgacagccgagcccgcagaccacgcacaagcgctacacaaccccacccacccgccccccgcccctcgtcgaaccacgagacccaagtacccccacaaccacacccacctacctaacgncctacgataacaacccacctctaaacacacaatacaaccccncaccacatatatcattcctagaatcaactaaacatcccaactttcatgatagtaaacatagtcaaatatcaagtagaccaatactcaaacccctcaaccaacgccacgctccctcttccgcccctctccgcctcnctcgccctctcaacacgtccactccaccgacccccacattcaacgaacctcaacactacacaccacaacacagcacacatcatcacccattaacattataccactccttacatacaacattctcctccngcaaccactatctataaaacacngccgacccacccacaaagtactcccacactccccaaagtcaataagtcaaatanagcgcccagtngaagcatcaccgtcggccacaccaacagcnacacgagaacggacacaagcntaacaaatcaacccncccgcaagacggcntnccaaccacaaccctctcaccnaatataatcatacacacaacccccctcctcacactcggccttcttcgaacaatgccccatcagcnacctccccactcctcttcccaaacctcccccgccccacac

SEQ ID NO: 20532 - DNA, 721 bp, Homo sapiens
tgatgcgatcggtgctctgaaaaaggactggggactagcgcaggcgttaaattgtcgcggtcgttttgctggtcgtcgatattacagtcgctatgtggcgtgacgctagaattgcgtatttatattagtgttgtgttttatagggtggcttgagaggcgtgattttcttgatataggggagggtacatttattgtgtgtgctttgaaatctcaagggcgggtggggcgaggtcgcgcgatgtctttgtggcgatttgtgatatgtctgcttgtgcataatatggtagttggaaggtggggggtgggtgggtgtgaattggtgataatggtggattgctctggttttgattggtggagtaagtgatattaggggcggggtgatatagctcaaaaatagggggaggggtttgatggttaaattgtgttttatgtgttttctttatcggtgcgccgtgtggcctgtccggaatcgtaattaagggagtggatcaatatttatttactgatatgtggcggggcaccggtagttgtccggtcatctgattactatatacacacagtcttggtcgggggttcgcttgcggtgggagtatgggcatgggcattggctttctgtatacatggtttatttcaagtccttctgtggtgatgaaaaaagatacgttttaacgtaaacaaaagatatatgggtatatttgattgaaaaaaggagagtaaggag

SEQ ID NO: 20533 - DNA, 893 bp, Homo sapiens
tcccccccctcttctttcccctttacgctctaatcccccccccctagaggtcattttggcactgttggaacactccttgagctgttgaagatcccgtgatcattacctggggaggggttcctgaaaccttccacatcgggatctgcggactttcatttttctaagagacttactcaatcccatgcatgcactacctcacccaccgtgagaaaggacaggcgcctctccctcacacatcactcataaattttcagcacttcatctttccccacccaccccgaaggacaactatcctacaatacatcccccacccccccccctcgactactccccccacaggacccgtacgttcataccgacgccctccacccatctcaccactacgtccctctcctctctttcccgctcccgccccactaccacctgcgtcatccccgcccactacccgatacgtggacattagtcaccgctgagaagttcacatagcccttcctcctccccgatcttatcaccacacaaaccactatccccactcgctagcttaaccagtcgtttcctcccccctattctcccccacatttactatatctcaacctctcccttccaacccattacttctcctctttctcaacctctcccctttccctctctccgtaagcccccctcacccacatcgatatcctatacgcatacttctttcatcctcctctttacccctccctcaacttcccccacccctctaatcctttattgatactcatcttcaccccttcacactttcttcttttaccacactattgtgctacatctcctttatactctcccccatacatttcctttatccccacactctcccttctgtcccatatcttcctatcaatatctctatttct

SEQ ID NO: 20534 - DNA, 914 bp, Homo sapiens
acccatcaaacgttccacgttacatatactttattttcattttccgcgtctttcttatgttaaacgatcacctgtaaacttgcgcgtcattctctctgctggctaatgcaagtataagaactcaatgaaaagacttaatcttacagctttcaatgtcgtcagattttccattatgtattgattttgcaacttacgatgtttttgagccccatggttcattttgattgtttaatctttgctattaaattcttgtcaaacacaggattatattgaaaatattggccttcttggcctcaatgagtggagcttttccggccagatttccctttcatgttggggcgctaattgattgaacctttaatctactagactcgggtgttactctagtccactccgtttgcagttgacgaggtattcaacattacttcatagagatgcatatcccgcgtattccacattaatttttggtttattcgcatgtaataatactttcgacaattagggcttgttttatgcctctttatcccgtgatttaggcccgcgtttgtctgtattctatacttaatggtcccgcccctcgcgattatttattatgtatttggacctctctttctttggaccacgtatcatcccctttactcattatcatctcctcaagttattccttctggtaaatttttctttgtcctctcctaacttaccctcagcgtagatggttactctgtctctgtgctcccttctttataatttttctgattcattaatatgtttattttttagccccgcccgctttcggtatatcagatgcttttatcctattagtagtatccattggatatttttttccacttccttatgttttctaagatctctcacattctcaatcctactacttattaatcatatttatattt

SEQ ID NO: 20535 - DNA, 211 bp, Homo sapiens
taggtgtacgcccatattgtttctggagttggttcctgctggtgggttcgcggtctcgctgacttctagaatggagctgcacattagcccttatttcatctgaatttcatcacatgcttcagagttgtgtttaagtatttgtttgctgtgtcaggtacacagcaaataaataaatacttaaaaactgatttttaacccaaaaaaaaaaaaa

SEQ ID NO: 20536 - DNA, 583 bp, Homo sapiens
tattttatctgacaaacagcagagtattagataaatagaaatcttaaatcctaacatgctgcacccaggaaagaaagcttatgcctacagcagaacagcacttagggatctttaatagaatgcaacttctgtcactaaacctttagaaagagatgtcttaaaaagaagagaacaaatggcacatacttaattcatttctcacatttacatatcataaaaaattcttattacatattcaagctcctatcacatctacctcttcctctatgtgataaggtcttcattttatatccctaaaagtgattaatagcagaatggagctgaaagcaatcaataaactcaatcaaccttaatgactgctactggatttgtggtaccagaacctattgattattacagcaatcttgacataaactaacatactgatgtggtagtcagaataatggctcttcagagatgacgcggtcctaatccagataatttataaatttgttagcttacctggcaggacagactttgcaaatgcaattaagagttaagggaatttgaaaatggagagactatcattgatttttagatgggc

SEQ ID NO: 20537 - DNA, 1228 bp, Homo sapiens
  misc_feature (1)...(1228): n = A,T,C or G
agcgaggtaagagaggtagttaagtaataaagagatgaagagtaggaagtgaagtttgagagatggagtgaaggtgagtgataatgagcagaatgagaagaaatgtgtcggtgagaagagatgtnggaagagaatagtgaagggagaggagtgagagtangagtagagaaggtggagngggtggggtgtaatatntgagtgatgttgatgaggnagtaggggaggaggaactaagtattttgtagcgtnggagaaggtggtgcgagagaaagagagttgatgagtagagacgagagatgggaggggttggcatgagagtgagagagactaagnagaggggggtagtagtggagagggagataagtgagtgaggggagatggcgagaggtaatgagagtgattagtggtgaaatcagatagacgggagtaggtgctggtggatggtgagggggaaggagagcgaggagtgagggagaggagggagatgagaaagagagggagtgaggaagtatgagagttggtggacatagagataagagcggnaggtgtggaggagggaggagagtaggaagcgaggagaggatggagggggaggggagggagagagggagaggaggcggagggggatggagaggaggaatagaagtgagaggtggtaggagatgataggagaggagaaggagagagaatgaggaggaggagagcgatagggagatgctgggtggtgctaatatagagaataggactaatgcattatagatgacaaaggtatattatttagagagcggagagagcgtagagatagaaggatagaggaccaaccaggagagggagagagctggaggagaagaaaaagagataaattggaaagataaatatatacaagattgaaagagagatggtgaagaagagggatagggagtatttgtaagatgagaaaatgggaagaggatggtagggagacgagagagggagagggatggaaggaaagataagagtggaaggngaatattttgtttgaatggcacaggggacgcccgaagaggggggagagggagtggttggggagaggaggggagaataaaataaagaaaatgaggaagaggggctatggacagggagtagagaagcgtgtgatgaagagtaatggaagatataataagagtagaaataggtggggagaggtctggtagggtgacaatctatggaacagaacgagagagcatgt

SEQ ID NO: 20538 - DNA, 974 bp, Homo sapiens
  misc_feature (1)...(974): n = A,T,C or G
tatccgccgctatgatcttgttctaagttagcagggcttgacagggctgctagtcgctttccgggataacacctgccgccatcatcaatctgctgagatttgtgaagaccactcaacgaagacagcccgctatgaatgaatcattcaatgacggatcaatccttatgtgatgctcacagacttcaagagagagagtcatagctctcaattcataaaagattccgagagagcatatataatagtcccgatcgccacaacagtatagataacagaattatccagcgcatgttacaaatagcttccattcaggttagctatagtggttctgcccatcttattggctcgatggcggcgaccagaaatttactcaatgcgcggctctctttcggctgtatatagaaataatcctacggcagccggacaacttccgtacctccttctctttaacggaccctgtaactacaatacgaacttctgctgcaccagctcatnaaagacgagagaccgtgtaacctaaataactgaaccctggatatcaatnctgtccatgccgcatgccgcctccctcaaaattaattaaactggcccccgtttggcctacacgcgcgggagcttctgcggtccctttccctttacgtgagggctgattcaaggatccttacttaactgcctccttatacctccgatcgtagctactgccgttaactgtatcaacctcctccaaaggtcatatactgtctattcccataattacgctcattnacccaagagtgttcttgtgtctaatatgcccaccgatggtccagctccgccaaaccggccgctctggctgacgtgttgccataggctttcgcttctgttacgngnctctccatagtcgcatcccagttcgactatgggaggaatcctacggagtttcttgattcctgcgttttccgctagatgccacctattgtattccctcgtctcacccg

SEQ ID NO: 20539 - DNA, 1688 bp, Homo sapiens
  misc_feature (1)...(1688): n = A,T,C or G
cgccgtctctctctttccttactctcttctcgtgccgcgcgtcgngnccgtccctcactcgctgtgnttctgctctgtctgttgcgctgatctcgcttntgcgcgtgtcgctgttgggtcgtcgatattagcgtcgtgctgtgctcnactcgctcgcgccgctcccttctggcgtgcgctctgcgcctcgtcgctccncgcgtctccgttgcgctccgctgcctngncctccctgcnctcagccatctctcccgtctcgcctcgcctgtcgcgtgtcgtcgtcgcgtcgtcgcgcgcgctttgccgtctgttgctntgctgngcgctgctctctncncctctcttctcgctgtctcactgcgctgcgtggtgcggtcgnccgtgctcgtgtggcgctgtgcgccgggtcctctcgcgcgtcgcgttcgccccgcgtcgctgctatagtcggtcctcgtcncgtgtgatcgtcgttntgctgtcctcgctcgccgccggcgtcgcgccgtctctgccgtgcgtcgtcgctctactntctgtcgtatcttatcgccacacttgtcgttctggtgcntnttgctgtcgctattctctcgtcctctctcttcgtctcgcatcgcctcctcgctcgtcctacgtctttcgtgtggccgtcggtgtggcgcttgtggtcgctctgctgcgnctctctcgctcttcgtcgcgtcttctcgcgctgcgcgctcgctacgctctcctgtcactctccgaggcacgcctggcgccgtcgcttccggcgcctcgcgctctgcgccgctcgctctgcgngcgcnccgcgcgccgtctctgnctcgcgctgtccttntggtctgctcgtgtctcgtcgccgttcgttcntngtgtgtggcgcnctgcgtcgtgctcgctctcgtgctctgtcnntcgctctgcgtggntctcgtcgcgtcgctcgcgcttcgcgcctcgnctctgcgcgtctgcgtnctcgtctgcctcgtcgctgggtcgctcgccgctcgcgtgtggtcgcncggtcgccgttgcgtgctcgcgcgtgcttntccgtcttcgcngncggctgtcgttgcgtgtctctcgtgtcgtcgtttgtcgtgtcggtcgtgtgctgtgtttctgcgtgtgcgtctgctgangtgtattactnctcgcttccgtccgcgcgcgtcgcgggcgtgtcgcgtggnccgnctgcgtggctgcgccgcgtggctgcgtctcgcgtgcgcncctgntncgtctgtcctcttttcgcgncgccgtcctttgcgcncgtgctggggttgctgtgtgtcggcgcgtggcttctcgtccgctctcgcgtcgcgtcgcgcggcgttgtcgtgctgtccttcgccgngtcgtcgcgctgtggcctcgggctccgtgttcgttcgctcgtcgcttcggtgctntgtgcgtggtcttcgctgtgctgtcgccgcgccgctcggtgtcgcgctngcgncntctcgtctccgcgcctctgtctctccgtgtctcgctcgccgcggttgttgtctntctcgctctcgccttcacggtcctcctntcnctctcgntncgtcgctctcccctctgtcagggnttcgtctttctcgtgcttgtctgtgtggtttgagtgtcgcgctgcgtcgctgctgtgacgntgcgtgcagcgctgtgtcgca

SEQ ID NO: 20540 - DNA, 955 bp, Homo sapiens
  misc_feature (1)...(955): n = A,T,C or G
gggcactggccggagttgtcggggaggcgatggggggggagggcctcattggcggcanagccgaccattctcagttgacttcccaggaaaatgattcagctgtgaaaaggagcaagaatcttgcaatatggcgaacataagagaatattatgagagagctttgagagagtatggatccgccgatnctgatctttggatggattatatgagagacgaatcggcgcgccgcgcttggtcgacctggtagctgctgacagacctcctggcgagccacgatcttgtttcagcgcgagtcgcgcgaggcgctgctgtttgctgatgctctgtgtcggcctgtgcattgcttactaatagttcgcctccgcggggcgacatctcgtggctaggtcctgacgagcccctacgcctccctccggctccgtcgcgcctaagcccggcccccggggcaacagaaggccgcactgtgcctgctcgctgggtgtctctcgccccgcccattatgctctaccccgttgacgctcgtctgcgtttctgtcgcccttcacgacaatgtttcgtccggtcgcgttgacctccctcggcttcgctccgatgatacagcgggctccgtgtctaaccccgcgttcctttgctttccgctccgcttgtggcctcttgactccgtttcttagccggcgccgtcccgttgggcctgcttggtcggtcgtcgccgtggtactatgcttaccggcaacgcaactggtccgtctcgcaccgatcgggctggcgcgggcctcgacggtcgatctctcgtgccgctctccctgaccgctgtttcccctacgcagcgccctcctcgcgtctgttctttgcgcgcgtcgcgccgccgcgcgcatccctccgtggtggctagctgtgctcacaggcatcgtgctccatcgcggcgtgcgcgcgagccgctgcagtggtgcgtagg

SEQ ID NO: 20541 - DNA, 1333 bp, Homo sapiens; identical to SEQ ID NO: 6095
  misc_feature (1)...(1333): n = A,T,C or G

SEQ ID NO: 20542 - DNA, 1780 bp, Homo sapiens
  misc_feature (1)...(1780): n = A,T,C or G
cgcgcgctggctgtctcgtctgnagctcgngtatncggacgagcgatgcagcattngacgtatatactntgatcnatacattanctgcgatacatactcgtagcatacgtcantctgatncaccgctatcantcgngtgcttcacgagtgcgnacacgacgcancgagantgggcgcacgtgtgatatngcgtgctagatcgacattgtggatgatatgtcgacgtagtcgttctngtatcacgtccgtctcgtcgacgtacgtgtacttactctncgtggacatttccgacaacgattacagtatantatgtctatcnaatgtgatangtttcgcagatcatgattgtgtgtatngcgtgtgntacgtntatntctagtcgcgcatcgcgtagtcgtcgtcgtntgcagtcagcgtcgnggatcatagacgttcgcacacactcgtacagctgtgcccatcgatntctatcatgttagagtcatnacgacnctatagcgcggcgcgtcgagtgactgtgatctgtantgagcagcagtggcttaatncgtctattgctattcagtacgacgagtnctatgttctcatccgtagtctcactgcgactgagtttcactcacgtgccacgtatcgtngtgnagataaactcatctcgacacgangtcangatatgcttgtactactcgtnttacatctangccggtatcgtgnctnatnttctgatctatantactctcgctctcgtacgcactcgtgtacactcatctctgcattgcgtcgacgtccctggacgntgcatacactgcggctncgatgatngacgcacgtggcaatcgtcngtgtcgatgccacgctcacactatcatagtagagtgagatatacgatgtgtgagtagtacagtctgctcatatanacgtgtgagagtacgcntcgtaccgcgctgcttcagnactncgtgtatctgacggtagctgacaactcttgtacaacgngcacgctgctcgtcgacgantgantggtacgatgtgngcgctgcatngcgtcgtatctgttatgtatactatgcactgctaagggtagtcgaatataacgtgcgactatcgacgaaggcacattgtatacggtgcagtgatgtgtctcaagatagacacacgtcgatagacatatgtgtngacgactagngagacgactgcttgtagtctcgcacgcccagacagtcaacanctatacaaatgctcctcgcgtctcgctntctgacttgtctctcgtcagccacnattgctccngactacatacgtagccaccgtgcagaagtcagtctctacgcaccaatacnatcacatantntatgtactgcagctccgcgcntgccgatcactcttcactgtgcgtagactgatacctgtagtcgtggcagctagacgcgcgctattcactcgtgtagagtggagcgtattagacgtgtagcatctatctgcacacgtttgcctaggtgagatacgcagagcgtgtgtgcgtcatgctgtctgctcgcgtgtgtgagagacgtataccaaagcatactgtctacctatatgagacatacaaagtgtgatatatangacatatatgatgctgttctcttncngtctgtcngncnntaaccaatntcttgtgtgncgtangntcntgctctgctcgcntcatgtgagggnttcgtctcggtgtcttgcgntgtgtnttgccggcggctgctcgctgatagtgtctcgtaccggantatcatgcatgcgagatacg

SEQ ID NO: 20543 - DNA, 851 bp, Homo sapiens
gcatcgcacccatggattcagttttcacagcgtacgctctttttcgtgtgacggaaagaggagatgggagagaacatcatggaccctactttatggttgccatggatgcaagcctcatttccattcctttctactttgaacatagcaagtcctggaggctgctgggtcgtcctccagccacaaggtggctcccccaatcccttctctcaagccaatcgatgcacgcctttgctgaattctccacacggactacaattcacagctaccatgatcgataaacgccattattttcattgggaagcaaaaggcttatgaccaataccctggggcactaaaattcaacgccaattttctcctttaaacatgcccacaaagcaacacagctttgtccttagcgaatcagtctatttcaaccatacttgtcataaagacaactgagtcttatcactaagagcaataaacgattagtcctctcaccgcctcatccagaccccaccctgcgtgtcgcaaccgaacaagcgcgtgcgcggacacacccctacccgcgtcatagacactttcctccatttaatccaactatatctttgagctaccctctccgcctactactggcgacctcttacactgtgcgttaataacacatggtcaaattgcggcccaaccccctcgtgtccctttactctttctgcttgtttctgagaactttactgccacgtaaatgaaagcgagcattcgaccggctcgggtcgtcgccatcgccctgcccgacgctgcatacgcgccaatcggcgcggacgccctcccgccgtgcccctgtcctcttgtcgggatatgctccacttacacgtccc

SEQ ID NO: 20544 - DNA, 700 bp, Homo sapiens
ggctctctgccgagagatgttagtgggagatcttggttttcgccccctttaaggggccggtgttattttgtatgggattaagataatgggcccggggggaaagaaaaacatggggtgggggaattggcgccccctttgggggggaggggttttttttaagggttctcttccttttttagggggggggggacccccgggggggccttgtaagccttttcttgggggggagttttccagaaaatattttcgtggagcccccttttttaagggggacaaattgggggggggggggtcccccctttggggggcccttggggttggttgaggggcccccagggaggtttgtccccctttttaatgggacccatgtttgggggggaggggggtcaggggggggggggggttttcccccccttaggtgggggggccccgaaaaagggggacccccaagcccgggggcaagggggcaaaattggggggggttttaaagccctgaggggggggccacaattagccccccttgggcctttttaaaaaattttttgcaattgccaaaaattggcccccttcccccccccttgaattaaaaaaattttttgtttttggggggcccgggatccccaaaaaaaaaaaaaaaaaaaaaaaaaaaaaaaaaaaaaaaaaaaaaaaaaaaaaaaaaaaaaaaaaaaaaaaaaaaaaa

SEQ ID NO: 20545 - DNA, 868 bp, Homo sapiens
  misc_feature (1)...(868): n = A,T,C or G
ctatttgctactaaggtcacgttgtgtagtcagagcaagtgcaacaccgtttacttaccgcanagtttgtgcctgtatacacatcgaagcacagggagaggaaaagacaacttttgtcttcctctttggagtctggatggaaggacaaaaagaaatgacttacctaaggaaaatatttcccacagcagaacaccaaaagaccagacgtcactctggattgtgtacactctgtctaaaattgtttctggggccattcatttcaaatggaggcgagcctacaggggtaaaagacatggattaagaaccccaattaccaaatctcttgaagaaaaaaacttcctctgttcctgaacacaagtcctgaagctctatacaaggagtgttaactttgcaacttaaccaagtactgggtttatatttaaaatttacattttcttttttgaagtatttttgaatttttattaagcctcccgcccaagccatagttccatgatgttagccgacgttttataggctatccgcttatttaacgcctactaaatccatctccgctacgtcacacaaagaatcatgatgagacctanagatttggttatatgtgaccctattctcatcattttagtaagctatggatgtataataaaagggnttatgtgtataagtcttttggtcttaggtggtagttgtgtttgtatatgttatgaaacggaaaagtactggtctgtgtcagctgaggacgaccagcagaagctcggactttgagtcgtattcgagcgtcatagggcctcggcgatccaggccccgagcagccggtctacgtgcgaatgtttcctgctccgcgagatcgattacctgacaggcctagcgt

SEQ ID NO: 20546 - DNA, 1255 bp, Homo sapiens
  misc_feature (1)...(1255): n = A,T,C or G
ccctcgaacacacacacgggnnagatacaagcaactctcatnngacaatgtgatgaaaccaatgaatattgagagaagngagaaaatatgtgggnngngggcaccacgtatcaagtctctacgagatcatggtatgtggtctcattatatatgtgagatatatatatgtatgacgtctgcgaccctgcctctcggtcggtagacctgtacttctngaccatcacatgccttaggaaacagctgcgcttctagcgtaccgagtggngaactactaccgatnnnnctcgagcgcacaccgccgnagtacggcagcactgtggcgcttactcagtgtgccgtgatgctctagcgtnngaagtcgaccagctatnctcatgttcnngctcttctacacacacacataanngcactctcggngcctaacgtccctccagcncaagactgtcacatgctctaacacatctgnnccctcacccctcacttnnnngcccctctgtcatactctatnncgcaactgngaccagccacaagcgcgacacaccacaacannnnnnnaaaatctgcagtacagtcagtgaatgctgngcgtggtaacttgagacgcatgaggcccgganaagtcgttgggtcgctgtgngcggcgttgnggcgattaaggnagcgttnngcgtgctagtcttgtgctggagnnnnggnnnnngaaccctacaatggactctgtgacatagttaacttcatgagatgggagacaccgctgtcacaccagtctctttnnncatttatttnattttcttgtgatttgtcgcngtattcgtttcttacaatgcctctgnaacttgctacaagctataatctctnnnccctcccacctacacttttttccttcttcttctttntcctcctctcttnctacccacaaaactcnncaccacaccccacatcccactncaactnacactccttctctancccaattnnnattaaatcctatcatactataaacttatactattaactatatatcacattacacattatatatatctttacacatnnnccttcctttctcttttcttnctttcacctcccnnccccaataacccatacaaactaacaccnattcctctnctctcctctcattccccctctcttacaatannnccttctttcttcttttttttatctctcccctnncctcccnactaatnatacaccccnnnccacatcanacccttnccatatacctctaccacca

SEQ ID NO: 20547 - DNA, 2055 bp, Homo sapiens
  misc_feature (1)...(2055): n = A,T,C or G
ctagtgatgtatttattcaaatcgngnnnnnagngaacganaacgcatatcactttcatannnanatcacagcacgcacantaataacatatagacagcagagtcacnagnggnggtgngngatgnagcacgagnnngntatcaatcatctagatatgttactatgancgtgcgaagacattgtgcgtgaggagctcatgtgttcgatatatgngacatgtagtatttacagcgagcactatgactgtatctcantacgtctgactgtagtataanactcacactcttntnnaacactctagctctggaattacagntgcacgacacagctaatcatgcgagtanaaatctnctatcgananctacatnctantntnttagnnangaatcttggacattctctncatgtngcgattcttcgtgctctcatcctatgacatcactatgngactnagngngantactcgtgtgtctaccgctacgtngnnngtgtatcttgtatacactcgtcgcagntactnatgtccnnngnccatatctncgtcgcacnactcactgtagagtatcaagtgctgnagctaatctgcgactcatacgctcatgagaatgcagtatgagactaatacgcatangatcgttctcattgagngngcactgcacgtgcgacgctagatcncgtngggnnnatctcatctgctgtacgtnatgcatagtgtangncgtcgtacgtgtntacatcgtgtgtactgtatcgtagctacgtagtgactatatgagatatnnnggnnnnngngtgacgtatcgcgtcgtcgnanngacncttaggcagnnncactacnagnnnatatatgtntgagctanatgaacngatctcgtntnngtactcacatctcnnncntcntttctngtngncgngacagtgtngngntccgtcagtgatgtcgngaagtcatcgtggtntnngagacgtatagtnngngcgctactcctgtcgtccatgcttacgcagngnaggnnngngnnngnnnngnngnngntgcacgatctcctaggngnagctacatctanganngacatcatattannancgaactacataaagcagtanggagnagnngnacaaatatcatatnngtgcgcgactgctgtcngnngtacgtatctntngcgtncgatcnctgtgtgtgatgntctctactgtgtgantngntgctcgttcgtngcctcggatgngttctctgtgtgcgtactatcattgtacagtacacgtnnngacacttactagagcatctcatacgatcacacactnctgtnnnnngatgctctcgtctctcactctactctatactntnctccgtacnctncntcacgtcatcacnnctatcgtctatcatacatactgncnntcncgntcnacnacgactcatnnnnnantgacatattatcnttcatcacnagagtgttacacttcgnanctctatnnnnacacctgntntcgcatcaactgtnttnngtagcttttcgttnnngacatctgacgnactacatanacacgcacagngtacatattaataatgtnttactgtctctctgngtgtnctntgantcacacgtgtnntctcgtnttgtgtgtagtntatgtnnnngntgtgtacgnttctatcatgtcttagnnnncattctacattctatctttatccttctatcntctcttnactctctactanntactcactctnnnnnnntnnntctactatactcatactatatactaantnaacatatctctatacttnannntatananatnnnnnnnncatcatcatcatctcatatattgtctctcatctatcgtgatatanngnatnatnntntnnctcttgngtacttntatctcttattacttctctctnnncacttaatcnttcctctcncctnnnnccactctttcttcctactttctatnaacaanaatcacacncctnnnnnananacactcttatcatcattacacatcanactctactcactntcncacacatcttcaactactct

SEQ ID NO: 20548 - DNA, 940 bp, Homo sapiens
  misc_feature (1)...(940): n = A,T,C or G
cgacctctccactcccgtgatccctcggtggtcgccccccgggccccgtcgcctgtcaccatctgaagaatgtgtacttctccctccagaaatatccagttaaaaaacgggtgaaaatacatcccaccacagtcgatgcgtgaactatacattctcattataccccagtcctggctgatgataggatctcgaacaaatcacctgtaggctatgcggaattcttatgcgcggaaatatccaaagaaaaggtctcgctcgattgaaaccgcacaaaaaacgcgtgagctttcttttgtaaccatggcatacctctacctccaccaacagcaagacccaatcgaccaattgagatacggacaattaacatgcgcttctccccaaagaaacattctctccaatcccctaactaacgtggtatagatgctgctctcgcgatctgcccatcggctcatcggactgtaataactacttatctgctcacgctctagctctagatcaggtctaaagttttccatcctcgtagaaactgaccctactaacccgcttttattattcatggccctaatacgcgggctactcacgtgctctctcctatccagcgctggtccctcttccggtacccccacggcctctcctatttccctacctcttaatattccagagtgtttgacattcgccctctcctaaccccttgtatatctacccaacatcccctcccattgatactacccccgcgcgcggcccccgcaagccggtacaccgctcttggactgagggcgagtcagccatcaatgagaagaccccanagcacactatttatatgcgccctactgcaagatgtttctcgttcattcctccccaccctgaagccccaccccccgtcttggccccagatccgctgttctcgcccgcacttcctgttctttcctgcccctatccc

SEQ ID NO: 20549 - DNA, 652 bp, Homo sapiens
  misc_feature (1)...(652): n = A,T,C or G
caattcatatctggctattacacatcgngcctgactctcactaggtgcctataaagacgagnccaacatagcgcagatagtaacgctagacatactcctcaagtctctagggccacaaacctgaccgtacacatttcccttcaaagtggttaaacgatctgaggaaatcttggcataagaggcggagtggggcccctctctctgtgtggaatgcgtcactttccgggtgtgtcataatctggcgatgatttgggccccgaagttccatccagcctgcagtactgccccggggggacccacaaggcaccaaacgatcctcttctagtgtgcagtgtctgtaacgaagccaaattggttgccccccccaggtaaatattttactttaggggttgtaaagcgaccttattccgacatagaatggcagattctaagatctgaaagggcggagaccgattatactactatgaagaatagagtgccgatgtcatcagttggttattcctgttagtcacaattcctattctgacctatataaaaacttatcaagacccgcacttcttactgttgtggattttgacgtaggtgcttttaggagaacaaaataaatgtggtctcagcctgctcctattaaactgcttattgtgtatgagac

SEQ ID NO: 20550 - DNA, 589 bp, Homo sapiens
agtctctctgcaaacattcccatcacccctaccaatgagctttgcctctactcacccatctgagccccagccttcgcgtgtgactccgaacggtggagttgtctcctaaatccattcatcttgccaaaacgactgctcacaatagcaaagacatggaatctactaaatgcccatcaatggtagactggataaagaaaatgtggtacatacacaccacggacaaccatgcagccataaaaaagaatgagatcatgtcttttacagagacatggatggagctggaggccatcatccttagcaaactagcacaggaagagaaaattaaatactgcatgttctcgcttataagtgggagctaaatgatgggaacatatgggcacatagaggggaacaacatacactggttcctatcagaggatggaaggtggaaggagggagaggatcaggagaaataactaatgggtactaggcttaatacctgggtgatgaaatcatctgtacagcaaaccccatgacacaagtttacctatgtaacaaacctgcacatgtacccctgaactgaaagtaaaagttaaaaaaaaaaaaaaaa

SEQ ID NO: 20551 - DNA, 943 bp, Homo sapiens
  misc_feature (1)...(943): n = A,T,C or G
ctctctctactgtcctcctcctatatctttgttcctcttcctacactgagtaaagccccacaggtgcaagctgttgagctcgaggctaaagaagttctcaaaaaattatttccaaaggtgtctcgtcccttctaatttgacttatggtgaatggttgcatggatttgaaaaaaacgcaatccaatgtctgcgctggaacttcagggtcacacgacgttaaggttctatagcacatgttgcatcatactgttgaaatgcacacattgctacagctagagtgtgaaacatgcaaatccccccttgcacaaacagatagaattttacagccccttcctatgtaatgctctagcatcaaaaaaaatataatggaaaggttaaaggtcgtcaaatccaccgcaaagactattcaaccacaatgcccccctcatttacctccttcccaaccatgagctaaacgtcgatctaaaaacctacattaaaggattcttgaccatcctgagcacaacaaactaacaacccttctcgacaccggaatctcgataaaaggcctaacgctggtaccaactcctacctgtctggcacccacaaccgcacaacacttgcgcagcgtacaattacgaataataaccttcacacaatcttttaaacttatccataagtcaacgtccatatgcgccccctcaagtatttttactcagcgctcctccccattctcgccagctcttacccctgccaacaatcctaataaccatcctggaccaccctatcttgttctcgtaaacaacgagttactttatcctcaataaccaactccttctccataaaagataccaccatgtccctcaactatcagtagtaacgtctacctcacaattctcgccacgcttttttcaacaccctaatacgccccaccctccatccgagaataaccnatatcttctcg

SEQ ID NO: 20552 - DNA, 745 bp, Homo sapiens
  misc_feature (1)...(745): n = A,T,C or G
caccacaagcacatngggtaaaaagtggggtcattcccctcacatcccctgtgcgtagaatgcattnacttctttacaagaaatctcagtggtggacccatatatttgggaaataacactatgagtatctaaggcccagctctgcttcttacacaactctgaagttttaaatactcatttaaaaataaaaatctgttatatgggaataaaacatctacttcaacaactttcaaggaataagtgaggtaacatatgcacaagtgtttcatatagaattccagccactgttagatgttattaccccaaatagataattacgaaaggtatgactatactgtttttgttaatattaatacatctgggtaccatacttttaaattttataggctggatttcagtaacaccatattagaagtctctgctttatttttaccatcttcttgaatttttgtgtattaaaatatgttaaaactcagtgctaaatgtcaatcttgaaatacctttagtcattttacttgttgaaatgtaacagcaaataatttcttgcagaaggcaataggtagtgctatttgctcacagtgattataacttttgtttttgccttcttaatgtgtaacagatgtggaaagacagtttgtctcacccatccctgaatgctgggtgcaacatatggcactgaatcagattacatcgtatgtgacacagtaaaatacatatccatgaaaagagaaaaaaaaaaaaaaaa

SEQ ID NO: 20553 - DNA, 830 bp, Homo sapiens
ccactatactgcccgccactccccccccacccaccaaaacatatacattgttaggcgaggacaacaaacattaccaccccagctgtgcccgatgcagcagaagcaaccagatgttcacagaaggagaggaaatgtatcttcaaggcaactaggaaagtctacagaaaggattcttgagtattaaagcaaagcctggctactctccccttaaaaaaggctagctacatgagaaattgacaacccaaacttctttttggctttagaatgatcactctgaaaaactgtgattaaaaacatcacggaattttgaaaggccttatgaaggcaagtgacaggcacccgcatctgtggcctcatgcgggatttatatgacacgttttccaaaggacaacaggccttacatctgcagaggcaaataggccacgtgtcactttagattccctaagcacaaaacagatttatctctttattaggactgtgggcctagaattctagcatgacaattctagcactcacaaacaaatacacatgagtgccacacaaccctgtctctgctaaaaacatactcaaaagctccgggtgcaactcttcaattcaaaatagaccctggaggctgaagagagaccggctcccgcccggcacacctgtcccacattccggctacaaataaataggctatctttcgaggctgaacaaacaaacccatcgaccgctcaaaacctcacgacgtccgcctaccctaaccgatcctcaccctctacgccacatattagaataaaaaccttacaccccacatcacccctcactctcctaccaataacctatactag

SEQ ID NO: 20554 - DNA, 656 bp, Homo sapiens
ctgaaagccacgtgaataaaggctgcttgcatgaccacattaagtgaatggccgcatctgtgcactggctctgcagccctgggcagcgacacagagacagcaagcagagcatccatcaccaggattctcagagtctcgccctgtcaccaggctggagtgcagtggcatgaactcagctcactgcaacctccacctcccgggttccagcgattctcctgcctcagcctcccgagtagctgggattacagatgtgcaccaccacgtccagctaatctttgtatttttagtagagatgggatttcaccatgttggccaggctggtctcaatatcctgacctcaagcaatccacctgcctcggcctcccaaagtgctgggattacaggcgtgagccactgtgcccagcctgtcctctcactcttgaattccttcctgcacgacactaagaacccatgtgacctcccgggatgagccccgatttgggggttcacctgtgataaagtaagctggtgaacagcagggaagcactctgtgtctgtagcttcctgtgagtatgcaatcatttcaaaattaaaagtttgttaaagctataaaaattataaaataaattaataaaaatcattgtctcaatcttcacaacaaaaaaaaaaaaaaaaaa

SEQ ID NO: 20555 - DNA, 215 bp, Homo sapiens
tgattattgggatagtagattaaaagtcaaccgaatactacaagaagaagcaaaaacattccagggtgacatgtatattagcaactgtcggcacataagcaattatccctcgaaagaatatgtccagagattactggcatttattcttgccagccctctacaaaactaagcaactttcactgaaaatatctaaataaagttactattttactata

SEQ ID NO: 20556 - DNA, 1176 bp, Homo sapiens
  misc_feature (1)...(1176): n = A,T,C or G
ctataccacaataatatataataatagaaaatgcgaatctattgtacactttgagaaactagccacatcgtactcagcacccccacagcagactacaggcaaatggtatccctgaagaaagaaaacctgcactcgaagccactcgagattctactaaatctaggacacatactatgcgaccgctagcatacagcatgtgtctgtttactacttcacaatcaatagcgatgcgagctttcttactcggccatcatcgttactagcactgtatgcgcacgtacttagagtgtgatacacaaagccagtacacacatcaaccttctccattctctactacatcgtcgctttcttcgagccactttacaacgcacctcctccccacgaactccttgtaaacaacacaactggacgcaaccgttatacaagccgcgcccacaatcaaaagcttggacacctctctcaccagtccatactaaatacacccattaacacattaccccactactccacccactcacaaagcgtaacttactaactcacccgcgtagcggagaaggctacaccataaaaccgctctctccttcgcgcccactcttcgcaactctcactataggtctcacccatatgtcatcgagccgcagccgccacaaccgaactatcctccagctgcgctacagataagcggacctatcgtcaccctcaacccccgtacgacagaacgcgcaacgcctaaccccactctgtagctactactacagtctctcgatcaccaacaatccggtgcactaacccacgggaaatcaataatggtgaaccaaccgatgtgcctcctaaacatattcacgacatttcccgactcacaccgcccgccacgtccggcagtcgcccatgttaactccatactcgtagaccccatcgaacattacctgcatacgactgcccgtcgcacacgcattgcacacgcgcgcacncgcactctgctatacagcaggtatccgagcagatagtctatgatgacgcagctgagtcactnaccntgcaactnctacgacggcagtatattgatatgcgtagcggccatcgcgacagcatgaccgtagntacgcgcaaggatatggcgacgatccatgatacacggtgtggcggaatatacactccgaaccattcacccgcgcg

SEQ ID NO: 20557 - DNA, 660 bp, Homo sapiens
  misc_feature (1)...(660): n = A,T,C or G
ccactcctccctccagaatagatatcacacttctgtaacaggggtggctgggtgtgtgggtggatgtcatctangatcgctcccttccatcccattgattacatatgagacttcaacaccttcgcctcgtctcggctcgccttcttttcatattgctctcatgaaacacttcgtgaagtatctcggcgcgctcattgagtcgccgcatggtctctgaacttggcgctgccgcgtggcgtgttgcggttggtcttttggactcacgcgggcttcgcgccgtctcctccgtcccccccctttaccttgctctttctctcggtttcttaccgcgcctcgtttggttctgtgcttcgccgcttgctggaccgctgcctgtcttgcctctcctgccctcctcatgggcattgtgtgctttactgtggtcgcggctgttgggttgtgcgctcgccgcgcgggccactccccgctggtggtgtcggttcctccttcgcccaccgtgggctgctccttgggtatcgacctcgcaccgcctactctctgtcatgttttgtcagtctgtgctggtgttgggctcgacggggtgagattttatcttttttaggaagactttaataaagaaaggaagcgatagctaaaaaagtaacacctaaatcaaaacgt

SEQ ID NO: 20558 - DNA, 868 bp, Homo sapiens
aatacacaacggcacgcgccgcttggtcgcggcccgcgcgaaatcggagggtaaccactatcctcagcctgcactccccttgagtgtattctgaatcactgggactccgttgaccctcagactgtagagaaagaggaaaaaaccttttccctcctctgtcctctcttccagccaggcatgaccatgtaacagtttgggctgctgagccagaagggaaagagtactactgctagacttccaggaaggctgctctaagaaagatgactcacaggttgcacttttttagttttgggggtttttatccctctacttcctgcttctcggaactaggacatgatgtcgtggaactctagcagccattttggaccatgaggtgattgggcgactagaagatacatcgtagaatggagcaccaagaacgaaagcccccaaagctgacctataagacctggacttcaaacctgcaaacttcttgcatggtgagagagacccaagctcaggctttgctcctgccagtggaaaactttgttctcgggtcatgagccaactcaggggcacgcccctttggtacccccagcaatatctaccagacccactagccccattcacgagcggttgtaccactcacagtcaatcagtcgcgtcaaacactaccccccggcatcttcaacgcacccaaggggactagaatgaagctcgggatccgaggcgctccagggaaattcgcgttttcgcgaactgcgcaaaacgaccctacgtgaccttgatagcatcgatgacaaacagacgagaattggcccgattagggctcaaaaagtggaaaacctagcgggccatcgcctcttaaaaggagcgtaaattacagaag

SEQ ID NO: 20559 - DNA, 768 bp, Homo sapiens
ggttgttagatgaccggcctcaccaactaccagcagaaagcagaagagcttggaggcaacttaaggcgtctggatccactgtctgcgctcctacccactatgctacactgcctctaactatgaggaagcaagggcatttttttttttttctggtgactaaaaagataagagttcaagtatgcggctcctgataatctaacttatttttttctggaaaaattgatagccactatatccagactgtctttttctttttaacagaatctcaagcaatctaccagatactgtcggaggccacccgaaacaactgagccgactaagtccaaaacaaaaaagaggcgtcaatactcccagccgcccacaacaccgagcaagccaaacaaatccacatacgacacaaaaaagaaaaaaacggccccagcaggccacagcaggaggagctcagcagaaccgatccccggaggagagaggaaaatcatagaccctcgacaacccaacacacaacgccagggcgacgggcagccaacagagggaacaacccacccaacagcggcacaacagtcaacccgagaaacagggcacaccccgaaaaaacacaccaccaaagccacaaaaaagcgaggccccggaacagcgcccatgaaaccaccacgcaaaaacccccccaccccacaccacaacccaaacccggcgaaagccgaggaggccaaagccagacccgaagcaacaacaggaagaacccaaaaacacaaccccaaaatagatgcg

SEQ ID NO: 20560 - DNA, 702 bp, Homo sapiens
  misc_feature (1)...(702): n = A,T,C or G
gtagtgaggatagtagggtaactcgcttctattctctanatattctaggattgcgaggtgtagacgtattctactcctggagtcgagccggacacaacgatgcttcctgagtctgaagtcacttctcgtggtgcctctcctccctggcttggtcgtacacccagctagaggaaggaatgcaaagtaaacaccaaggacaaatatttccagaggactgttactgctgtgaggctatgattatgctttaaatagtgtaaactcttcagaaactgcacagtgtacttttattgggaaatgatttggggactcttttatatactttagctggaaattcccccaggtgggggaggtatcttccaaactgcattaaggtggcttgcaatggaaggttccagagaaatggcattacatactgttttgcttgataaaaaatcttttgctacaaccaaacgtatacagggactgtgggagacatggtagtacatttctatttttctgggcgtgagctaaaaggaatggcctagcctctccctttaacttagtattcacattcacttaacccttttaattgctcattaaagggcccagcccctggtgtctcttgtattgctaaaaacacaccgttttaaaggaatacggacatttggttcacctgctggagtgatcctttaccagaataagaattagaagtaacttatgcgc

SEQ ID NO: 20561 - DNA, 996 bp, Homo sapiens
  misc_feature (1)...(996): n = A,T,C or G
acaaaccccccccacatagaaaaaaccccccttaaggggaacgtgnaacggaccttaacatgtgtccctatctgtgtatctgcccttctccttgggatacttggaataaagaaagtgatcattgtctacgttgaaagcatctgccgtgcagaaacgttatccatgtccggaaagcattctgtctcatctctcaaattacttcattgatccagtggacggctctaatagacaagtctcccaaatcggcgcaccttgggccaattgtttgacaaatggcaactgacttccctagaattgtgaagctaacactaatcctgaactaatatagggggggaacaacaccctcactcgtctcttcgtcaaggcatcctgaccctccctgacaaccatcggctgcgcaccgaataaatcatcgattacaccactccttgcacacaccggacgctaccttccacacaaccacccctgactaaccgaaactctcccgccggctacagcccctagaccacgagacgttccttacgtcaatcccacatccgcaccaccacctcgcacaaactatgcttcacctcctctctcccaccaccaagccaccgcttcgattcctgctcccccttccccaacgctaaatagaaaccgctaagcggatcccgcacccatgcaccatcctcctgacgtccgaccagcgctgcactcctcctccccataccccagcgatctcgtgcagaaaatgtctccagtgatcctactcgcaccgtcccccacgccaccctcctcattatatagactatcacctgcccactatctctcatgcccgcctactccgcactcccctccactactacattcaccgcgtcgacgttatttcacgcaagagtactagatctatctcgtcagttatcacctcgcccttgtctcgctgtttctctctccctcgcccccctgtctcacgtccgtctcccttcgactttcctcaccactgcatatcctgttgct

SEQ ID NO: 20562 - DNA, 886 bp, Homo sapiens
  misc_feature (1)...(886): n = A,T,C or G
ccgggttggggtngcgtcgcgcggactccgggngcactaagggactcgcggtgtaaagacgatggggtctgctgggagcttgcggtagcttagatgcggtgggaacgcgttggcgtgggcggtggggtgggaggcggggagggcgggggcggtggtgtggcggcgggggtgtggggcctgggcggtgcgggggccggggcggtggggggggcggtggggcgggggggggggtggttcggggcgcgtcattacctggtgggctcgcacggggggacagtggggacgggtctggccgagggggagcggataatgtcggcggggcgggttgcgtaaagccctgggcgaggtgcgtgggtgggtgggagggcgggggggagggggggcgggagtgggggggggggcggggtgggggggttcggggtgggggagcggggggggggcgtgggggctggagcgggggcggcgggggttgtggctgcgggcgggggggggtggggggcgcgcgggggccgcggcggggggggccggactcgctcgccgggctcgngtttagttgggtttctgcgtgggctttgggatggactgcttcgtgtcgcgcncccttctaaaaaaacccggctctcccctcccttccgtccaatctcctcctctctctncccccttttctttnaccttttattcttctttcttttgtgtcttccttnccctttttctttacctcctcctctttcctccttacccgcttctttctccccttcctttttttttcattctttttctnctctctcccttcctccctnggttctccctctacttttttctttgtttccctaaattttctttctcttctttctccttcctcttttttctcttttttnctcctctt

SEQ ID NO: 20563 - DNA, 114 bp, Homo sapiens
caggtactccagtaattaaaggtgatgaggaagaagacaactaatgccacgctttccactgtgtgttatatgtatttaaatgtcataacaacaatagataaattttatataaaa

SEQ ID NO: 20564 - DNA, 772 bp, Homo sapiens
ctagtgaggaacgctgaaggcactcccctgaggaacgggccctcaccaaacactgagcctaccatgcctttatcttggacttcccagcctccatgaacgccatacaagacgttaacaaaagaggaagctgggtaaagtgtattcatgaattctgcactattttgcaactcttagaaatttggactgggctgtgtgcttctcctataccattctccagctacttctgtttgaagaggaagggaatggaggtcttgaaaggtggaagagtcatgctgaaatgttagctgcatatcagacccagaaaatacagcaagttttttggctgggcgcagcggctcaggaggagggcgcccgggaaatacctgctgcgtgaatgaataaatgaatgaaatgcttgggccctgggaaatgcttgggcccacggccgcctgaccacgcgggctggaggatcggacgtaccgccggtgccccaccatgaaacgaaggcatggctgggatgcgcaacccttcccacgaggcccatagcgccccaaggccctagggattgaccgggacccccgactggcagaagccacctgcttgatacactaatttggataagggaggcctgggactatcttactccttttaggaaaacccaactgtagccgctattccttttgttcaggccctaaggaataaattgtacgtaccataaattcataacccctttttatatacaaggtccctttcatgaggaagaattggaaagctcctacaaaggtagcagacc

SEQ ID NO: 20565 - DNA, 485 bp, Homo sapiens
  misc_feature (1)...(485): n = A,T,C or G
tgtcaagatatgccataatactgagaatggaggagtctnaggccctggtccatcaactgacagcatgaacttcacgtcaagaagtgagattggtgaataagcgaagacagaaggaaaattggagatacagctggatgtatgaaccctgctctaaaaacactctttaacggctggagtgcaatggcgcaatgttggctcactgcaacctctgcctcctgggttcaaatgattctcctgcctcagcgtcccgcanagctgggattacaggcacgtgccgccacacccggctaatttttgtatttttactagagacagggtttcaccatgttggccaggctggtctcaaactcctgacctcaagtggtctacccaccttggcctcccaaagttctgggattacaggtgtaagacactgagcctggcccatctggctgttcatttcaatctattataatatcctttataataaaccaagatgcggcggc

SEQ ID NO: 20566 - DNA, 362 bp, Homo sapiens
  misc_feature (1)...(362): n = A,T,C or G
gcatngcanannataagaaagggtncantnagggtnctantatgtnttgataggataatnganantaaaatnncaaaanntncgananaanatttttnantagatngaacnatacaagntnataggngnntncgtataggagnanggacananatangcannattctatnaatatatnanancnntcacngtataancnatntaagngnntaganattctanangtntangtnnattgaatanaattacnanataagangaatgggncataacanatnttgggcgncaagtaatnancatnnngatgcccaggagaananaatgntnnacanggcnnnaantnttatnnagcaannatanna

SEQ ID NO: 20567 - DNA, 1694 bp, Homo sapiens
  misc_feature (1)...(1694): n = A,T,C or G
ggtaaccccgagtccaccccgatattatccactccctactattatctcagatttcctccctctcttattttatgctactctccgntcaccctctctccctctttgcacccctcttgtatctgcgcgctcgtttagatacctaaccatctaacaaagctcacattagtcagcagtatcttgcttgcacgattgtctcccattacttcacgtcaggtagggtgcacggcgtgtaaagcgtttctctgctgtgtctctctcgtgctgcccacccgtcccgcaaatgtgaatcacantgcattcataagttgcatgccgcnagctctgtcgttaacattatgtatgatgaagtgccatccgttcggtgcacactatgcatcgcgcttgtagtgatgatgaggcagtcccagccccggcacatcactcatatagcttcatgacatgatcgacagtataataatatataatgaatcgcatggattactctcgctcgagcgcgcagacgtccatcagacacatccaatctcgctgcgtaatgatagtgcgtatcatggcatacgtagatatgtatgagagttgtatgtacgaggcatagtagtgcgantacgcttgtattgagttctatcatttatnttcgatagactctgctctgagcacgcgagacgataaatcggtaccgtaagcgtcgcggtagctcagcaccgcactattgtatagatgtgccagatctcacgcggccacacatccnttgagctctcactgatctcgacatggangtagtatgtancatccngcacaggctactaggtgcggcgagtatcgacctcgcgcaggctcgactaacgacgcgagtnagcggagagacgtacagactctacggtctgcacgcctagtnagatagcgagtgttcgcatgatgnagtgacatgatgcatatcgtataataattgacgctacagccatcttatnctgtctagttattattcggacgtgatgaagacgtattcgatagtatgctatatgtcaagatgcgctatccatcgcgtancatntcacancgcgacacgcgcncnatgtgactgacgcntagatagacgtgnagatgtagcagagcgacatgtgatgtgtgtacatgatagcgantcccgatgtcaganatagatcagctatgngatcacgtatgtgtgcgcggtcgtgagtaatgnacctanctncgcagatcatcgagcgcngtacncnacgtcgtangtacattatcatagacatngtatgatcacttcgatcacgagcatacatcgnacatagtaatgcatgcttcantganatggtagcactatntctatgcttatctcgtccgnantagatacgctgtcactctgtctaacgntatcntcntgagcgcgatgtctgtctagcgacgacgccgagtntgtatctgcatatgatntgacgtgncgncgagcngagcagcatgggtncgctgcacgtcagtctantgctcagcgtagatccgtgggacagagtgacanacagcacgcntnnattatactgacagcanctcgtacgcagatatacgtcagtgtgtnatagncgtctgattctgcgcgcgtgacgcgtgatattcatctgatccgacgncncgtcatagagcacacacgacatgtatactagcgataccagacagagangccgagagcg

SEQ ID NO: 20568 - DNA, 593 bp, Homo sapiens
  misc_feature (1)...(593): n = A,T,C or G
aaanaccngggancggntnttttnccnccctngttttttttttggatanacatttntttaannaatggggncccntgnagcaannaacaacccatgttnntgaaaaaangccccgnaaccnagccttaggtntgaatagattggcataanaaagggcttcacaagggagggaaattganggtcccccagcnagcagcnagcaagccagnagccagcntcaacttaccagccnagtnagtgaattnaagcnttcaaaatgattcntacccactcagcnttttgatccacttcagctgttgcaaatgtagcgctaagacaagttatccccactaaatcctgcccaaattacagattaatgagcaaaacaaatttgtcttgtttgaagttactaagcatcagaacaattcttttttatactaaaggtaactgttactgagaaacaggtctcaggtgcctgacattactcacacaaaatgatataaatttattttgagatcatcaaaaatgactctaattttgcttcgttgttaacttggaattatctatgacctctttaactccatgccttctgcccagtaaattgcaaataaatg

SEQ ID NO: 20569 - DNA, 565 bp, Homo sapiens
  misc_feature (1)...(565): n = A,T,C or G
cgggcccccccntgaggtggcgggnatcgaanaggttnaaagggcccaaaggggcctttcccaagtnaaattggtaaccgcangcaggngnttnttgacacnacaggtttngaacttaaagngnaggactttttttattaacccnccggctacagnagggtggggtgttgttnagaaagagtcggggaacccgaggattaaaaaaatatntaagagatgtctcaaaccagttacanactgnccttattcggatcctgattaaaccaaactacagcccttcagattcttggcttagatgtcagttcctcaggagaagactttcctgaactctcaatctatattagaaaacagcaacaataaaaacgactagaggaaaagccacagaaatgattctttgtctgccaagatgaaagaagtctcaactataaccaaaacctcagtcatatgctttctagactattaataaaaagctttcagagtcagaagaacaattctaagaattacccaacagatcttaaattagtatcacaaaatgagtttcccccttatcaaataattcttttaa

SEQ ID NO: 20570 - DNA, 1621 bp, Homo sapiens
  misc_feature (1)...(1621): n = A,T,C or G
cacctcactatcancacacgaacgtcttcctgtatgtctcgcacgctatcgcgtggngatngctgccgctctatcggcgcgtctntccncacttcggtctcttccttctcttgatgtgtntattacatatgctcgctgacaccctatcttcatgtatatcgtaagataagaatatatctatatacagtangtctcatangatcgctagatcatcatatccgaggcagcgacgtctacacatacagcggcgtgtagccagtatggcantgagcacaggctgtgcgggatgagacgactctctcacgtgactgctcagcacttgacgtcgatcgctgtgtgnggtctctcgtcgccggcgacgcgctgcgcatcgggtcggcgcgtagactctagcgaantnagactatcgtaagagcaacaantatgttcatatacgaggacacacatagacgtttattaagtttatatactctctatttattcttcccgccgtcctctctcntcctctcttcncgtccctcctctcctctctccatcccctctcttgagtcctctagcgctgtgcgacgcgcgtcgtgttgagatatgagacgtaaggagtaggaaagtgtagactggagtgaggcgacgtgagagagcgctgcgcgtagctgtgaggatgagtgagagatagatngtattcgaataggatacagtcgagcgagcaggagcaggatgccgcgacgacagcgacagaggcgtgcgaggncgctcgggcagcggaagacgcananatgagacgagtgtaactagtcggagccgcgtgcgtacgtacgatgatgtacgctactactcgtcgtccaattncntcgcncntcatcattagagcatcttcctatgcactttgacagctgtcattacgtcgcgcaccnacnacgcatcaacgagtcatgcgntacgtgtccatgctcgacgcgacgcgctacgcgcgtcggtgtntagcgagatcgagatngagccgcgcgcacatcgcgcgctccacgtatcgaatcagcacatcactatcacgtagacggtctcgacactatcatgcgtacgtgacgatcacgcgttgagcgcacgaggcacgatgcggatgtgagtatagcgagtaatgagtacagcgactgttgagatnataatccacattatatacgcattgcggttgttctcaactctgtagtcacgggcngtcggtcgtgtgcgcatactactggcgtcgcgaccacgatcgcgtcctcggcagcactgcggtactcantagtgcatcgtctatccgctggcancaactgcctgccgcgtacttagacgtacggagatgataacagcggancgtgcgcatgtacgactgactatgaacgagctangancagtcatactacactacgtacatgagttgcgtntcgtgtgcaggggcnttgtgtcgagacggtagcatacagcggcttaccggtcacatcttcacgtgctccgctgctgtgctatgtagttctcatgagtaggttctgcgtcatcgacgcaatgtgtcgtaatcgatccgtgctgattgtatatangntgtgcgacggtcgccgtcgtgtatatctatatatgncgtgttncg

SEQ ID NO: 20571 - DNA, 584 bp, Homo sapiens
  misc_feature (1)...(584): n = A,T,C or G
gtcctggattnntgctttatggccctcaagtcgaattctttcttctgaggaggcaaggactgaagttgcttctgaccagacagtttncctgactcttanagccgtggagcagtgtgtgtcatgtgctgcacacccaggctggaacagcctgtctccaggagaaaacgaatacagcagggatgacttccaccagctccactttgcagctntgaggtgtattaaaaatgacctggaagaagtcatgccacgggccagaccttaacattcctttcggcttaccccaggatttcanacgaagcttcactttcctaaccagtcacaaatcagagaatttttgattccacctatgacctgtgagctcctgcttcaagatattccaccttttttaggccaaaccaatgtataacctccaagtgtcgatttacactttcgactgtaacttctgctttcctgagatttacccctgcctttaaaaacccttgcttgtaatccctcagggaggccgtgtatttattaatcatgagcatgcccaattctccttgcttggtgccctgcaaataaacaccgatgcgggccgccaccgc

SEQ ID NO: 20572 - DNA, 566 bp, Homo sapiens
  misc_feature (1)...(566): n = A,T,C or G
acaggaagagaattggaaatgctggagaagctctggaagcccacagagaacagatgcataaacaccatttaccagacacagctcagcaaaccctctctctcttccttccagcagcttggttgtcctcaaggagttcctaaatttcatacttctgagggttatatgggatggtgaggggtggaggagagtagcacggattgaaaaatacattaatgttggctgggcacagtggctcacacctgtaatcccagcgctttgggaggccgaggctggtagatcacctgaggtcaggagtttgagaccagcctggccaacatggcgaaaccccatctctactaaaaatacaaaatttagctgggtgtgatggcacatgcttgtaatcccagctactcaggaggctgaggcaggagaatcgcttgaacccaggaagcggaggttgcagtgagctgagattgcagcattgcactccagcctgggcaacaagagagatgctccatcttaaaaaaaaaaagaaaaatacattaaagtgtaccaaaataaataaaagagatngnggtcactnnnnc

SEQ ID NO: 20573 - DNA, 734 bp, Homo sapiens
cgaatggatagtaatttgtttgcatggggtagtatagagaagagatattaggttcacgacgatctgggagagggtgggatcagttaacattgttttgcgtgcacctcaggcttcctggctatgtgggactaaatagtaccggcattgtgggcctgtgcatactggaacttgcaacgggaccaacacgtgtaattgaagagtcagtgggaaatctagtctcttgaacaaacaacgtagaatttggaatataacggacggcctatgtgtaatatagagatagggcggcggggggtattgaatcataagttattagactgggtttgacagtaagttgaataatataactccgtctacgggaatggagttatagtaggtaaacaaaaaatagtaaggcaaagataacatcttgctcaaaaaaaaaacggggaaggttttgttcgtccagttccactggagaggtcggttcaaaacaaaagtatcaaaaatatcagaagaaagaaaagaaaaaaaaaaaaaagagtaaatcaaaaaaaggggaacatctcaaaaaggaaaaaaagaagagaaaaaagggaaagcatttttttacacctaatagttttgaattctccagaaagtaactgagactttggcttaagccgttaaatttaaaaatttgtttttaaaacgtgtgtgcccttccttggaatttgctatagattatgctttgcaataaatcacagccttttccttat

SEQ ID NO: 20574 - DNA, 149 bp, Homo sapiens
  misc_feature (1)...(149): n = A,T,C or G
ccanaagggncagttctcccnaaaagaganttnangaaanccccntggaaatacnttgggggttccccttnggngtncagggannaacnaaactttggaccaattncctatngtntttcaaaatgaagggggggaanntttgccngata

SEQ ID NO: 20575 - DNA, 817 bp, Homo sapiens
  misc_feature (1)...(817): n = A,T,C or G
gtctacaaatgtaaaacaaggccaggtgcgggggatcacgcctgatcttccagcactactgggaggcacgaggtgggccaatcatgagatcaggagatggagaccatgctggccaacatggcgaaacctcatgctctactgaaaatacaaaaatcagctgggcatggtggtgcactcctgtaatcccgctacttccgaggctgaggcaggagaatggcttgaacccaggaggtggaggttgcagtgagctgagatcgcgccactgcactccagcctgggagccagagtgagactccaaaacaaaaaacaaataaagttacaccagagtcttcatgaaagatctaggctctgttaatgatcctgcttaccatgctgacgcaggacgtcctttttctactcctgcacattcaggtttagaacatgtatgaatggtgctgactagcagcacatattatgttgcgcatgaagttcaggtgctgcataactagnagtccatcctaatgactggaccggctgacctgtccttcaactgtccagcaaacgagtctaactgactagcgattaactgtttgacctaaagcaattgtatatctcttgagaaaacatgttttctgccgcgttaaccatgaataaaaccaaatacaggccgcatcctggaggatctcctgaggcgcttgcctttagagagggtaaataatgaccctcgctaactagatcggtggactcccgcctgcagtttaagcaaccggtctacttacctcaaagctgaataacggttattcacataataccgtgtacttaaggaaaaactgtcagc

SEQ ID NO: 20576 - DNA, 388 bp, Homo sapiens
  misc_feature (1)...(388): n = A,T,C or G
cnganccgnggnggngcccnnatttacngttgnggcacnntacccaaggggggtgngaaaaananncttccanatanntcntatatgancttggaanaaaattntgcncnaaaaaaaaattcncacngacctgnaggggcnnaaaggntntanggtgnngncnacacnatccccnnnggtnatatattccacccacgacatatanttntnttcggaaagggtctattagagagnccnagngncanaaaattngngccttttnaaaagnccngggnaaggagntgagaaggntttgacaantagaagctanaagatacagngnccannttngcancntccaagccnttgggaagccaagacgtgaggactcccnngaaaanaanaaaaa

SEQ ID NO: 20577 - DNA, 758 bp, Homo sapiens
tagctgctggaatgagaagacaagaacaagctgcatagccactggcaaaggagagcactgtgatctcatgcagagacttcaacgctgacgagccagtggcagcctcacgactaaagactgccatagacaaagcacccgattcacgtaaagcttacagctctccatgacagattaccttactccagcgtggttactcgaaatggcttgaaacacattgtgccagcagctagaggatagtgacggaaatattgcctatgatgatgaaagttctgatgagcaccccacatgcctcccaacagaagccacagatgctggcagtgagaaatatcatgactctcttgagcctacaaaacatcataagttcgattacgttctatatccaagaaaagaccatattttgtatacaagtgataagactttagatcatagtatgtattccccgtccgacaagaaaaaaacttaatactgccgatcgtactttgcatgttagcagaatgcctgatactcggaacatagttgtgtcatctgtcctacacattcacagctgagagatcgcccgacaataaaccaggatgccggccgttccctgtagggaggttactcatgaaccatgctagtgactaggtcactcagaggatggatggagaagcgcatacatcgcccaagccgtaatctggccccccgaagggggaaacgcggaataactgtgagcagagccacaaaggccataacctacaggcctcttcttgcgcttccaa

SEQ ID NO: 20578 - DNA, 1209 bp, Homo sapiens
  misc_feature (1)...(1209): n = A,T,C or G
aactcggaacactaacatcggagtgatgatgcgggtgggatatngcgacannnnnngnactatttttttgttgcatcagcaggnctcgaatttatctatcttaatatctcgcctacagcgcgagatgcacgtagactctactcgaacactacacnacgtacgtctgaatctatactgacgtgagaggatggacgtgctaattcaatctacacacacgcgggataagcaggaacatcgttactcctttggtcaataaacacagctgtgggtagagccatacagcagagagaatatgcgtcgccactctcaaataactcncgggagtggtaatcagactacccacacagattacactaagactgtaggtcctcaaatcgtcggataatacaacatgacgaacacgcggcgggtgtcccgttctagtagataggttcaatatcatgtagtcccctcatcatntgactacttgtgcagctcgggatagcgcatggattggaggtgagcggatatatattttacataaagaggcttgtggtcctgggaatctcacttggaataaacgggatcggcctctggaanggcttgggaacatgctcggttatttcgatggtacaacaagcatccacccagggtggcgatagacctcgcgagggtgcgcaccgcagtgatgatggttacacagaagtgtacacaatagaaatgcgggcggagggttactacaaatacaggggcggtgacaaacagggaatagaaagaaaaggtgaatatgagtgggtgtgggggacgggacccgggggtgtgaaaatggccatacacacaacgtagacgtggtggcagaggtggcgttcgattacgggagacagaaatgtggtggtgtntggaacaaatgggaaaacacggaaatgnaggcggggaaacaaagggaactggacagcggcggggtggagaactaatgggcgaggtcnataacngtgggaacaacagttcgtgcaggacaagctagaatccagtagaaatatcgtgacgggggatatagaataatgggcgatggacaaatgtgaatgggagagtaaacataaactgatcagaaacatggtgtggggtagaggaagggcggacagagaaaggatggataatatagcacattgtaatggagggattgagcgcgagagggatngcagtggcgcacataccaaacaagatacatgg

SEQ ID NO: 20579 - DNA, 1717 bp, Homo sapiens
  misc_feature (1)...(1717): n = A,T,C or G
cacgctccagcaccacgccaccgcgcgcagcgaattattaccgacaaaacccaaaaaaagaaaccacnngcttgataaaggnnaactncgncccccnagaaanncctcccanggagcgngaaaaacacnnaggccccccccggaggggacccaaggacacaaggagncagcaccactctttggcgcaggccgcagggcggaaagactctttgtttcagaagaaagacgaggaagccacaggcagaccggccaaggagaggaggagacaagggcaactcaacgaagacgaaggcacggngacgccgcgccgatagagcagagaagaagcgcgccgacagcagcggagacgccgcgccgcacgcacgacacgcacaccgcgtacggcagcaccgctgcagagcacgtcgcgcagcacgaggccgncggaggagcgaggaagtactacagagcgagtatatgaggnaagncgcgctcttttcttgtctctttgatgagaaagganagacgtgtagaanagagaaacgcacacaacgccgcgcgacgcagaaggaacagtcttctatcgatgcacaagacgaacagagcagaagagcagggcgacggacgagaggcgcgacagcgacgcagggcgangagacggacgacgcaccgcgagtcgcgagccgtaggcggatgacgacacgcgcggacaaatgagcaagaggaagagaaaggagaaagagcgggacgcggaagagaagtgcacggaggaacgtcaccgcggagacgacagacagcaagagcagaagacacgaagcgcgatggagcagnanatagagatccgcacgtacacaacgcgagagcgagccacagagggacgcggaccggagcaagggnacgcagagcgcgtgatagacagccggcgcnatatgaaccncacactagcgagaggaagtggacagagatgacgggcgcggagagagacgccgagtgcaccgacacgaggcggagacgcgagcgcgcacgagtcgcgagaagatgagcacagaaacgacacgaacgcagaaggatggacgcggacggaagcgagccagcaggcggcgcgcggctcgcatgtgatctcgtacgcaggaaggangcagcggctggacgcgccgctcgacnacnatagcggcccggcntcgtgctgcgccngctggcgcctgcgtcgcgtgaaggatagaacacaccgcgcgtcacacgagcacgcacgaacgagcagcactcgnaggagagtcactcggacgcgagcagcgctantggatgaacgcgngagtcncgatagatgagtcacgtgcagccgcgcgaagcgtgagtcagcacgnacgagcgagncngacagcgccncgcatcnaccgctcgacagacagcnagccacagagnaggatgatagnggctagagtagacgactttcaggctcggcagancncganangacgtgagtggatataggtcacgtgagacggtggggagagatgcgcgggngagcaggncgngagagagatagtagcagtangncatgcagcgatagatgtgacgacgcagcgatagaggatgngaccgacgcagagagacgagtgcgcgccngccagtactgcacaagcgatgacgcgtagacgcatgcggtgcaacagccgaacacgcgcagngcacagccgtgcggcngccagcacacgacgactcgnagcgagtacgacag

SEQ ID NO: 20580 - DNA, 604 bp, Homo sapiens
  misc_feature (1)...(604): n = A,T,C or G
aggaangctnccctgtaaagaatgcnaaggcnctnncnaagcntgcanaagccnntggcaaangcnagcatggattcccntccattgacttcnagtattnnaagagcccagtggaagcccncangattannnactcgccatgaaaccnaagctncnggnttccaagtaatnnntcaagcttttccagnnnggcatgacctaacnccagtgtggtttctcgaaatngcttgaaacaaaatgtaaancagttnagganagtgatggaantantgcctccngatgangaaagttttgatgagcagcccacacgcctttcggcagaagccaaanangctggntgtnagaaaaatcaggtctntcttggnanttcaanccattcnnnnantananaangncnntnatccaaaagtaaangcattttttttanaaaagngatcaagnttttagaacncggatctttcttccaagtcngngngagaanaaanttatccncacngatnnacnttgcattttgcagaangtcgcagatntcagaagntagngatgtcatntgncnggcacantgcacnnctgacancttccccgacaataaacaggatcggcg

SEQ ID NO: 20581 - DNA, 2135 bp, Homo sapiens
  misc_feature (1)...(2135): n = A,T,C or G
cttgggagactggaggcgcaacngtggnaacgcggatntnctccctctactcagnaggggaagtgaggnnncgtggnggcggtgcgcctggtatatacgtgttagttatatatctcnntctgctctgctacntcgcaccgtncagacacaccnccacactttnacccctagcnctcncngntntatctccagcagctcgcacacgatagaacaccacaagcgncgcgcacacgccacacagcctcgctctgtcccctccgacgcacgccacgcgcgcgcgcttctctccgcacgaggtnnaagngntgtgagatgtaatgtggacagcgatgtannataatactntaatagtacagtgcgtnttnnacgagggcgagtgngtagactgtnattgttatgnnncatatactgctccngcgctagagatgtnagtcgtcccactcgcatgaagtcnccacgcngcggtgacacagtgcncngacaacgtcanccnccnccggactctngngcgcgtcnccgagttggcgctgtcgctgatctctctncatctctctgtncncntcatcactcatcatgtctncactattcntatctgtcgntcgcnctncgtcgcangcgagacgaggcagngagacatcagcttcacctgaagacagtgcgctagagncgcgngnacagtncnctnacgtntgcactggcngatacagtcactacgagacncagcgacgactcatcgtcnangcagatntcnacactactncgactggtactgcgtctntctnnatgtntgtngntctancagnagcgctcacnatacgantgcatatnagtgcgtgtnntcngctgcntgcgtgtgtcggcgntntcncgtcctatgtgtatgtgcacaggatgtgtcanngagtangttgatttacgtatnagttantantaataagcgtcntnctcntttcgctgtntcgtcgtgctgcgcgtnctctatcnctgctncagcactgtgtcgactgnctgcagaggangatcngctgcnancnagtactgttgagactcgtcgccncntcactagcncancgctganagcatacntcncgactcagatacagcntgcgagatgacacagctgcactcagcatantcctactacgtagtagtcatgacatctatggctgcngntacgntacgcancantgcgtagcgtncagtacagatnactagttgtcgngtatcacgnctcgnacagtgcgtcnanctagattcattagtcatcgntnacgagancgntgntnatcagctgcacgatacatnncatacggttctgacgangtacagtgcngtccntgcgcctgctgcatntgacgtgtgtcnnctcgngacctagctgctntcagttagcatgtcngtcactgccattcgtcgnnnncnnntcgangtagtgcanacgtncnnctcagcatcgctnctgtgtcgacnntctcngtgcagctatcactgnccngctgcacgtgctcgtcagtcgagtcgtcnncanctaccnntactgtantgnatcataggactcgactcanctngcatctcncanatttgctacgctcngacgaagtagactgcncnatcacagcagcanctgtcngcgtccacgtnntactgcatgctangcgctcatgcgaagccgngacncgacgaccgatcgtgcnncacgatatgacnatnncnngctancnagttcnccagtactgcgtcgttgacnacnatccngcttctactactactcntagtctgatctctatggnctganncnncatcgcacgtatgaagcatgnnctnaacgataggcagcgnnncagtcgacgaccactccagacgaccntcnacncgtcgctctnactggagncgacgtcgtgacncnncntatagttngcctnctcacntacgatgtactcagtctancgctagtcgncaagtntccncnagctatcagcgacagattncgcgtcngtcgtctctgtcagtngatgagatgctcntntagtttangtatgaatngtatgtctcatcntcacgtgntcctnntntatctncngcatnctcgncgctgctacgnctntgctnatcnactcagtcatcgtactgactcg

SEQ ID NO: 20582 - DNA, 492 bp, Homo sapiens
  misc_feature (1)...(492): n = A,T,C or G
cncacatcagagacagcagttgggacaanctgtagaattggaantggnccaaaangcttggggaaaaaacaaaatatcnttaaatttggatatcagtttannnancagggaccnncgaanccagagcagnttnatnctataacaaaaaacaatnacttagtgcgtaaaanacganttgaangagatcnccagtaagtntncnaaggtgttatntttggaaggcttcagaagatcaccaagggntcnatgttggtgacaatcatgtaaaattttnctgggtanaagggaaaanactggaaaaatttttttagtgacangcatttttttttttagttgntatcaaattgtaaaatcagnaatgtgatattttatattntgaaacatttctactttntgctaaaatcaattttaanttagtttnattgaatgatttatgatgaatcttgggcaaaaaaatacaactgtnaaaaatttcaaaaaaaaaaaaaaaaa

SEQ ID NO: 20583 - DNA, 1337 bp, Homo sapiens
  misc_feature (1)...(1337): n = A,T,C or G
aaaatacccacgccaaaaccacattctttcccatgcagagacaccttgattcccccagctacagattcctctcctcgggcgactcctactagatttgctttctgcgttgttattgtctatataatctaccaatccttgatccgccaagctataccacacaccatttcccctgatttttttgttattttaatgtgctacatataaacacaataagtccactcacgctcatgtcaatgtatatcctttaaaccacttactcctatcacntgttttctacatttattaacgtacacattacttcttatcttatcatctatctttcgtattcgtttttcgttcgtcttcttgcactccattatatatgcgcgaacgtgtcaacctctgcaccgttctaccgctcactccgctccgccctcgtatcatccgcttcacactaccgacatatctctctgttctgttctcgtatgagtccacgcacagaccgacgcggcctctcgcagcatgttcttcctatcctcagtctatgtatgactacatcaacgatttagtctacgctcacctacacacgccggtactactcgtctcccacttttaacatctagtaaaaataaagaggcactccgcccgccacactccactctccacgattatcttccacgtcgcggtaagcacgtaacgcgcgaacacctatgatatcttctcaccaatacataccatcacgcttctcgcaccggcagatcgatactacagctactgcagcgcaattaagtaattttcactctgattatcagctacactcttctgtccagtactcattactacgtatcctaagtaagtaatgtcacttactatagcacatcgttacatcgactacantatatacgaccattactntgcatcatctacattttgtctacaccgccaccgcctccgtcatacctcagtctaatatataatctaacttcngaccatctanactccttatctctactcatactaacgctgccctcacactgcatgttcgcacactctcccactcgagacccgactcctctctcacgtacactcactcgcagctcctccaccacnacacacccgtacgtattatcgcgtgnnnnnncttttgagagntgananntaataatatatatcacactcaccatcatataatgatancatcgtgatgaaccgnagaatatatantcgatctnatactntcactacctatatcgcgcactcatctcgaaatcatcgctctacgcgcgtatgtatatgacctcatcacacanacgancgctatcanttcaccgtacactaancnatcagacacacgcact

SEQ ID NO: 20584 - DNA, 760 bp, Homo sapiens
  misc_feature (1)...(760): n = A,T,C or G
ancananacnatgtcganaaatagatcncnnttagatagntnananatnatagatnnnannnatngattagatatatnagngancnatcngagagaaaagatagttaaancagagatgtaagtttnncncananaatnangngggtanacaanaannnncagtanatccaccagnnantatngtaaanannggcnnaaagancnctttggaggntgagaagananntnatgatngncatattanncaagaggtngtcactaaccaagcaagnggggtacctnntctngccaccnattcctattntnagaancntagctanggaanagccacccnnaanactgtgctggtnaagagcccntgtgttgaanggnnatggtcaaaaananggatttctgaagncaanaactggaagtggagttaggagcttctnacccntcatggnttcaaatacacgancntcttttgccagcgcntctaaaganctgctctcacctctctgcatnccaatagatattccccctatgtgcatgcatcacctgcacacctcacggctgaaatcctccctnacccngggggaccttagcatgcctaagtngcttanccnataaaaacanattcngnnngccaccnnggngagngncgantctaagatcatatnagnnagtgtntaccncctcaaacagngagnaaaaannagatgtaantaagtaganagtcaagtnntggatttaaaaaatananaatangnagttatggata

SEQ ID NO: 20585 - DNA, 1092 bp, Homo sapiens
  misc_feature (1)...(1092): n = A,T,C or G
catcactgtacacagcatcgacacatcancggcagaaacgcagcttggtggggttattcgacagaaatgcgttgcgcggtcgctctccgcatatccatccacaggaacagtaaacaccagcgtcgccacgtgttctggtccgcgtgttccgggacacggtttaggcaatcaatgttatttaccacccgcggccggggtgagtattggcaatttccccacttaatgttgatatcgctccatntcgccgccgcaccacgcgcaccacccccccgacgtgtagaacataggtcgaggcgcaccaacggctagatgcattcaccagcgtgtagtacattatctcattacgaccactgtgaattattgcataacacggttagcagatgacatacagtgatgatgcagcgccaaagcacgatacgactcgccgcatctgatatttcggtgacctacaaccccgtgtggttgtggatatctcagacctatacaaaacaccaccgggctgaattatgcgaatgagacagcctccacgagagtgcgtgttatttgtttgttaagaacacacaccaatccagagagcatagngcgctccgccgtagtgtgagcgctggtgggttggtagacacaactagacgatacgaacaatgggccgaatttctaccctcattcaggttgcggtagccacgaccaccaactgtgtcgccatattagttcgcacccagcgtttagtagtagatactacaaatgtcgtaatataatcccgttaatcgacgcatccgactaataaaatgcgtatcgcaacgcgcgtaatattaatatgcgccgcagtggtctattcagggtgtagctaacgcgccactctgtgtcctgcacttgctaggttttatggcggctcggaggcgttgaggcgataggaagcgaggctncgaggtgttantgtgtgtgtggtggctcgtgtcctcatacccacactcctgtcatgtttatcgccgcgtgtgctttatccatctatctcgatcgctcgctgttgctatatatatcctgactctcatcttcgagcggtgcacgcggatctacgatattccgatattagat

SEQ ID NO: 20586 - DNA, 784 bp, Homo sapiens
gccttgctctgtcaacagatgggaatgcacaggcgcgagctaagcacacaatgtacacctcccaaggttcaaaaataatcaaacctcaactactggggaggctgaggcacaaaaatctcctgcacggggggagggaacaacggtgtggttcgcaccactcgtctgcacccgtatacaacattggcagagggtatctctgctaaaggggcaactaacgcagtgtgaggggctggtcctgtgtggagaatgaaagacaaatggtgcgggtggaaaattcgaaaaaggagctaataaaccctttttaaaaaagaaccgtgttgcactcaggggcaaccctaaaacgtggagcgtcccctgtacgaggggggggaacaaaggtaattcccaaaagtgggggagaacaaggtgtgacacacggcaccaaaaggggggagggcgggattgggggagaaaggccccaagagaatatacggcgcaaagcgatgagaggagggggaacgccatggggttggaaacaggacacccggcaatgtgggctttatatgggtaatgagggagtgcgctaaagagggaggactacggggcgaaacggaggagacagtcgcaactttcctcacggggcgggaaagaaaaagggtgtggcacaagccatgtgccccgcaccttaaggagtgtagactgattgggttcccgcgatgcgcagtaaaagtggggtgaacaaagcggatggcagacggtttggggggggattgggtgcgccgaggtacaccgttatacacacgcg

SEQ ID NO: 20587 - DNA, 1515 bp, Homo sapiens
  misc_feature (1)...(1515): n = A,T,C or G
cgagccaccgccaccgcgcgccccncgccgccgcagcaacagcggaaaggaccccaggaaagagaagcgcccccgncctcgnatcnaagaanggaacngncgccncncnacncgaagcncnctgcnnacngagggagcgcaacaagcganannngncnccgccncgcaagaagagcgagcgagcgagcgaggacggcgacgccggaccnacgcaggctctcacgcngncgagcggcgacggcgcgcacgaganaggaccncgacgcggacgaagaggagcaagangcggacgcacgcgcgcgcacacanagcagagacgagcgcggaacgcaagcgcagggaagagacagccgagggcgagcgcgngcacgagaacgaccgccgcgagacacagaancagacgcgacgaaggaggagcgngcggccaccgcgaagccaaagagaggaagagcacgcgcgacgaacacaccaaggccgcggcgacaagcgcgngaacggcagaagagaagacgcgcgcgcagnacacggnacgcacgccgcccgtccttcctctcgcagcgagacagaccacagagacaaggagaacgagacacgcacgcagacgagaacacaccgatcaacaacagagagcgcagaaaaacagcagagagacgagacagacgaagaaagaanggcngngacggngaaggaagacgacagaccagaggagaacagcagagggaacggcggcgangtaggaacgaggcgcggacacggcgcacagggacgccgagnaacgaagcagaaggggcgcacggggcgacgaggagacgacgggagcgggacgtaggacgcacggaacgtacaggcgcagacgaatagaaggcaaggaggcagaagcgcggcacggacgaggaggaggagagtgaaggaagccgccgagcagcacaggcaaggagccgagaggcacgaacacacacaacggagaaggagagacgcaaacagaaggacgagggcgcgcggcagcacgggagggaagcgaacaggaggagcgagagcgccgtaggggcggacagacaaggaaggagcagcgcaacagcagggacgacgcgcagggaaacgagagagaggcgagagggaaagagcgcgacgagagagagccgaggaggggagaaagaacacacgcaagcagacgggcgcacgggaggagcgagaagaggaggaagcaagagaagggagagagagggagcggcgagcaccagcgggagagcgggacccggacgacgcgagagcgaacgaacgagggcggcaagagggcgtaaaggacggcacgggcagacaggggcagcgaaggcaacgaaacaccacgagcgcgcacaccaacccnaggcacgcagagaggggcaacgggggagacgcagaccgcgagacgaccacgagcagaacacgacccgcgacaaagaagagagcganaagagagagcagcgagagaagacgctagacacggcggcgagccagcgcgcgacacagagagcg

SEQ ID NO: 20588 - DNA, 380 bp, Homo sapiens
aaatggccaatttctttcaaatgctgtatactggaaaaatccaaaggactcatcagatgaacacatttcaaagagccactaccaattttttttcttaagcaaagcatcaagccttgatttgccgctgataaattctctgtgtcagacactgctccaggccaggaacacaagaaggaaagtagacccaaccatggaggagttggctgtctcctgggaggcagatgtgtagacaaggcacactggcattgacgccgcaacagaaaaataagcacttggaacagaaaggagctctacccaactacccggaatgcaggcgggcctgggactatgtgactaccaccctctaagtgaggttttgaaaataaacaaggatgcggcgt

SEQ ID NO: 20589 - DNA, 1107 bp, Homo sapiens
  misc_feature (1)...(1107): n = A,T,C or G
cgctcgctactaagccaaccgcgcagcgacggcgtcgggcatgcgagcggaagcccctacgtgtgggggaaataccannaagaagggcgcctctcgcacgcgcaactcacctccncgaacgcaatcacacacaataagaacagttgtaccnacagacgtaggtggcgcgccgtgtagctagtgaaccaccttatctccacaagtgtccattgaattgcgtcacagtgtggttagtcccacacgcgtcgccgtttattgtttgcattacccactatatgtgtatgacccatcgttaggaggggcaaaaggacacggaaacgcggcgcgtgggcgtagcccaggtgcttgatggagcacctgcggcgtatgtatgttgtttagagtgcgcgtgattacaatgatgacgcgttaaaatcatcaggtcgttactgttagtcgagaagagtagtgacacgcaaggaaagcatgagtaatggaacggcgcacaacccagttatgcacgccgtcgactattattctcaagtgaagggaccgcaactgatggtggtcgttaagtgaaatgagctgtaaaatagcctcgacgaggacgggatagaggagagaagaaataccaccggagggaccagttaagatgagtcacagggatacacaccacagacggagggatggcccaaccggtgtatggcccgagtgtgttggtatccgcccacccggggttaagaggcgaaaaaataaaagatggcgtggggtgcccccccccacacgcaacaccctgagagcggccgcgtggtactggggactaagaaggaggagtacaacagaaccctgaatgggatagaatgtgaagacatcggggggagaatgaaacgggagggaatggtcatacatgggcaaaggctagaaatggtggagaggatgtgataccgcccgagacggagacgcatgaagacacacatgtggtagagatgtggggggcgtgccgccctcgcagtcgtaataaggtatgcgcgcgacgtcggatgggcaggagcacggagtgcggaagtagtgactgtgattcgatatagacgaaagaacaacgccacagatgatcagcgggatttacag

SEQ ID NO: 20590 - DNA, 869 bp, Homo sapiens
atcagagatataagataaggctctgcccacaactccaggctgatgcatctggtgaggaaagaaaggtgtatggcatgttaggctttatctcaggtggcatcagtagtcaaaccagaactttgttgtgtgatgagagaaacaaactcttaggagggacctccttagactagaagatcatcgggagcgcgctcctcctgataggtcataaaacaaccactcgcctgaaatggggctttcgtttcattgatgggtcgacctatacggacacagataaccatcctttcgacctttaaagcggagagggaacatttttggtaaaaaccaaaacccgaagtagttttatgtcgtttccgagccccccaatttttttgtttcttgattgttacaaacacgggtggctacttacgagaggactggtaatgaaatactatgcacgtgcgtcgctatgaggccagcccgggtttaagaaaacaggagataaaagttggggggggagaagagataaaaaaattcgcggtatggttgttaataaaaattgcctctgtcctttaagataaaaagtaggtttttttgttggtgtgggataccaacctgtaacaagcgaccattgcaggcggtcggggatttgtgggctgcggggtggtcgcgctctgtgagaactggcagactttttagacctcctctaatgagaatttttgtctgcgcacgaccaagattgtggtttggggtcgggatagccaacagagagaaaccacggcgccgttcgacttttgtctctgtgcgagacagcaaaatctggagatgttagggatagacaaacggtcggcgcgtatatcggtgtggagaaggagaaaatgatacgcagcccg

SEQ ID NO: 20591 - DNA, 1895 bp, Homo sapiens
  misc_feature (1)...(1895): n = A,T,C or G
aaagaaagagcacgcccgcccaccgacgcccgccgcgatgaacaccaacagagagagcgaacaacaacaaccgcgccngcttgcatggnagcancgaaccnancccgcnccgacgacagcctctcgccacgngagggccgacacacccgagagcagccacaaccggcacggagcgagacaaccagancagacaccaaagacgagcgaaaccctcttcacagacgaaacgcacagaagacagagagaaanacggcgtgcgacagcggaggaggaggagaaagcgggcgaagnaaacgcgncgcggnagcaacggagaagaaagaagcaagacagcaccgaacggagaacgcgccgcgagccggcgaaccgcggcgcgacgcagancgcgcnagcggcggcgaaagagcacgcgcgcgcgnaggaacagcagcacaaggacgacacagagcgcacgacgaggcgcacgacagaagaccggacgccgagcgcagcaacagcgcacacanagcagacgccgcgaccagacgcaaagacagcgccctctcctctctcaccaagaaaagagcgggaggtacagaaagagacacaatcagccaacggcaagacacgtgcacagtccgcacgacacaaacaacagaangcaagaacaagacgacacgaacgcacacagcagcaaggcagaacgacacgccacaacgacgaaacacagcagaccacggagcgaccgccatgagcgaacagcagagcgacagccagagagaggagagagagaagacgacagcgagaagacacgagacatacaagcgcacgccacaagagaataccagcncacgcgaggaggacgcgctcgcggccgctcgcagntaaagacgcgcgcngcgcgacactcgagaatgccgaggcgagcgagcaggacacggcgagaagcgagcacgcaagcaccacactncgcagcgccgcgacgcaccacagcaacaacgaccgaggatgaagagagacgacacgcgagaacgcgangccgacgcagacctggatcgngccgcgcctagcagcgaacgcgacgacgcacgacagcgcgcaccgcgcacgcgacgagcganagaagcaagagnanacgtcactatcaagagaggagacgagcatgtagcgagaaacgaagcagacgccagcgagagggcaagncgcaaccgcgcgagaccgcagacgcgcgacgaggaagcaggatcagagcagcacgacaaggacgacagcagcagcgacngnagagngagcagagacgngccaancanaggnagagagatgcgcganagcgcgagcagagcgcacgcagangcacgacatcgagcagangacagcaggtcagtacagagcaacntaagcaacagagacagcacacatcgagnacgcgaacgcgcacgacgagagcgcgagcagcgggcncagagacngcagcgatagtacagcaacgcagcgacacaccagcngcagacagcagaaagctacncgnacgngacgcacgcgaagagagagcaactacacatacgatagtacgcgtcagtgcacacacggctcgcgcgacgtnangcgacaggnanantangagaacagcgncaacacgacgacagcagacgcngcnagcanacagncgcgagtcagcagcgatcaaagnatgcgacgccgtcaacgcatcacgacgactcacagccgctagacgagacggctgatgnacgagacgacgacgcgagncgagcgaaangacgcgccccgcccggtcaagnatagatggcgagcacgacgagctgagacagatgtacagtagcagagacgacgcacagctgatcatcagcgcagcacgngagcagcagcgcacgacatcgcnatcngagaganagcag

SEQ ID NO: 20592 - DNA, 763 bp, Homo sapiens
  misc_feature (1)...(763): n = A,T,C or G
angattttccaaaatttgnccntgcccagtgtttancanaggggacttnaaaggtccagntganaaaaaaggaatgattggnagaataagcccaaaagcccatgnnggntgaaagnttntcccaaaaaaaaggggttttntttttggcccccccngccnagtgaaaaaaaaattccccaaaattggggncncccntttnccctttcccnggttgcccttccaagccccaaaaccntnaagacccggcttgggnaaaaaggggaggaaaaanttncccttaaaggccttntttttccaaacnagggggttttgggttggcattncaagccnagggngnggtccnnattcatttccnatttttaagnaaggtttngaaaaaaaangtcccgggatggtggnttcacnccntgaaatcccagcnctttgggaggccgaggcaggaagatcattgagctcaggagtttgaaaccagtctggacaacatagggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaaagtaacataaggaaaaaagaagccttgntttagcacaggtatgaagccagaagccagcatctcaactgtgcttgtcttatgcagaaancg

SEQ ID NO: 20593 - DNA, 169 bp, Homo sapiens
  misc_feature (1)...(169): n = A,T,C or G
ttttntatggnnaangggggganttttttttnttttcccgggggnntttnnnntanggggggggnnnntttnttaaattttggggngtngcnaaannnnnaatntntttcggggnnnnaancttttnnggntnnanntngnntnnaanccccccnggntanncccttnt

SEQ ID NO: 20594 - DNA, 485 bp, Homo sapiens
  misc_feature (1)...(485): n = A,T,C or G
cnnttaataaccccgntacaggaggttccaacaaaaagtcactactatgatttggtggtaacatattcatcgacatgtcatttgactgccatggatactgtggagcaaggacacctggagaaaaaaagaagcatagataagaacagctctatctggtctcattctgtcacccaggcttgagtgcagtggcacgaatacatcactgaagccctgacctaggctcaagcaatcctcctgcctcagcctcctgagtaactgggttacagatattccaaccttgccatctctggaaaaccctgatctgtttgaaaacactcttcggcttaacattacctggcaatcttcctgctgcaagtgcatctcctggtaaatggccattcacgccattagtggaangattgttcatctgacccantaacccactttttatctntaaatcagtttgggtagggtctcccggggtcccctaaaacaataaagactga

SEQ ID NO: 20595 - DNA, 131 bp, Homo sapiens
  misc_feature (1)...(131): n = A,T,C or G
aaaattcaangggggnngggggcccaaagnaaaaannnaannanggncnnttttttaannttnngnccanaaannnnnnnnnnnnnnnnnnnnnnnnnnnnnnnnnanannntttnaaaaaaaaaaaaaaa

SEQ ID NO: 20596 - DNA, 615 bp, Homo sapiens
  misc_feature (1)...(615): n = A,T,C or G
tttntaaatntttggccaaanangggcccnntttccccagnttaaaantggttnaaacncanntcaaggngttttttnaancaaacaaattttttgaaantttaangnnccaggggtttttttaaantaacccccggtacagggttaagtgantacaacaaacccntttgnggcagtagttttaacaatggcntnccaannttcaaaaaggattttaaaggactgtggcacatanaaatgtattttgnttaagctgtacaacaggatggcacaaaatcctgctgatagaaataagtgtgaccggccaggcacagtggctcatgcctgtaatcccagcattttgggaggcccaggtgggtggatcatctgaggtcaggagttcgagaccagcctgaccaacatggaaaaaaccccatctctactaaaaatacaaaattagccgggtgtggtggcacatgcctgtaatcccagctactcaggaaggctgaggcaggagaactgcttgaacctgggaggtggaggttgtggtgagccgagatccagcctgggcaacaagagtgaaactccgtctcaaaaataaataaataaataaaaaccgatgcgaaatgtntcnaa

SEQ ID NO: 20597 - DNA, 523 bp, Homo sapiens
  misc_feature (1)...(523): n = A,T,C or G
gtcccagaccgngntttnattngctnntancncnccattncccccnccnctccgntaactangccggggtctcntncaanancttgccngaccacaggcaggtacagacataaatnatccgtantaagcnttcncctggagaggccagatganagattatgctgagtcaagcagctnaaatgcantatataanatttntgcntgtgtggggtcattgcacctgtgcccctcagtganccattcaatcaagaacannctttctgttataagatgaaaaagtcctggagatcttatgtncattaaggtgactgtagttaatagtaaagcattgtatacttaaaagttgcttaaagagtagatcttaattgttctcactatagaataaaaggtccctatgaagtnatanananattagcttgttacattttataatccatgcatatatcaaaatatcacggtgtgtnccttaaatgtatncaattttcatttgtcanntatacctgaatnatacctaagngcctnc

SEQ ID NO: 20598 - DNA, 890 bp, Homo sapiens
  misc_feature (1)...(890): n = A,T,C or G
ggnggnanngngcgaannncncaangcnnattnncgcntcgncnnattngannntcgnnntantancnccccccantggnangtggagatnnccnnacaggnccnnagagnnnacctnngccatacanatttgccantcgncaaaaaggnnncgaagnnancntgtagcattccgngccaaagggntncnnntgtcgattcnggttngcangaaacnnggnnccnccctccngcgcantnntggnncgnggntccccngcccatncccacccttngcaggtntncccaaaatncntatggnncaccgctgggccctttcccgcccnttgcnggnangctgggccnagngcccnntcccccacagattaaaagcacgtggtnttccaanatcntctttcnttnnntgtggttctcacttcntcaaggtcagcaaaaagtgtcaatgatcnccccaaaaatcaggttaanaccaannatgatgccatgaagaagnacnagaggtcataaataantctagcagcaaacaggggttcctggaaaagagaggtgtctggatcagtgtgggtcccttgcgaccctttggtctgcggagcgtggggcacagctcaagtgagacctcatctacttgggtagaaattaaattgggcattcaacttttaaactgaaaactgcatctcttttcatgtcccctgtctcaattgcgacttctccaagtgtggtgtgacacagccaggagggatattcactggnccagctctgtgaanaaaanaagtaacaacagagagaaaacgtgaggagaaaagagagaccgggattttgaaatcctgtttcctgaatgccatctcaccaggcacagaaagaataaatcaggagcggcgtcaaaccnnngc

SEQ ID NO: 20599 - DNA, 960 bp, Homo sapiens
  misc_feature (1)...(960): n = A,T,C or G
aacaaacagaatggcttaaagacaaaggcagtaagataagaaacgcaagcctctgtcccgttctcagaatttaagtcccttttcccgttttctttaggggacttccccaagcaagggttcctatctttgggcggcaccaccccagtattagggagtttaaaaagcgccattagggtctcttcccttttcccaggagaggcccccccaagactatacactcccctctgttcttttttgtctcataatacgcatgccaaggaacctgctctcccgtgggctcgcagtcaattacagttgatgatgttacaggtgtgacccatcagcaaagggcctctccctggtgcgccnaaatatcatttttagacaggcaatgcaataaatgctgaaccatcacccgacattctagttggtagaggagagccctctctcctgcccagctcatgcctaattacctgtaacaatcccactgggcccaatctgtttttcactgcaaatgccttgctactaagactatacaggcatcctccctctaagcccagggactgtcgcatgagagtgtaagggcgagttttgaaggatataattaggtcaaggtcagaccctccaaatcaaggatgggtacaaagatgcctgaacaactggtaaaagaagaaaataattactgacaggaataatgataccttgtgacaaagcctcctgggtataatactcccagttatgagttgtacagaccacatattttaaattttttcagaacgggtatgttttgtatagctaattgccataagtctgtaaccaaaaccaagattacatactaaaactaaaaacaagattgagctatggctcaatgcgtagcatagaagttaaaaataagtcagttttgtaacctcacctttggctttttgtttgttcatcttctacttaaaaaacaaaataaataataaaaagggatcggcccga

SEQ ID NO: 20600 - DNA, 712 bp, Homo sapiens
  misc_feature (1)...(712): n = A,T,C or G
gnnnnnnnnttgaannctttgnaattgaggatccttgncgccngccttntnnncntncccataccntcttncacnttgtncatntgctnggngnacttctngnganccntntctaggtcngannctgnacgcnactnctganagantnngggngacacctncncncatnatcantaatgnctacaacagtggaantatattggagtntggcaggaaaancccaatggccnngtttctcggtatcnatgggantcctaatggnaacttgcttttcctgggnggcagtgaggancaaaanttnactnatgaanncctggagcccaanngcnngtganctannanananntttacctgtcatacanngggatttgtacatttctctgggnnnataaaaaangcatgtcccaatgaaagccggtaaattggctaacnacttcctcgntcantggncnntccttaactgntgaangggctanntcattcagtctntagacttcagnaaatttcttaaaaatataaannnttcncntctgtttgacataaaaaacatganaattttgaaanataccanatggccttaaggncnttncctttggncaatttacccaaatantngtncanaaaccccgnanccttttaacttagnattcanannnaatnncgggcggtttcntnttttgggnggggnaaattaaaggannccnacnnccg

SEQ ID NO: 20601 - DNA, 127 bp, Homo sapiens
  misc_feature (1)...(127): n = A,T,C or G
gagcctgtcagctgtccagcagcaaacactccaccctccaccttccattttcccccactactgcagcacctccaggcctgttgctatagagcctacctgtatgtcaataaacaacgnaaaggcgtcc

SEQ ID NO: 20602 - DNA, 1315 bp, Homo sapiens
  misc_feature (1)...(1315): n = A,T,C or G
agagaagcagaaggccacaaaagaccggacacgggaacagcacaaaaaaaagaccttcttttttaaaaaaaaacaggcgactatagacagaagggacacacacaagcaggacccaggaaacgcaggcaaggaaacccaagcagacaacagccacaccaaccacaaacggccacacgaacgacgaaaatccagatgacgcacgcgacggcggaccacaacacacgcgccacagaacagccagagcaaaacgcgcgcgaacagacgcaccgggcgagacgaccccacgccacgtccaaccagcgacgcacgccacgagcaccacagagatgagcctaacagcacccagccaccgagaccacccacagaaagcccaangcaccgactcttctgacgaggcagcggcccgcaacgccccgcacaacgtagctaactgaaaataccgcggaaacagccaacgcaagacaaaacacacaagaaagcaaagaaacaacagctggccggcacatatgagacggacggagccatagcgcagagcaccaagcacacagaggcggcgacgacggtgccgcagagaacacaccaacaagacaaagaaataacgagagaacggcgcaccacccacacaaaacgccagccgtgcagccaacataggaacaggaaacaacaaacaacacagaaatagcgccacgcccgaagaccaaacaacgagacaaggaaggcgggagccgagccagaagagccggagacacagagggagtgcacaacacgacaagccgccatgagagcgcgacacgccacatcagacnagtagacgcgacgccactggacagagaccgcggagtgggatccgctcgacccncatcacgagccacagccagacgaagcgtcacgcgccgccggcgcgcgcgaacgaggcagcgcggcgcgacacgacagcacacaccacagcgcacgcacacgacgcagacccagactcagacagcgcagagccgacggtcgacgaaacgaagaagatagactacacgcggcacaaagtcatganagcgacccnctggcaggagacagcaggagcagcacagcgaagagagacgacccacagagcgtaatacgaganacgcacagagtgaacatacaccnacaacacacacgaccagcgcagagcacacgctgcgcagcgacgcagtcacgccgacccaacacaccgatatccatcagtcgacagacagcgacgcgatccgcgaaccaacaatactagccagcagacgacgcccngcgctgacacgacacaagacgacatggagcagaagcgcagagg

SEQ ID NO: 20603 - DNA, 596 bp, Homo sapiens
  misc_feature (1)...(596): n = A,T,C or G
gaaacccntaaaangggaaggcccccccgaattttaagaaggcnttngaacnggggaaaaagccgggcgaaaccggttgggccgaagaaaaagggaaagggaaangaaangcgaaaanggaanccggggncgnttaaggggcggcttggncaaangttgtaagcggggttcaacggnttggcggnggtaaacccaaccaaacaaccccggcccgggggnttttaaantggcggccccggtttaacaaggggngggnggtccccccaattttccgccccaattncaagggtttggcggcaaaacttgtttggggaaaaggggccngatccgggttggcgggggcctttntttcggcttaatttaaccggccccacttgggccaacggaacaaggtttttccccnggacttggaaaagccggggcaagtgaggcggcaaaacgccaaatttaaattgtgaagtttaggcttccacttccatttaaggcaccccccaaggctttttaccacttttaatggctttcccgggcttgggtattttggtggtggaaatttgtgaagcgggattaaccaattttcacaccaaggaaaacaagct

SEQ ID NO: 20604 - DNA, 1241 bp, Homo sapiens
  misc_feature (1)...(1241): n = A,T,C or G
gtgggaaaggaggacagacgaggaggggggaaggaggggggggcctgggaggtcggaccgggggcggggggggcttccgcggggnagaaacaaaggaggagaaaaagagaaggaggaagcaagcgaggagggctttttcgacagaagggagacaagccgctagcggacgagggcagggacgacaagaacgggtacgggagaccacgcgcggaaggaagcggaagggagtatggcccgcacgagcgcgcgacgggggcagcggccgctgactcgagagaagggaggagagagagacagcggcagacaaggagaaagggaacataacaacgcagacgagaagaaagcaagacatgttttttgtacaggcaggcggaaggagaggacaacaagaaaagagggacgccaccgacagactacgaaaacagaaaaagacgagaccgcggaaagaaggaccgaagaggcagaagagcatagaacgagcgatgcggcgctcgagagccaacgtgcgacggcgcgcggcgaggacgcgccggacgagaagcacagacaagagtaaaataaaacagcagtgcgaggacgcagagcagacgaagacccgcgcagcgacgctcgggcgagaagaggcgacaccaccagccacaggggtgggagatgaggggtgagtcggcggctaacggaaaacaaccacgagaaaccggaagggaaggcgaaacgtacatatggagagacaaacacaggacagagacgatcagctaagagaagcacaccagcagtgcgactgacaaaagcacactacaaaacacaaacaacaacgcagacaagaanacaacgaaacgaatacggaaccaccaacaggcaaagtaaagaagaaggagtggatagtggaagacgaggatggagaagcgaggcagagtctgaggtgagcaggacacaagagaagaagatggaagagaaataagaagaacagcatagatacacagagggaaggaaacagcgaagcagggtgagacggagagccaaacagagacgtaccagacgcactaggcgagaagagagaggagcacgatagagcgagagaacaagaagcgagcaggggaacgacgcgaggcggtagcgagtcgccgagcgaaagaaggagcagagaggagaagaaagacagggcgctgcccgacggatcacatgcgggcgcgacgaagcaacacacccgacaggacagagcaggcagaccaagagaagagggg

SEQ ID NO: 20605 - DNA, 1043 bp, Homo sapiens
  misc_feature (1)...(1043): n = A,T,C or G
aatttattaaataataatgctttatttatatatagagggataagagcttaatcggcgacgactctcttatctagccaccgctacacattatctgatcttctgggatctctactaagatgctggcagcccagacagctggtctggccctgtacgagccttcaggggctgggtatgcttcatgatctgtgcattgtcactgactgtagtaaatcatttgcactgggaactcggcctgaaatagaatgcccttaatacgtatctgaagatactaacttatcacactactgtagtgttgttgctttttattcgtgtatttaggaacatacttaattttgttagcttgtgcagtaaaattattaaggcttgagatactactttgtagaattatattaaattcactgctagctaactattttatataggtctattaaatacttatattgaaataacagttagtaaatgtgctttaattataataattatgtcatactattgtatcaatgtcctcagaattgtaactattatttcattcatagatagtaccatataaatcaacatgtagattatacagacttgtaacaactacagcaaggtgtacagagtttatcgaaaacaaaatgtactctgagtagaacattataataggtgacaagtgaacaagtgatcagttacagtattgctacgatatatactataatgatacgctataatcgagtccgtatactttgtatcgtacttggtattgttttcgaaccccatctcctacatcgaattacaatcctttgatatacgcaaatacctatagaccgttctcactattactcatactcgcaccgcaacacgaagcagcatgttaaaaatcattnatcagataagacttcaatcgtttatcatatgttatattaaatttaaattaaaccataaacactaaatatatagacatgtaatcttatttattcaggacattgtgaggttatatagttgatatcaacacacagtagatatgttatatgatcatgagatgtctaccctatatactttat

SEQ ID NO: 20606 - DNA, 173 bp, Homo sapiens
atagtaggactgaacttctgagaggttaagcgacatggcacagattacacagaagagaaagattttgaagatcagatgaagtagttaccttggaatactccagcctgggcaacagtgttaagactctgtctcaaatataaataaataaataaataaataaaaataaagcacga

SEQ ID NO: 20607 - DNA, 1109 bp, Homo sapiens
  misc_feature (1)...(1109): n = A,T,C or G
gagccggcaataagtacctcaccctcattccacccctccttcactcagctctcaccgnctnctgttatctaatcaccgccacagattcctgtgaagcacctccacctatgcgtgaagaacatgcatcactgccttagtgtctaacaatgagctctagggctctgtacaggcctcgcatattgctcgggcgaccaactgcctcccagttggctcgttattcccactccatatgncgcggactgctcccaacacatccacggagggtagtcagtgtgtgcaatgggccactaaatagcacaatcctaccctggctcgaccgaagcacgagatgcaacaannaggcaatcactggaccactgatagtatccctgntcataacattgtcatttatccccctatctggcgagctacttcggccacactatcctgccccccacctatnccaccctctgccacctgccccgacccaaatcgcccaacggaatattcagcggaccactactctctccntccatcgcttggagcatcatcatatccctttgccccccttcggttagcagcatgataccttctgtgtcagtgaatcggtcgcactccaataccttgtgacctcttccccctcaccctttcccncccgcatcagtgctacaccgttcccacgatcaatcccatcgatcccctggcctcgtcttcattcggccacntctacataatgcgncctatacaccctacttcctgtctcactcttctgtccatgcaacgcccgagaaccctcnncatcgccacccgtatctacttcacttcctacttcccaccattcgccactaccatctnccatccgcgaggtctccnnntcctcctttacttatgcggtccctctcacncacactcctctacaccagcctcctcggctagcacatgttcgcgcaccgaccgcgccnccgtggctcacattcacttgactcccttccaccttctctccctcactacctctagcctctaacttcctaccagcattctctcactgactttctttagtgctatcgtgtctctattangcgactctccctatattagtgaggagantacgacaaacatcntatagtaat

SEQ ID NO: 20608 - DNA, 843 bp, Homo sapiens
ctggtccagttctgatggcaaagatgatccaattgatgtatctaaagacagtatatctagtgaagatcttacagaatcttttaaaagatggcattcagttcagagagtccttaccggaggtgaaagacctgctacaagcggttcatcttggcagcttccagacccatatttaattatcgtatgattagaaagcaatttataaatattatgtccagggaacaacattgcatttttctaaaataggccgttgttctataaatatgtttaacttgtgatcttttacagctttattggccttatactttatgtcacttacgctctacgtgattaccatgtatgaccgaaataagaagctttattagtgttagacatcttatttcattactttttcacatggtattcgagtcacaagacttcgttccgtgatacgttctataataacatcggtcttattgttattaattatctaaatatgcataacctaatattattcagcttcgcccctggtcacaatcttactcgattgtgtcgtcctcttgcattataatatatatcaaaattacccgtcccgacatcaagaagagtgaaatcaagaatatcatattatatcgttctccaaactaattgatgatgtaataccacgagataagtataaggtgtttagcgagctttaatcttatcaatttagttcacttcatgtgaaactggcaatgcacatatcattattacataaacatgaataataaaatgtagaaaatggatgataagataatagcagcgttcatgaaacaagtaccaaattaacaatgacccctagtctttttatatagtactactcagact

SEQ ID NO: 20609 - DNA, 929 bp, Homo sapiens
aaacaactaaaattccgctatattagaaaaatagagaagacctaatgggcaacaactctatgcattttccaccgctacacgaggatttgacagctaaggatattgaagaaatttttgatagagctcaaagctggcacaatcccaaaacctgggccaaggagtggacactgttctagagagccaactggaggacttacctctttgactgaaccacccaagggacctgaatttgaagtacaaacacgctttttatttatatggaactgagaatatatcaatataaaaattaagtatgtgcttacgatgtacggttaaattaatacaaaaaaaatatataaagtagatatacaagaataaatatcaagatactattcgattctgattaaaggaggggaaaattatagaccaagaatgcactgatagagatttaaaatgcatattcaataggaatactagaccctaaacaactaaataaagcgataacttgtgtttctctaactccggaagataaagaaaacaaagaactgtgagcataatgaagtccaattaagcacaaatatcacaagacgcacatgatgtaattgtaaccactaagaatctatacccccattgattatgtgagatgacaccttcacagcgcaaatatctaaataaattcttgtatttaatgtaatttcaggtatcattacgttgtaaataatatattagcacgagagcttgaacgtacaaagcaatttcacgagtgaagtcagaatactagcataagacacataagataatgcatgacattattctgtcagtgcacgaggcgtattaatatatagagactagtaagatgacaagagctccagattagacgtctcgattcatacataaggtcagccattcgcaattaccaccaaaaaaatatagaaaatgcatcacagcga

SEQ ID NO: 20610 - DNA, 1620 bp, Homo sapiens
  misc_feature (1)...(1620): n = A,T,C or G
aaatcaatatatattcacatcactctaattaagacgcaacacacaccctaagatgctctctaccgtaacttcgtaatatacntaccacgtcctctatgtggcgatgcagacagctcatggttataacatctgatgttatccttctacacaatcctccacacngcaatgcagtaacacgacatacacagatgataataacactatactacataatggtacgacatttaccacagtctaanatccctctcaacaagtcatacatcacgaggagtaacntgctcccacgctttatctttatttgtctctgtcacctcacacacacaanccacacatcctattctaatcaatgcgtaaagcaggtattattgattattatttctattgtctctatacatacataaaatatatcggccagccgtatcataattatctttactcgttgaccttcgatctcacccgaccgctccgacaacaccagatgacaatcaatatatacatttataacaattaacaccctatgacacagaatatattttccacaatactctcgactattttnacccacttgattataaccccaatctctacgacacacgtcacgccattctcacctgatntacgccagtagacgctgtatcataccacatatatcaaaccnatatcataatgaggtactatctattattatatctagtattagtctctcgatacggtaatggtacacccgcctctcacctacacaatatacagtatccacatataatcattataatttatactcttactacatatccccaccattatttatatagtcccctcgcccatcctatacattcactggtctgtatctgatagtacttcgcagtactccatcatcacttcataccatgctctcatanattaagcattcgaacatgaaaatatatactaccgccacctcacgctctactagacccaccacgagtctatttattgcttagacacatccagcattatctacatacatattccatctatgattagatacaaacgatacgctantatgtataatgaagatactattcanctttaatctgcatactatcataagttcagttcgatccgaacgcacgcaacttactattancttgtatacactanagcgtctactatagtatgacatacanacactccatctatctacgtgtaccactatagcatntatagatacagatcatagactgacaccttncagtcacatgtaactacgcttcgtgncaccataactattgtataaattactattctaatcgaagagatatctgtnatatataccacatgtgantcacactantgtacataactaaaattaaatatataagacaccacgntctcacgtagacgagatcactcngcagtagnncacacgtnatgtttttaatatatntnaatatctatatatatcattgacanatactcacatattagtccatcnatcaatacccgttgcgaaaatctaagatatattnactcaacatacntacatactctcttctatacagcttaccagtnanatatagatactacaacgacacaactacattacacctaacatcgactatacgatatcgcatagacnag

SEQ ID NO: 20611 - DNA, 119 bp, Homo sapiens
  misc_feature (1)...(119): n = A,T,C or G
tacagtccagcctgggtgacagagaaaagaaaaagaaacatntcataatttggntagagcataataatttgattttctggtttttgaaaatttgagttgcaataaaattagatccggcg

SEQ ID NO: 20612 - DNA, 1671 bp, Homo sapiens
  misc_feature (1)...(1671): n = A,T,C or G
cacgattaccattcaggtcggctgggggccgctactctgacaccacatctctcgtcaatattctcgtccttgcgaccatcgatcaaatataaaaaccttcactgtcggatatttgccatgcttatttccaaattctattctctcactattcgtgcccaggcggtgaagatctcatgtggcaggctccagagggggtgtgcccacaacgcgatatcacaacaacgcaagcgacagcctccgggccgggcgatcgacatgtcgtgaccttaaagcgtagcacgtcgagacgatctggcctcgatcgtaactgatcananacggntgtacacacgcagcgcgttgtagagantgagtacgagtgcgcgcgtctgcgcggtacatcaatagtgaacgctgagcgcgacagagtactagctcgtaacgtgtactagtcgacgacgtcgctcacgcccgangnatgtcgcgncgagcacgcatcngactatnagtcacgtcgcatctccgctatcacatagcgtgccgcgcagtgtggtacgcatggtgtactntagcctagcncangcatctctcgcgatacagtactcgacggcctactgcacaccgactacancaacgcacgacgtgcgacagtgtgtatatactgtngcgacagcaacacatctactagcacgatatagttagtgtgcgcagatgatnaagaatgagtantgagcatatgangtccgtgntgatgctcgctcatatatgtncacagcgcaccactctctgctagacacgccagcgactcacagagtcacactatacgcgacgctcactcnctgtcagtgtatacatcgagcacgatagtcagacgtgaatgacatcagnaggtgnccgcacatagtagtcgtgcgtcgacgtcacatctcgtgagtgtagcctgccttacgtacgatagacaggaagcactgactacatcctctccctcacctgcctatcgtatcatacactcatgctgcgtatacgctcgcacatatcgacgantcactatatcactcatctatntatacacgtcagatagtctgcgtccgagtgcagctcctgcgcgcatggtgcgtgtggatacgaacgcatgttctcgcctgacatctagtataggtatatcatgatctactacttatagtnatgntactgantgtgtngtatcatataccacgcacgatcgtcagacatgtcctcatagtactacagctcacagctctacctctatacactgatatacgtgnacactactgatcaatataccatcggactgcatattacaagaccattaacgataatctacgcgctcatcatatactgcagtcgatgactgagagtgacatagtacgtagaatactaaagaactgtagtcagagagaatgatacggctgagcgtcggagtgtgnagacgggagtggacacgaactaatgcgtcgagantggcgtgacgtggtcgagctgacactctgagtatactggtaatagcgaacgaggcgtgctgtgatatgcacagagaagcagtgtctagaagacgactcctacaatgctntacgtcgctagacagccactgcatggcgcnctcgaaagacatngagagagattagtcgcagacgtgatcggcgagccgtgaagatcgtgctaccagatacg

SEQ ID NO: 20613 - DNA, 777 bp, Homo sapiens
  misc_feature (1)...(777): n = A,T,C or G
cctcgttcagagtatggtgtaaccagtacgacgggtatggctgccgataagaggccgcatatcgtctgcctgcgtgcgctctactcctccactgttagttagtaggtttgccgtgcggcgtcgcgcgtgggtctgcgactcgcgccgcgtccacactcttcngtatgtctcccccgtgctctccgtcagccatgtctcgtgttgctcttcctccggactcctctgcgtgctggccaccgttcctcantccagcttcgcctatccgtcagggccgccatgcctcttttcccctcgcccgtctatttaattgcggcatgctccactttatcttattactgtgagctagtttgggatccccccctctccctctccgcccctctcctcctcctcctccttcctttcgcttagtcttcttcttcccccttctctctctcgtttactcccgtgcttctctggtctctctctctctgcattttatgccccctccctctgtcacccgcactttctcctcccctctccccctcccgttattcccctacaaagtttaaatttgtccttccacccaattccaccagtgcaatatattttgtcacccttataagtaggtatagcagttatgatcacaacacactgtttttccccctccacacaggcatagagtgtctgctattaataattatcgctcaataattgtgtacctttagctttttaatttgtaaaggggttaataaggaatattngaccaacagccccttgantagagatcataatcagcca

SEQ ID NO: 20614 - DNA, 816 bp, Homo sapiens
  misc_feature (1)...(816): n = A,T,C or G
gctcccgtatgggtttcactggacataacactaatagacgcagcctggaccaccccctgtagattcttttggaggagggggatttttgccccgcaaaaaaaatgggtgccacttttgaggacacatggggactccttttaagtacccccaaccaataggtaccagatgaacgttgaagataaaaaaaaaagaccctcttttattaatatctttaaatctatgtggatacctatgacgaagggacactctagaatgtttcactttgtgtgccactaaattgtgctcacatgtttttattgtcgtggtagaaaacacactccccctccccataacggtgcgtcgcaaaagtgtggggggctctcctttgagtgggcgcctctactgtggtgaagagactctgtgttgaacccaggccatgagtgaagcataccaaagggcgtgctaccatcgcacggaagagttctgaattatgtgattaaacaatggcgagtatggatgatttcacatgatagcatattgagcgcgggtcatctaggttctaaacgtggtggaatgggcaacgtggcgacgcataatttaacacatagatatttcttctccttgcagttgtatatcgttgctcagacggtcggtgggatnaagagaaccactccaaagcgacagctgcatcancagttatgtatcatgagaatataatgagctgtagctcatagtatctcatcatatgtacgagcatcgcagattcgtagacactctagaggagtgattatccatatatgaatcgctaactctacgacctgagatatcacgctcccg

SEQ ID NO: 20615 - DNA, 843 bp, Homo sapiens
cttggctgcaactgactctcttaatctaccaccgctacacggtgtatcagtatgcaagaccggactggtgctattatgaatggtgctgcacactgttaatcaagcttacactagctattatgatgcgcgcacagtgagaactctgcaggtctaccttgcaggcagcttcagggatacggacctgcacaccctactagtgaaagagcacctgcttcaagcacgtactccctaggattatttactctggagaatatcatatctcacatcatgagcgctgcgaacaggctcacaagagcgaacctggaagaagatcccgtgaagcctgacaacatccaaataagcttgaatgcgcgctcttcagacctgcttgagccttgacaggatagctgcatggacctactcacattatgaccacagccttatgggacacaaggaacctatgacacccagctaaaccatacctagaatcctgatgcacataaactgtacaatgataagtgttggctagtataagctgctaatcatggtgaaaatatgtgatacgctacatatgactaggctacagattatatgagataattcacgtgaagaacttaacatgcacccaaacaatggtaactgttccttgaactgctaatagtatggaccacacttgcctttccctttctcaattttataaatagattaactataatactcctacagctataatttgatactttatgttactaaagaaactagtatatacatatatttacatatacatatgtgcttatatggggatatatgggtgcatatatatgcagtattttatgtgctcatatatagcatgggtgacgggga

SEQ ID NO: 20616 - DNA, 961 bp, Homo sapiens
cccttccttactctcttaccacctctcctaccctcctgacatacctctccacaccacacctcctcatcgttatactctcaccaatcctccaatcgcactgattatatcatcctctcctagccctccaacctctctcctctctccatgcgctcgtcgtactctcctactgcacacacactcttcatcgcacacctactcctatccctccgcacacagcctacatcacttccatacccgcagcctcctctccgcgcccaattcgaacaactgacgatcaacgagtttaacgattggaatcgcatcacctacactccctgctgcggttaaagggcattcgccacacccatccaatccttcaaaagttttttataaccccatagggaaatataaccgctgggatctccacctaattttctcgccaaaagagcctatcccaggttaaattgtatacgagtcaagtgcttttcacacacagttttcttacattaagtgcaaggcattttcttaacaaaccccccgcacagggtgacggcatggcataactgctcacaaactggtcggagatcacatgggccagtccctgggtcactttctggatgtggcatcttctaccgtctcatagggtgaggcacatatgtggcccctcataaccctcttaagacccctctcagggtgccactgatgggggatgagggaaggccctctctctactctttgaccccccccccccttgaccctcaacacctctacacacacacacacacacaaaatcacaccattttcatgcctgtcaatccccaccacaccacaaggcaggaagggggtggtgcctgctggggcctagagggggatgtttggggaaacagagacaccggacatccagggcctccccgccttcattattcatttttataaacaaatattgttattgtaaaaataaatagtcgaggctggccggaaa

SEQ ID NO: 20617 - DNA, 799 bp, Homo sapiens
ctgagtagatatctgggctacaatttcttcttgttgcgtttggttttaaattcctcagtccagtccccttatcactcttccttagaggtcccatgccagtacaaaatgggcgtaaaatagatggttctcattctccagtacggtccttaaagaagcagttaatttccagtttaaccgtctggtatgagggccagttacccgtcgggtaggaatgctcctaaatggttaggtgcaacctccttgccatagatcatcaatggtaactccagtactctgtttgcccgtatagacatatctcagctatattgcagccacaggcaatggttgtgagcagacagtgctcgtgcttctttttcagcctctcatcctagtttaccaattgtgcacgtgtccaatagagtctatcacaaactgaatgtgaagccatagcaaatgtcttagctctgccattatacagcagctctgagtcccccaggtcacacattctccagtcctgcttactgattattcattatatgttgtcgtgtgacttactgtttttatccactattcacgccaaaggtgttattgtgtatccataactaggtccccagtcactcatggcatgcacatgtcaaagatgtggtcctgaagaacatgccacaagtcatgaattgttaatcaatgcttttatctatcatacacccccccatagaagatgaaaatttagagttggcagatgacctcagtatgtggtatcttaacccgcctcgttagaagcacatgcatgttattaataaataaaatatggatcgggcca

SEQ ID NO: 20618 - DNA, 518 bp, Homo sapiens
  misc_feature (1)...(518): n = A,T,C or G
ccagcgccctcgatgataaaggccacattctacccaatctccaacatcgccataacaccctataccacacggctacctaccaccgcgtgcatacaaaccctcaacaccctaaagcagctcagttacagactacccgtcccaccacagcaagacatcgtctccccccatactctaccaccaactcctacaccccccgctcgcctcctccaccccagttgcccactcccccaaagcaatcaacacctcgaaccctcacacccttccatgatcaacatcgtacctaaaccacaccccaccacacctgcaacaatcgccacgatcacccgcctatcctcccgtaaccactccgcgcgcctctacagcgccaccagacagactcccaaacacgccccgcaacacgacctcatcgcccatatcccccttctcgccacgcctccttgattctctctcaaacttgacatccacgatcaacccccctctacacacccaaaaacacacaccacaccncccccccncct

SEQ ID NO: 20619 - DNA, 935 bp, Homo sapiens
  misc_feature (1)...(935): n = A,T,C or G
cggattttcgccaccccccacctacaccgctgggcagctgtaccaacataaggaccatcgaccctctctcatctcccccacgggatgagccctttaacaagcaccactttagcatggtgccaccgccaaatggcgctcaatcaaacgagcatttccaatttagaaaaaggtgccatggtcaaatttcctttcagaccaagggagattcccctcttgacggtgggggccatataacagcgcccaccgcccaggccgtcacgcgcctttaaagcggaatctgtggttacacaatgatttctttatatttggctcccaaaacagcggaaaaggagcttttttttttcccccggcagcagaaaatctttttgaagctcctatgggattcttaaaaaaagccacagggcaatcgcatctttctcaacatggaagaattgacaaagtctggaaattcgcccactttaattatgacacatctcagaataagaatgtcaatgtaaatgaaaaagcagagttgcgcctttggtgctactgttttgggatcagagactgaaagagtcaagcagaagaagctgtaaatgatcaagcacggagtttcgcttttgttacccaggctggaatgcaatggcatgattttagttcaccgngacctccacttcccaagttcaagcgattctcctgtctcagcctcccgagtagcggggattacaggtgcccaccaccacgctnggctaatttagtatttttagtagagactgggtttctccatgttggtcaggctggccttgaactcctgacctcaggtgatctgcctgcctcagcctcccaaagtgctggtattacaggcgtgagccactgtccccccccatcaatgtggaattttatacctagtgaaaatatctttcaaaaataaagatgaaataaatacagatcggccg

SEQ ID NO: 20620 - DNA, 1254 bp, Homo sapiens
  misc_feature (1)...(1254): n = A,T,C or G
cgggcccaaacacggcnncgngccgngcgccacgcgcggcgcccgcggacggcccgcgccgacggcacccgacaccaccacaacccaccgcttgaaaagaaagaagacaaccgcgcacgagatttaaggcggagaggaagagacagganggaagagaacggggcgacagaagggaacaagtacgcacaatatctcttagcgtggcgaacagatagagcgcgggggcggccggcctgcgacaccgcagggcacatacggcagcgccgacgcgcccgggagccacgaccaaccaccgtacgaccacaccgaccactctacaccgacatacggggaagaggagcccgggagacatagcccccccccccgccctcaacgcacagccgcctccgcgcccacccggcgaacggaggagggaggaatgtcagggagagacgaaagaaagtaccccgccccgcgcgcgaaatcgcgtgcttcagtagccaatacaggaacgagacaacacaaacagacccgccacatcaccaaaaccgtagaacacgccaacaaaacccctggtagtcatcaacgcacaccccaccacgcggaccgccgccgcacggccgtcgcgcgcgccagacaagcggccgcgcgtcacgcagcgtcactaacgccgctcgccccagccgacacgccgcgtgcgncggcggagcgccgcgcagcgtaccaccgctccagctaccgagacgcgccacgcagaaccacagtagccatcatcatcccggcctcataacaacgccccaccgaccgcagccacggagcgccgccgcgcacacgcaagcgagccacgagccactcgacgcgcgcgtgaagcgagaaagcacactcacccactacacccacagcgagcatccactnatcggagcgagtgcaccaatgacaagatatgcctagcgcacacgcggagccactgacctgcacacactcagcgcctccccgtgcgcagctccagcactcgcacacacacacatgacacgtcgacagtgctcaggtcatcgagcacaataagacacgaagcggcgacaactaanacatnacgcgagagacgccagtggtagaccgccacacagcgccgagacacgcacgaagcgccgcagatgacgncgcagacangcacgagagaggcgcacccaccggcgcaatgacagagttcgtcgaccgcaacaattcgaaacacatgacgtcacagtagacgatacatatcagacgaaagcagag

SEQ ID NO: 20621 - DNA, 898 bp, Homo sapiens
  misc_feature (1)...(898): n = A,T,C or G
cacggctcacttggtctacgcctccacaccgcatctcacacactgccatttccacgcgccattatctcctacccctcctcgcaccctccctgacattccatccgcttactacaccgcgcaccgcccctctctcctactcctcccccattcncccaccgcgtctccacctctatcgctataacccttcgctcccacgctcacacaatcatgaccgtcccgctaccataacatacgggtctcacatatcacagaccgtcgcatctcgatacggtcgctccttactctcctggtactatgcttttcctccactaaggccaactgcctctcactttccccagctctttcatcgccccctccactgatatctctacacctcggcatcacatctctcttccccaaacaaaccgccctccaactcctgcatcagccctacctatgtcttctctcctccttcccttctctcgcacatcaccaagccctacggcacacagcccctcaccggcacccttcgcctccacgccctgtctcacgttccttatcaagtgatcaatcctgctccactacatcaaaactccttgacccgcttacgcttactcaccaccctctcaaggtaaatatgcccgcccctgtctatccgttcgtatctatcatcgcctccatgactcctgtcaccctttgataacgtaggccacaacccgcttatacgtccacaaccacttctcgttttttcttctactcccacaccaggccatagcagtgtcttgcctattacataacctatgcctcagaaaactttgtgtaccctttacgcttttctaatttgctaccacgccgcctaataagagaaatatttgcatcgtatagtcgccttgacctagaggatccataatcacgccta

SEQ ID NO: 20622 - DNA, 1449 bp, Homo sapiens
  misc_feature (1)...(1449): n = A,T,C or G
aaagacaacaggaaaaagagcggaagcagggagaaaaaggccctattgggggaactggtggggcgaggctttaagaggggggaaaccaaaagaacagatagacgcagaagccgagaggcacgtcttttggcaggtaacgatacggatagtggagtgtgagagagcgataatgaagacggcgcaccataaccgggtcagtatcagccatactggagaatcaacaagagacacactgacaataaaccacgatagggcagcaatgctatcgccgcgtagcacgaagagacacgccgcgtcgacagacatcatcgcacctagggtaagagagcaacgcgaacttctttttgagggagcgggagagggagacaagacgagagtgtgacgctaatntgacggagtgggaagaaaaagagataggggagtaaacagtgagacatacgcgaaataanacgttgcgaaaaacattggagtaagtaaagctgagagtgaagcaacatgttgcacggcagtcagaagatgtaaataagtgagagctgaacaagtaaggcaacgacatctgtataccgcagtnctgcgcccaagtacaaagtcgctcggagtccgagaagagcagctgaaaggcagtcaccgactaagcgtaggcggtggagacgcacgactgagngcgccagtcaacacaacgaatgtancatgctctgagacctgagtaagatgtgctagtagatagatgctcganagcatgaganagcagacagtgggcgacggcaccttctcctaggtgagacacgcaatgcgctgatcgcgntcacgtctagacgatancgatgccataggacttcagacacgngcacacncactagcatacagcacgctacacaatgaacgactagtacacgagagcgacagagagagcacgcaggagcgacacagagagagcgagcgagtcggtgtgagatcagcgagcatgacaaccagcagagtatangatgtagtagctcataaactatatncaagtgtagtangagacgagagcatacaagaatagcatcacaagatatatagactgagcagacgcaggagcgtgcagagatgaagaggagtngcagactataagacgctaagatagcacaccgtgagagaagcagcgaagtggtgtagtactatgtgtcggagacgagatgagcgagtgctggtgtgacacacagaggctgtagaagtcgtgtatacagaatgcacacagttagtattgactatgtgtgaggctgcagccagcagagtagtgacacgtctgagcacagttatgcgcagtgtgggtgctgcgatggactaagaagcatcagagcgtaataaaagagcggagagactggatacaccagaagtcacagaggcagtcagggcagaacaatgctcagacggctntagcgagagattatattaatagatcagtct

SEQ ID NO: 20623 - DNA, 1935 bp, Homo sapiens
  misc_feature (1)...(1935): n = A,T,C or G
tatacgtcacgagttctcgaccngtcacnctagcgtcagttcgtgcgaggcgcagcagccggacgcgcatgcggccatgcgaccgccagaagtggacgtggagcacgctgcggatcacgcctctcatcgtgcgantgaggacgtagcgctcgacgacggacgttgcaggtagtcgagtatcgacagtaagcaagacagacctatacaccgcagacgcacgatcagccacacacaatcgacaatacggctgtgatggcgtcgccctcgcccgcgtngcacgacagccatccgtgacgcggtncgtagtcgactcatatcactcgagttagcnagcgcgtggagctgagaaggtggtggacacgtacacgttcgtcgagcgtcagatgccnacatcgagtagtcntgcccagagtgtacacctgncaggaagtataccaaggatgagagtctggtatntgctcacttgtcgctactctccgaagatacgctctatgggtgcagatccactgtgtcgcgtgtgcacgcatcgtcgaagtagcagagagagtcagaagatcagagtcattatcactcgaacagattctgtcatatagtcnccgtcgccagtccgcgacgcaccgataccacacaccctgcgacacacaagcgacgctaatgccgctacgcgtaccgacgatgcgagctaagctcgagtcagtaggactctagatgacgaagcggacaacagatgacgagatctacgcgtcacgactccagcaggacgcggnantngnacgctggtcgtgcgctgatgctgattcagtcgtatgacctcatntgcctaccgcacaaactagcgnatatgagtttgactgatataccgagtgagagtcacnacagcgatagtcactntatcagctcggagagctcgcgcgtagcgaccangacgtgcacatcgctgcgcgcgtagantcgngtgcacatccgtatatgtagtctgaccgcgcgtcagtatgcgtctgtcagcgatcggcatgtngagtgtatgtattagtgtcagatatcagcgcggtgatcgtgagatgctcgcagccgcntgtantactcgcacgaacaccgagcgcacacagaagccggcagaanagtagagagtatatgtgngaacagtgtggcgtgctagcgaggctcgcgcaccgcgcagcgtgcacggtgtagatgtgacggcgcgtgcttaaagtagacgtagcgagtgagagnagtcagaggnatgtgtcgagactagtatccgaggaggaagtantgtngcgatcgcagtgacgcgatgagctaggtacgtgcgcgagacgtangacgatgctcggatctgagcataacgnctcagctatcgcgaccgtgctgatgcgactggcgatcgtnacgatacatgagacagcacgcnactactgattacactagacatatctntcgctgtgagtnaagctcatgacctgccagatctctaacgcgtcgtggcagttagctacacacgcgacagctcgtcgacgtgtgacgtatacgtgatcatatgcagtactcnctncngancacagtatanttggtgcgcancgagnactcnagtagagtagagcgagtactcgagcttgactagtcgtgtgacgactgagactagacggcgcgcacgcgntngcgcgacagtcgactngtgcgtgcgtgngtgtgatctanacgaactacacgnatcctctgcgcgcactcactncncatcagtctcacagcgatgctacgcgccatccgntagtgacntatgnntgcgacgtcctgncatnctgcatnctacgnagtcgtcctantcgtacgtcccgtcancngatcttatgcatgtagacgactcagagcgntgagctgtcgtacngcgtgaacgcatcagcngcngacgancgcagacagcgctcgacg

SEQ ID NO: 20624 - DNA, 495 bp, Homo sapiens
actttgaaccgagggcctgtgtacctactatactgtaggctaattggatcaagtggtaggggtggttggatacacctggattcaggaggcgcgaggaaaagagctggggtgaggatcggtaggagatacaaagggggatgagaatggggaaggaagaagtggggcggagattaataaagctggagaggtgtagcagggtaggagaaagtgatgaaagggcgcagtcggggttcgctggcagacggtcttgctgtccaagttggtatttctcgtaaaagataggttaaggtgcgtagtgcgtagcatacaggaggaggggagagtggggggagacggtcttgccagctcctgagcggccaaggggggggctgtcggttgtagtggcgcgtcgggggcggaagtgactaggtacgtgtctgctgtgtcatgagcttgggggtgtggggtacattcctactgcggtgggttgaggctagagcagcaggaggtcgcgag

SEQ ID NO: 20625 - DNA, 879 bp, Homo sapiens
ccacccactgagctcctccctccgtgtccaaacaccacagccgtcacacaggggggcctggtctcagaggcgaccaccttcgcataactaactcactacaaacctctgtcacccttcccttccttcttcttcaactccaccaccggcctcccctctttcctataccccattgcatcgcagccctccgctctctcacggtagaacacaccactccacttctcttgcccgcacacctcccctccctcccgctctctccttggtcgctcgactcgtggaccttcaactgccccatccatctctgactcccacattctttgcctccgccacctcatctccccgccccgcacactccactctgacggggaaatattacaatccaccaccaaccggcggggcaagactcctaaacaaccttggcccccaaaagtttccaagcggcaaaacccctcgctaaggctccccgaactcttccagggttctcgcgaaatgaacgcaaatacacaaaacaattccttgtatttggcgcagggtaagaaaaatcccatcctgttccccagtcaggtgaggaaagccggctcacgagagtatccacggagaagaggccagcattgtgtggctgccagcaaaggttacttgtatgttaaatcagcggctttttttagccccactatgtattttttttttcttgaacactcctgtgtctaccgggatctcctgtttttattgttttgggatgagattttaaaaaccccatttaatgtagcctgtgtgctcttgttcattaaaccaaaaagaaaccctggatcacggcaaataaaggcgatgcggccaaccttttttttcttcggatatcacgacaacaaatacatcgagtcgtgc

SEQ ID NO: 20626 - DNA, 918 bp, Homo sapiens
cgcactctatctcacctacccctaatgctccggtcccctcacacaatcatttcctcccaccataatcctctattcgcatactttttattttctcttctgcccctcttcttctctcttttaccgacccagcctatatattacttccccttcctcctcccgccttctctaatatatcgctccccaccccgcggcacctgccggcctaaacacgcggtcgccgcgcatccacacctcttcttccccccccctcacctcgcttcatccccgactccctcggattcaacaccttctggtctcccacccaccgccttgcgatctcgccattccaccgccgcatagccctccagtctccgcgtttaccctaaaccaaacccagtcgcattcactcgcccccccccgcctggccttccttcccctcgcttcactatcctcgccccagagcttgatgtcctgtccattcttacccctctcaggagccaccgtcgcacccagcgggctcccccgtcgtgacctcgcctcccggcccgcatcccgttgttacacatatgccatatatttccaccttatcactttcaacatcttacccgggaaataatgtatatcccagcactatccctttaaaagcgtataaaatccatacatactcgtgaattattttacgattatggtcacccctcagtcaatgaaagagttttttgcccaatataaattctgcagctatataaggggacaggagaccaacacaagcccattatattcagtgaagaaggcaaaatatcaaatctgtcaacaatgtaactgcatttttatatgtatacctcccccttttgtatgatttggaaaaagacaggaaataaacacctggcgtcgttggctcaaacggtggagtagttcgcccgaagcatctttttccttctt

SEQ ID NO: 20627 - DNA, 194 bp, Homo sapiens
ggatccagagatcgtcttgctgctttgcccagactggcctcaaacttctgggctcaagcgatccccttactcagcctaccgagtagctgcgactacaggcattctccactgtacctgactgaagtctaaaattttgaatcaagtctaagcagcatttacttatgatggcagaataaagatattttcagacatag

SEQ ID NO: 20628 - DNA, 233 bp, Homo sapiens
  misc_feature (1)...(233): n = A,T,C or G
ggagaaaagaggnnnnnaaaaaanaaaaagtttatagccacaaaaccccaaagtccgggttttagtgnttggaaaacagacaaaataaaggaactccctttgaggggggtttaaagccctcaaaacaaaacaaccaaaaaacagcgctcccccagggggggtttttttccccaaaacaaaaaaacaaaaaataaggatatctccccgcgggttttttnataaaaaaaaaaaaa

SEQ ID NO: 20629 - DNA, 1948 bp, Homo sapiens
  misc_feature (1)...(1948): n = A,T,C or G
gtattttatgttcttcgccggccgctcgcctcgcgccgagatgntatgtcggcatagtgtaacgcctctattgtgacancgcgtgtctcgcccatagtctgatgagtgcgctgatcgactctgcagcactatcttctcctgctctagcgtatgtcggcgagtccgcgnctctaatatcgcttctccacagtagtnagcagtgtctcgtagttgacgtagtgtaatatagacntgtctgatgtgtacgcagtcgcacatcgaggtctctatagtgatggtntgngttatgtgcggacgagaggtcgatagtgaagagtcgaagcgagtgcgcgacgtactgagtcgcagactagatgtctccctactcattaangatgatctatatccggttatagtagcgcgttcgctgtagatgcacgctngcacgctcgtcgtcgcgntagatngnttagcatcagtcgnctgantctgagncgtancngagctantgngtgtcgccgtcgctatgcctacagtgcgatctctgacgctanatnangagatctacgcgccagactgcccgtcggcggatgcngtgctatatgcgaccacatggtcgtggttctcgcgtantacgtcgctcgagctccngcgcagacgtacgcgagagtgagctgaaacatacatgtgacgattataataactcgtctgtacttcgtaagtgntagtcagctagttgtacttctcacactgagtagatactnatcatatactagtcgtagtcgcgccagcggtcgcagagcgtgattgtctcgagatcgtctgatgttgagcgtcgaggagtgacgatctgtgatcagtcatttgagcgcgctactttatttgtncncgtctaagntcacacatcttgcagtgacggaacgcgctgttcagtntcggattncgagcgactngatcgtancgactgtataatcatgnttggctgagtntgtctacatacattagagcaagtagctatagntccggcgacgtgcgcgattaatccgctgatgcgagtgagatgtgcatgtgacactgtncgccgtatcaatgcgtacagagttgtagatcgtcattgcgctcgcncttgancntatacttactcataccagcgatgtatagtgtgcantcgnanactagtctgcgagtctgtcgaatgcatgtgtcggntgtgtgatgtgtagtcaatatgtnacgccagtcagcatnctatgtacgttacatgatctatataggtgtgantgcgtatcagtatagtntcacgcagtacgtacggctgagcgctcgatgcggncgcgacgacgatgatcgtacacctagagacgatacgctgctgactggtagtgtctgagacgatatatgactacgtgatagatcgtggactngcgntgtatcgaatacgtctgacagtgatgtcatcatctggtcgagagtangtcaagctcgatcngtgtcctacgctagtattgatgcatctctagtgctagantctggcccgatctagctgtcatntnagtagtcgtggttgcgagtgtgatcgcgatgtatcncntgtcatgtgtgagctcatgtgtgtgtcgcgacgtgtccgacgcgcacgcgtgngagtgcgtgcgtgatggtantgtaatntgagatantacgtgtcagtctcattgctatctcgatgcgagccanacntgcgtcagatcgcgagacgacgntcctccgcgatnctgcgcagacngtatgtgtgcacgcgcgacggacgagcntgagtgacgacacacgtntcggtctntctcgtagtgtgcgcatgacgctantantgcgccgcgcggntgtgttntgatgntccatctagtctcgntttgntcgtctgtgataagtttctcgagttagcgaatcgcgtntcgctccacgtcgcgtagtgacgatcatgatatgcgat

SEQ ID NO: 20630 - DNA, 375 bp, Homo sapiens
aaaggttgctccactactgtctgcatctgaacagaaaactacttcagaaaaccttcttggaaacaacaacagagcaaaatgaagcagggtctggccaatgattttcaggaagcctgagacttaaagggattctcagaagaaactcagaaaagtcgctaacttgtctgtgaagccagaattgtgatcagcttcagcgagggaatcagaatgctgggatctcacctatatcagcttcactagtgtcaggagtctctgaactacatatggggatataggacgatgtcagacaaaatgcaaattcgagcaatcttcttatttgagttcaaaataggggataaagcagtagaaacaactcacaacatcaataaagcgcga

SEQ ID NO: 20631 - DNA, 714 bp, Homo sapiens
  misc_feature (1)...(714): n = A,T,C or G
acccccagctccgtgaacgacccccacgccgcccccctcccctcattcatcccccacccccccgccttctccaccgcccacctccgccccaccctcccccgccgcccccctccccacccctccttctcttaccaacaaatctccattacttccccccacccatcaccaatacaggtcacctcaaccgacagatccctctccttaactcccctaccccacgcctcgtccaaaagaagccctcagcgatcatgaccctacttgtggacggacgtctcaacccaaatcccgtcaatcgatggctcttcccctacacttacctgagacgccaggccgccgcctagttcatgttcgggatacatcgcaaagcctcaccgccgaagaaggatatcgttatagagggtaacaccgaccaaatcagatgcgtgggagaacggggcaacattggcgcgcggtcggatggtcgtacattccgataaaacgtagtcatgacagagttgacacgtggggcacgtggcgtactcagcaatacattggtccgtggatatacgtaacagtctgtttcgacgtgagtatttagcacgcaagagcgtaacgcanttacnttacacatgcaccaagtacaaggttctgacgtgcggggtcgggactgtcggcacaaagatgtacggagctacaggggtcgtngtcggaccgcgagcaggggtatagactacc

SEQ ID NO: 20632 - DNA, 870 bp, Homo sapiens
  misc_feature (1)...(870): n = A,T,C or G
actggggggacgtaacaaagggaggggaggctagcggcaacgcttcttatctaccaccggtacagcagtctttccattagtcatgccaattcttgaagtattaaatatctgtgtgtgtccaagagaaaatacaaattttttaagaaaatctgtaggaaggataaaacaaagtgggcgggaaaatacacaaaggcaccgggtgggtttccttgggctggtgatagactgtcagaattcagaaaagtctgagtgccacaaagttgttgacgggggggagggcaaggcccagtcngtaatcgcaacaaggggggcaaaaaaaacaacaaggggaaactaggctaaaatgtgcagaacagggtgactgacactgataggtataaaaatgggaaggggaaatgtggacgggctaagcgggtgtgggggcaggggaaggttggggacaaggttgggaatggagggacacaaaaaaaacaaggggggaaaaacgtgaaaagttgggaggaaaccaaggggggaaaggaacggaaagtggggaaaacagaaaggaaaaacacaaaatttggnggttgggaagggaagaggacaaacacacggaacagggggccaacaccacacaagagggggacactaaaaaaactggaacggaaaactctcatccgaaaaaacacaacgggaaagggggaaacaacaaaacagaaagacattgggtgaagtggggaaaggaggtgagttgaaaacaacggggggacaaaaatgctgtggtgcatgtggggatgtgggggcaaaagggggggcaaacgggcggattaaaaaacggaaccggggcaagggggggaaagcgtatgtgaatcgggtggggggaataaaggg

SEQ ID NO: 20633 - DNA, 1192 bp, Homo sapiens
  misc_feature (1)...(1192): n = A,T,C or G
catatctccgccgatttatcgacccatattcatagtctcatatattgcccaggacacgggtgttttgccgcacgaaaanacgcgcgtcataatgtttancgtgcctagggtcctcttggactatggagcacctgaacaatagatgccggtgatcctattctgaccggtttaagggccctgccctcatcgtacgttgtcgatcacggagaccaccgcgcgcttttgtaccgctacgatcttaccccttttctctgtagtgttacgcttttattcccattataccgcgacccgagtggatgtggacattatcgcagcacaccccgtggatattcgccccttatcaaggggccttatgaataacggggagcgtctgatttatctatttggaacctcacctctcaggaagaatgtctaagtgagacgccttttttcctgtgtgctcccagaaatgtgatgccgtcgccagctaacgtgttggaagcgcgcgcctgattgtcagtatgatcgtttatgtggcctcccaagctatgcgctcgctctcgttgttgttgtatgtcacacccagttgctgcactagtgggtgagattcccggggttcccgacgtttgtatcgacctcccgaccattagtaagcgccgcgtgtgtgttagtattgtcgcccgttcacaaatccaccaacccagttactctcgtaacagatagagaagtggacagtcaggtgcaagatatattcacctatttgtgtcgtatantattatattgcagcgtgcacgctatagggaacgacgcgaagtgtacggtttgtgtcatcgtggccgtgctcgacacactgtttgagtctgatgtgttctggtacagttgtgttacatgtatatgatgacgtgatgacaagtgtatgggcatattatagacgcacttagacattctgtaaatcatagataatgtgagtaatgtgtgggtctcagcgcaggagtgtaggggntgtcaagtgcgacaggtcattcctcatcgcgctcagcgcgaaattaggctgctaacgcctgtcgcagatgatatcactacttttactcgagccacacatgtagaccctgttgtttccgcaanctctacctcctcttattgtgcgtcgtgatcatatagtatagtaccgcgctgtgtaactctatcatatgtttagtgctcgcgcaccgtg

SEQ ID NO: 20634 - DNA, 999 bp, Homo sapiens
acccagaatcgacggtgcgcgcgtcgatgaacgaaagaaattttttttgtccccgcacgcctattatactgaaaccgctcacgcacacacggctactcgaccaccagtagtcaaacttaagatgatgatgactctatcaattaaccaccggatacaggtcatacacagacatatttacttgtgaatgatagaaataaaggcctaatgtgaagagtgtgataagtggatataacagcatctcctaacaagtgataagtcgggcagatatagactcattttttacgctgattcatcatctcaaaacatcgcacctgctcaatcaacaaaaagaggaggatgacacatttcctcgcccttaaggacttggatgcctgacagtcttccataaccccagaggtgatgcatgaaccatatacgccgagctataagaaaactctcaatgctctgatggaggtgttaactgcacttataaatcagaaggatcttccaccaatggaacctctcatatattcatgctgtatacaaccgcgtacactcttatgactacaaaagaattaaataccacaatgcccatttgtgtgaaatatttcgttttttaagaaaagtgattctttttttaggaattgaaaacataactttattctggttcccataaagggtggtcaattatttatttaaaggggatttttctatttggacaataataaggacggaaatatatttgtacttccttgattctatcaatagaaaaagcccacctcaacggagaccggcgaccacatcttatggcgtacagacaaaatggtcgaattcactgcgtttaacaaggaaaactattctaagaacagagataaacattaataggtttacgggtaacagctctttagccatacgagagaggagagtagtgagaaataattttaaatacatttgagagactcatcagaaagacgggaaacctacaataacaattagtgtggcatagcctgagccactccg

SEQ ID NO: 20635 - DNA, 801 bp, Homo sapiens
tctctaattatccaccgctcagggcatatgtgattacgctgagtctacctggatcatccagcatactggttttgtgagtaaggacccttggattacattggatccacctggaaaatccaagatgacttcatttgacttcatggagagttcctgaataatcagttgacagaggaagaaaagacaaaggcctggtttacagatgattctgcatgatatgcatatacctagggagtgaacaatcagagaactacagtctctgtctgggacatctttgaaggacagaggtgaagagaaatcttcccaatgggcatgacctgatggcgcattttaccgggaaggaaaaatggccaaaatatgcgattatattgatcccattgggatagtgacggtggggtggttagatggtgcgggatgtaagatgagcaggatcagggaaggtgggtcgaagaaatttgtggggacggtgtgtgcgggggccggggtaagcggcccaggagtccaaacgatttgtgatggcgggggctgtcgataaggggcggaaccggcaaaagggtataatatccggtacggagtgcttgggcggcggtggacggaaggtgaagagcggggtatggaaggatgttcgcaggtgatgagtagtgtcgatcccgcgggcgggtagaggggttagagcgtggagtatagggggatgggtactttaaacatagatcgctgactggggggcggaggggacgtgaatttgttcgggcgaggtagaggcgctggggggacatacatttgggagggggttccaggagcgcg

SEQ ID NO: 20636 - DNA, 885 bp, Homo sapiens
  misc_feature (1)...(885): n = A,T,C or G
acgtccgcaaccttcctcgcatcgcccctcccattgctcagatccctagtcttgtggacttgctaccccgaacctctcatatcaacgcaattgtcccataccaacctacttgggtccccaaactcgatagttttggttctgcaacgcgctctccactatcctcaggtgatccgctcgcaaaatgtttcgtccgagatcactgatcacgttttgttggttgagaggtctcgttcccagaggcgcacatgcttctactaggagaccccaccaattttccaatccctctggaaccatcaaattagcaattggggcccttaaggcttttcaagcctctgagcccaataggctaagaagggcactatgcatgttgccagcggagattgattcccaatacccaggggacattggactattactccacaataaaggtgagtaagagtatatctggaatacaggaaatcccgtagggtatcacttaatgttaccacacattatgattaaagtcaatgggagaactacaacaattcaatcaagacagaactaggaaaggtccagcatttcaggaatgaaggtttgggctaccaagacaggtaaagaaccaagtgcttgctcaaggcaaatggaatgcagaatgggtagtataagaaggtagttatcaatagcagctatgaccatgtgattagttacataactgaggactgtaattgtcatgagtatttcctccctattttgctaagaatgtatttgtgcatatatacacatatattaagcaaatatttttggttttctcctatcttattactttatcttgtaacataagatctattggctttatataagttaagtattgttaatttaagactaataaatcccgtatgcgnccag

SEQ ID NO: 20637 - DNA, 1525 bp, Homo sapiens
  misc_feature (1)...(1525): n = A,T,C or G
gcagtctcccagattatctccgcgtacatgaatcgcactcggcgccagagccngggcctcactcgggataacaacacgcccttaagaatgttgaccttgactaacagcccctgccgggaaacttatacatcacgcgaggttgcgactcccaggcgcatgttattgtctagggngattagtgagaggctcctatccactacgcgtaanagtagtgaacagccggcacagtcatgcgcgcgttgttgtaatcacttcacaccgcgcgtcagacacatatataagcgtttatggaggacacctcatttatatacacctatacnccacacgtcgcgtacatgtggatgtgcaacgagggagagaatcgccgccgcgacacacgccggtgtgtaggacaggtccttaacactggccgcggcctgtacaccaacacncagtgtgagggcatagtgttgctgtgtttgcgcatcgcagttgttcgcgtgttaagatgaacacagtgcatacatcaaccgacgaatcccgcgccatgggagatggtgcgcatgctaacattacagatcctcagacgagcacgttgtgttgtgatgtatgatgagtgcagtcccactcgcaaccatcatatcgctcgcnaccgcgtgtagtctagtaccatatatcacaaccacgcntgtgtgtcatgacaccagcttgtagtatgacgaagatcgccacgntgtgcgtgtcacccatgcgtgtgtgtgcgtgtgcgacgaacagcccgcgacacgacgctgttgtacacgagtagccgtgggatgtgtatgaagaccggagatgcatactcacacgncatccgcacactagcacaggctgtacgcagcgacaggagagtgtatctataggagataggccgtgagtgagtgggaggctcgactgtgcgtctccatgtacatctcacacagtgtgtgtgcgagtntacatcgacagtgttgctagccgtacgcacacgtgatcataacatcgagcaccacatctgacgccggctgtggtgagattgcgtgtggcgtgcgccactgtatacccctngtagggtacgaagagtgctgtggaatgccgcacattacgagtgcgcanatctggtcnggtgactgtagactgcgcagtgtctctaagcgcactttcatcgcgatcgcatgatggagtngtatatctcacgcntagntntcatatgttgtatgcnacgcgatcgttgacggagcatacagagtgtgtagcgtagtgtagcgcagtcgaatcacacttgtagtnattgtcagcgcagtcgcncggtgagaagatcacataatctgccgtcgccgcgacacgctatgacgctgttgatggtcgactatgtatgtgcatactagccgctcgtgtgctggaccgcgtgtgttagtccctaccgcgcacctctcgcgccgcgttgtccatgcgctgtcgccatattgacgatggccctagctacgacctnaccgtcagcttggtgtctccatncgccacgnctgcg

SEQ ID NO: 20638 - DNA, 1080 bp, Homo sapiens
  misc_feature (1)...(1080): n = A,T,C or G
cgccgcgcgacccccacnnnnnncccctnnnccccgccggggtattttcaggaaagggtgaccaattcccctggcgctgcctccgggactctaggcatggtccaaagacggaggattacaccacgggcgggggggctctgataactaaagagaatttacaaaaactagcggtattcccccgccctgtgcttacactcgaaacatctagcgccatcccacaaaacaaaggaaaacaacccgcaccgcctagtcaataccgcctatggaatacaaacaaatatatattgtttcgagagaatacaccgcgaaggggggaggggtatttacaaaggccacgcaaaccccaaataatgcaggccgcatttactctaatcgtctatcaatgtcccctcaatcatgcagtaatgcgcgtcgtaaaagatagagatcgatcaatcgacatatcccgctctcattcttgtatcaacatcacgtccgcgtgagtagtatcgatcactaagcgtattgtttctactattaggaggggaccgacgcccagaccagaacgcacccggatataactcaccctcatctacacataatagtagcgtctagaccgagactagacgcacgcgcgggcggtttctaacagttgcactaccactcagtttgaagtagtccacctcactcgcaccatccacgatagaaacgtagcagagcactgtcctcttctacgttcattgaacataaactacacagcctaccgccggtactatatagtgtccgccctagagtcaattcactataacatgccgncggtggtacggatcgcacacatagatgctcaatccaggtgcataagcgtaaagttacaacaggtctcgcttcgacccggccgtatacataactgcccacatagagttgttccgcaaccgaccacttaatctatctctttcgcgcgcgaagagcagccaccggaacaccatgaacacaacatcatatactaatctactaaccacccgagacgatcctatncaatcgcggccgaccaacggcatcccctcaatcctaacaccaccacacactcacccgcgcctcgac

SEQ ID NO: 20639 - DNA, 277 bp, Homo sapiens
atagccagatagacatcattaactatttagacggcaataaactccgcagctgaggcggtcccaacacggaagtgctaacgattcacactgagggagctccattttcgcgcgacaatattctggcctcgttagataatattgtacacaagagtcacgttttgcccgccgatcatcgacatgctatcataacatcaagagtggtcggatgcggggcggaatattgattatttcatacatccagccagtgcacgcgcgtaaaacaactcagtaaagaaga

SEQ ID NO: 20640 - DNA, 566 bp, Homo sapiens
ataaattgtaagaagagcggaggactaaaagggacgagcaatagggtatactgcagcatttctcagaggtgatagtttcggcgggatatgggtagagagtggtaaaatgattagtgtgaaatagtgtgtggcttttatcggattagatgatcgttgagttggacaaaataacatgacgggtagtaaataaaagatatccgaaaaaatggatactgttagggcaaaaaatgatgcgcgccgttctcgctaataattaacatccagggggaattgtaaatcagtgttagtgggggggtgtatggaagaaatggaaagtggatgaaaaaaagatatatagtctgtgacattcttgatttggggatgaactgatgttctgtcatcgcgacctcaaagatatggatagggcggggttgagtgcgtgcctgatagacaaatgtgttatatcacagtatccggacgcattaacggagcgtgaccgaggcacagtgattatggataataagaggggggtgaatgagcaactgacattggtacgtgagcttttacgatttctttataaggtatat

SEQ ID NO: 20641 - DNA, 891 bp, Homo sapiens
ccccctcgcatccctgctctatcatcagtcgctcaactacaggccattcacccctccctaccccgagccccccacaccgccatcacccacctctttctcctctgcccccctctaacggctagtttcactccgctcatctccccctcctactcggctcacttcccctctggcgccacctcattccgtgcaccccctatcccctagacctacccagcccacacagaaccgttcccgggctccgtagctatcgccattgatgtctttttctcacccacactattgatactttatatgcacgatatctttttcatttccccccgctcccatactcttttgcgttgctaaaggccacactattgttgtcgcccaatagtgctcccaaggaatattagaacccggcgtgttccccccccccccgtgcgcaacgacacgggagagtgataattcaaaccgtgatcctgtgcccagttttcaaaattccttcacccaagctattgaagcagccttcatgaaactggccacaccaggtatttcagatcccctctctgaagagaaaggaggaaagaaaagaaaaaaacagaaacaggagctcctgttcagcccctcccgtcgtccacaccaagtgacaatactggcccaggctaccttctccatctggtttttgtttttgtttttttttcccccatgcttttgtttggctgctgtaatttttaagtatttgagtttgaacagattagctctggggggagggggtttccccaatctgagggggaaccaagaaaattttaaatacagtgtattttccagcttcctgtctttacacacaaaaataaagtacgatgcggccagacctcccttttctcttatatacttacgcacgacctaaccaca

SEQ ID NO: 20642 - DNA, 908 bp, Homo sapiens
agagagagaatagagacgaataaggccaattacaggtataagaatcagagcaaatagaggcgtcttatgccaacagatgcaagaagggtaagatgcaaggggagtactatggaaatgaacaacagcgataagatggtctacgatggcacgcgatgactatatcagcacaagctcccaaccgccaacaatccccgcctcaggaagtccatggaccaagaaaatttgtagattggatctggtcgaaacccggaaatatggcaaatttaatatggtcggtatatttaatgatgaaaaaacaaaaggaaaagatgccaaaatgtggagcttagttctacccgatagttgcctgaagctgagtccaatttaggcattcaccaggcaaatccttgccaggaacaagaggagagaaatcgagccaaaaggcatgggcatgggttcaaatcggcttatcctgtggccactgtgaaagttgatcatacaaaggtcactgttgtcatagccaagcagagttatgagaccacaggaaaaagcacttggaccacgtaacattgctccaagagtataactgtctccaaccctggatgatggaacaagtgttgcaacctgaaaccggtttgatctaatagctacagaaacaacctgcggaaatctaagactagtttcacccactcaccaatcagagcttgccggatccccaaaacgttgctagtgctaatgaacttgctttcctaacaatccataacatttctcatttttatgaaacctacaaccttctctttgctctttggacatactgaagaccacccagtctgtgtgtatgccccaaactgaaattcttgctccccgaaataaaacaagatgcggccaatgtcagtaccgacaaaaattaagaaataaaagacagacaa

SEQ ID NO: 20643 - DNA, 872 bp, Homo sapiens
  misc_feature (1)...(872): n = A,T,C or G
acacgccgtgtcagtactaacgctgtccaatggacatcgatggttttgcaggcccacctcataatcacancgacagcctttggatactaatgaaacaccgtattttatgaagagcatagactgcatccgagccttacgggaagaagccattaagttatcagaagagcagcgctttatcaccttcctgaaagcccttgaagagaaagtggaaattaactattacatcattggtgggaaaccgtggaccaggatggaattactctgatcaccataaagggagccgttggaacgcctgtcctaccctgaagaggccactaagtccctggcccccacgcacgcacacgtggcaaccggcgggtggattcaaacaaagcggtgagcgccacgacttattgcccagatgacccgcgcaccgtagcgccatataagaaatataccaagtgtaggtgcctgctcgccttaccaagccacgaagatctcgcatcgcatagcagtaccgaccatcatacaatcaccaggggataaggtaatttaagaactacgcccagtatagaggaccaaaaaccggccacgatataacatggcctccccccagaacgtaaatcgcctggttaacagtagcggcggtgactagtggagtcagctcacagaagtcggccccgccgactatagcatagataacattacaccagcgtccgttccgaatcacaatggagtaaatgcaggattacacgggcgaagttgctttctcaagtcactatcagagaaaccactcacgcgcactcgatggcctcagaagaggcatagaaatatgactactgtaccgcagcactacttgccacaacgatatttgcgtaacacgacttccaaga

SEQ ID NO: 20644 - DNA, 875 bp, Homo sapiens
cacccaggccacactcacctcatctccggcggccacgcggtattactccagggagtactcaggtctcaatcacatcgaaagccttttggatactaatgaacaccgcattttatgaacagcatacactgcatccgagccttgcgggaagaagccattaagttatcacgaagagcagcggctttaacaacttgctgaaagcccttcaagagaaaggggaaattcaacaactaacagctctctgggaaagtgctgtccaggatggaatcactctcatcaccagcgaggaaggctttgcacctcctgccccacccgacgaacccaactaacgcgctcgaccccccacacaacccgctgcggagacacccggccccgtacctccaacaacggcgggtgaggcggaacgagctactgtagattatatacgacgcgattaccgccgtgaacttctatcacaactgccggcagctccgccggtgcgatccctgcgcactaaacggagccccccggctcattccggatggcgtaccagtgcccgtagcttcggatagtcggtagccggtgggcggatcaagtcacccttctgccggatcgccccgcccattcccctctcccccgcggagcggggtcggcctgcgtaacacccttaccgagatcgtggggctagcacaccaactagttaaccaacagatccggtagcagcactaatcctggcgcctccctgcgaccccgcggtacccccgccgcccggctcgccgcccgacaccgcccacgccacccgcagcctacacccgcgaatccggacgcctaactaccccccacaactgtcctcacccaaccgcgcagacgaggacggcggctcgcccgcctcccgtgcg

SEQ ID NO: 20645 - DNA, 471 bp, Homo sapiens
ctaatgcataagataataattcgcatttaggtcgcctctcccgccttacccccttttcgatcccgataagaggtaacttcacccctctcgccagcttggcccatgttctcggcgccatccagtcctatgcccacctcatccacgtccagcgactcatccgccgttagcacaccgttccggaaggcaaaagccttgtatgcctgcaaagctgaacgtgactcagaactttcgttcacaggaggcacggccttcgataatgcagagtgtccttcagctttcacagccatcttcactgccacaccggagctacaggcaccttcacctttaacctgggcacttccactggtcgtgtgacacaccttctcacatctcgtcttgctgccataaccccatctttacagagcagcgagagtgatttctgaaacacagaattggttttccagcccttgagtggactaccattgctttaat

SEQ ID NO: 20646 - DNA, 454 bp, Homo sapiens
aggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgccgggcactgtggctcacgcgtgtaatcccagcactttgggaggccgaggcgggcggatcacaaggtcaggagatcaagaccatcctggccaacatggtgaaatgccgtctctactaaaaatacaaaaattagctgggtgtggtggcatgtgcctgtaatcccagctactccggaggctgaggcaggagaatcgcttaaacccgggaggcggaggttgcagtgagctaagatcacgccactacactccagcctagtgaccaagtgagactgtctcaaaaaaataaataaataaaataaaa

SEQ ID NO: 20647 - DNA, 835 bp, Homo sapiens
caccctccaatttccccagaacaagtcgtgaatctaccacaagaataaaagaaattctaggttctccctctgttgcccaggctagagtgcagtggcacaatctcagctcactgcaaccttcacctcccaggctcaagcaatcctcccacctcagtctcccaagtagctggactatgggtatgtgccaatgtgtccggaattggtgggttcttggtctcactgacttcaagaatgaagccgcagaccctcgcggttgcttggttgtcatatctgcctgttgctgtaagcaggacccaaatgaacaatgggcctgttcacactggagccttttccagaatgataccatctgcttgtgtgattcatccatctggagggatatgaagcgcaaaagccatagctgtttctcagccacagcctggctacaggaagaaaccaaacaagtctggaagctaccctcaaggcaaaagaactagtagaggtgagatctcatggggaaaacatacgggataaagccatggtagaagttataaaagctgttcctcatgccaattctcttcactaaatataacagttaagaagacactggataatgagaattactaaatgcagctcactactttaaatcgctcctgacagttattgtgcaattctttctccatttcgacatctaagatcttgctacataaccatttcaaacttgttttctgcctctaaggttggccaagaaaaacctttctccaccgagttaacacgtctcaccctaaatccgggcacttctacgtggattttacatccacaacaaaatttggttactatttatgcctatcgctttttg

SEQ ID NO: 20648 - DNA, 768 bp, Homo sapiens
aatagaagtcaattcggaagtaactcgtcctagcattttttgattataccaccaagtttaaaattcgtcccttttgtcggagttcgcacgaagaaagttggaaggcagacttcaaacaacaagctacaaagcacaggaatgagacatttaaaaaatgctctccgaaattcggcaaaactcacagggcgccagtggatgctttaagacattcacctggctgaaaatacggtggtgggctgaggacctcccctaggtgggttctgtgggcgccccgtgaacgacgagcctcccgccacgggacgcgaccatccccgccgcctcgccgcccttctccggtgtcggccgcggggccttgccggcaacggtcggtaacgggcagatcccaggagcgaagggccctcagagactaccccaccaacgcactccgactccgggggggcggcagggagcgcggccctgccttcctccctaaccctgccctccctaacccactacctgtggggaaggcgctttcctccgcggagcggacacaacccgccactagcccggcacgaggttcctacttctctcgacatctttctagccgccggcgaaaccacaaaactaatctgaccacccttaaggtgctcgccggacctggaattacaccctctccgatggccgggaggcccccctcattctttgttttgccccgcattcaggccctttcaaggacaggcgacgagagagacacaagatcgctccgctggagctcataccttattgtgt

SEQ ID NO: 20649 - DNA, 834 bp, Homo sapiens
  misc_feature (1)...(834): n = A,T,C or G
gcatagcgtcgttcatccaaaaaaattagaaatataaaggaagttcgntaggaactctcgcctaggcttgagtgcagtggcgcaacctgggctcactgcaaccttcacctccagggttcaagtgattctcctgcctcagcctcccgagtagctgggactacaggcacccaccaccatgactggctaatttttgtatttttagtagagacaggatttcaccatattggccaggctggtctcgaactcctgaccttgtgatcccaaagtgctgggattacagacgtgagccactgcgcctggctccttttgtatattttggtatgcatggagaggtgtttattgcctgaacatggagcccaaattacctgcccccaccccccacactggtcagcactggagctctggtgccaagctgacctctgggatcattttgtggattctcaagggctgtgaggggaaaacatttcaaattaggcaggatgcccaattactaggagcacttggaatctccagcctcacaaacacaaccacgtctgaatgagatttatagagaggaaaaattaccctccatgaatatccctttgaaattgcccagccgagaatactcctgggagcgggcatggggatgcatcccgagtttcttcggaaggatgatgcgaagagtgcccacgctggcaccccctggatggtatagacaggcggtggggggtctgttgaagccatgcgcgcggctatgtggactgttcacggacggccgacgcccaaggatatcctgactttcagcctaaatcccctggtaatagtgaaaaaggaacggggcacttgataagagaa

SEQ ID NO: 20650 - DNA, 1163 bp, Homo sapiens
  misc_feature (1)...(1163): n = A,T,C or G
ggggggggcgncgganggagganggcacgagagggagangagaaagaaaaaggaaaagtgagacagcagaaaatcagccgccgnaaaagaagtgaaccaagagatcagcagaaacactaaccgttccccccgcccaccagcagaagcggtgtggttgattgtattaaagatcgaccccatccccgcttccatcttgacctacataatataataaagtgatatacaaagttgtatggttaggtaataggattaataaattcggagacgtcgccggcaccatatataaagtattgaattataaataggatcagttacacaagatacatgtatcaagttcgctttggagattcggtttgctacaatcatttaccggtgtatatgtatcgtttactgttgcgttgcgtcggccgcgcgcgcatacatatgattgtttatgttacgcagtgtttagtcggtgtgaggcgcccgacagggatctggtacccgcccccgtacagatacctaaaatcatcgtcctacggcgtatagtggagtgtacgacaacgagcattaaaggtcaacgataaaaacgagatgttgacgtataataccctagtcactactctattttccgcgacttagtattgtgtgctacacgccgcacgctattttttccgcaccatacggagttatcgcgtactggaaaatggagttgtgaatcaccagtgtgtgacttgtttttcgcgcgtgttggccagtttattgtcgatcatagttgattaagtgtgtagacgtattgtacggcagtctatgtatagttgcgaacgcacaaaggaaggcgataagagtgtttcgagataaagtatgtagaagacgaaaaatgtaaattcagttatccacgctcttagacgagatttggtggttgtgtatcaccgtcatattgtttcttgcgattatctcacccgccgtttttttgaacacgacgtgcagagcaaccacgttggttcttgagtgggtcattttggtatcactgttgtccgcagatgcantgtgactgtagatgtctagctgattgtgcgacctaacgtgcgatctggtgtgtgtcctacacgatcagaccgtcacgttcttgtggtaatttacccgagtgtgaagtgattttaagtgcgagcgtaagaggtcac

SEQ ID NO: 20651 - DNA, 1462 bp, Homo sapiens
  misc_feature (1)...(1462): n = A,T,C or G
tggcctggcgtgaggatagaagtcccacttactgtctccaaagagagccgacgtcaagagaactcaaactctgggctctcctggggtgggctatactcacactctgagcctggcgtgaaccttacactctctgctctggtgcatgcggaagagcattatagctggaggccacatgggtggactcgccctgagaagtggaggcttactgccagctcgaacggaaaccttgtggggaatggtgggatcacgaaggattggggggcttgaatgatgttgtgccatgtgaggacacaagggggctgcggctcttgttgtcgccgcgagagaccgatcgatgcggtgggccgagaggtgtggatgctgcgggcacggcacgctgggggtgtggtgaggcggtgtggaggagcggcgcccgttgtgctgggagcgtgagggtgggtcgccgctggggtagtgctgacgatctcgccgtgatcgtgtggatggtgctcgtgggccgccacgggtggcggtccaatttctccgcacacggagaccacgtctaccgtggcgacctgcccgcgctccccgatgtatatagacacatacttattcttcgaccgtaatcccgcactcgcctctgtatgtccccgcgctcgcctcgttcgtgattccgccccagccccctcctccttgtcgttatattcccgcgcccagtgcgcgagacgttgtcacgcgctatatcgtcacacgagactcatgtgtagtatacctgtacgacgctttatacacaacgttacacagccacgcggcgctatgntgccacgcgtctcatgatcggcgtctgcgcgcgacgatagccgtgttggccatcatatcgtcgttgtactgcctctatcccccgcccaccgctctcgtgcacctgcttgcgccacgtcccgcggatccatacgcgtcggcggcgcggcgctagcggatcatcaacgcgcgctgcgccacngcgattaattaatgttcgtcttaatacaggctgatgtgcagccggntggctccgccactgtgcgttgcacgcctctccttttgcttctcgctctgtcttgttcgcgcgcatgngtcgcgtagctgtcattgacgtaacggtgatatatcatctcgctccacacgccgttcattgaggttcatatcgctgctgacgtcatacnaanacgccgcggagcgacactcgtcgttgcgccgatacgtgctgcacgcgtagtagcgtgcaagatacacacatacgcngtagtcttgtacacatcacgaccgtaggctgcgncgtagtgacgctccactgcncgcgaccggnggttacgttgttanttacgtcgtctatagcncgacgcgcacagctgcgcgctcgtatcgagagcatacagaagagcgcntcgagccgttcgcgcgagctnttcgaccgaccacntctcgcgcattcacgagcctcacg

SEQ ID NO: 20652 - DNA, 1312 bp, Homo sapiens
  misc_feature (1)...(1312): n = A,T,C or G
gtgtgtgtgggttcccgccggtgtgtttcaactccctcaccaaagatttcaatatttatngatacattataaaaaatacctaaaaatagtgtctccccctgagcggtttgccaaatacccaggagatgttcgcagngattagtcttgtcatcatttgtccgagctggcagtcagagccaccgccaaatgtgttagtcaccaataagtcgatcttgattataagtagaattatttagcgttggttaagcaattacccgcgcgcagccaccatgcttcattcatatttcctcgttgttaacggccgaaagaaaaattcgggtcggtgggcgagccacccacctcgagccaaggaccccgcacccaacgaacacaagttagactgacaaacccacgcagaatttgggtcgggcataccctatatactgcgaataattcaccgccgaccacaaggagccggcgacggtaacaatgatcgacggaaattccgccagatagagcagaagggctacttaattatcagcatagaaaagtatggaattccgagagtataagaaacgacaaaggacgcccgagacaaagaaaaactaattttcgcgctatacaaccattatccacgtccgataaaagcagtattgcgatatagtgatacttttctgtgagcaaatgaatactttccactatgtgggcggccgagtccggttaatagttctagatataatacggctcgaaaggcataacatacagtacccaaccatatgcaagaacgcgaggactacgaaaagataaggtcaggacccggggtagactataccgattcaataaagtgattcaagtatatataatataaccgccgataattttacccgcccgcggtaatcatataaagacgaaagacccctagtccccatattaaatacctatcaaatatatatatgcgagcgcctgcactggagaagcgcggtatatcgcaaccgtattggagtacctgttaacgaaacaagtgattttaattatatattaccgcgcgcacgattttntacccaccaatctcataatttatacactcctcgtgctagcgctgctgcagctntgtagatattaccagaatgacaacagtacaatgttattatagttagcgtagcgtctntcccacagttatcactaccgctcccgccttatattaaagaggagagggacacaagtggccgaaataagatattattagtttaggcgacatgcaacaatncaacgcacagaataaatagaaaagaccgagccaacactcgctgtcgacagacagatcactacctat

SEQ ID NO: 20653 - DNA, 1978 bp, Homo sapiens
  misc_feature (1)...(1978): n = A,T,C or G
ccccnnccccnnnnnnnnnnnnnnnnnnnnnnnnccccggnnttnnnnnntttnnngataaaaaannataccncganncaannnntngtcaaannanaccagaanaaanaagagnataacgacacaantggagacgcacggtcctgtcgatcacgacangatagcgatggcggacgccgagcatcagtcatacatatgacgcgcctaacancagcactacacgcaacacagcgntcgtaatatgtgtggtattgttgtctattatagtccatgtcgcgccgcgacgttagcggcgatccgctgccgcgtgtcgccgcgttcacgttatcaatcaacaacacacgtcacagcagacgcactnagtagggtaatggtacaggagatggtgatatattcgccgagatgttatttaggatatatatctcagtcaccacacttatgcagcctcacccgtcancagcatcaagcagntaattatgtcgtgtgtgatattagtgtagtagtgtganacagcnagtatatcttgagttaattatacggctgtccgncgtcagactcgacatgcgncgtcgcgcacagnatacgctgcgcgatatatgcagtcactgattacagcacagatgacgacacagtcgcgcgatctatgtaacttatnttgnctaccactatgtgagatgacgananaccgtgaacagacagtcgtnacancatttactcgnattatgaccggtcactcgcgctcccgcgcgcgcacacaggtagtcatacagacgacggcagcnaggattcagtagacaagcgcccaggtcagacccagaacagaaccactctcaaatacacaccacgatgtattctcgtctgtttaacctatcctacaccaaccgatttaatacaatagcatgccgaatgcatattgtacagcagacgtagcaatacgtatcgcgcacgactgttcatacggccagcagatcctaccgtcgcacagcgtatgatcagagcggcacgcgacaaccactcgcaggaccgtngttaagcaccgatttatatgtacgtcccacacaacttccccactccgccgcatgtgagagttcacgcgcatcgcgtacgtcttgtatgatttatacgcacgccaacatgcacgccaacctgtatattttatgtagcacgccgcggctgttcactggccatagtcgcgagctatagaggagagatatattaagtggacgttcatacttataaccgacaataacgacgttttatgtatctaacagtgcgccgacttattgcaccgcaattatatataatagatagatccagagaaagaaaggacagtattgtgcgataacagaagacgcaggtacatgaaatgactcaaggacacgcagacagcacgatgtgttgaccactcactatgccaaggtctacgggcaacataatatggttacacatggagacaacatacaatccacatgtnaacaccagncgactagccgctcagtataagtactctacaccacgggtgtctataacgagcagtgctctagtccttcgactgtgccnacttgtcnacgtcgagctgcgtagtatcgtcaggtatactgtgatttgtagngcgaattgattgtgacgtcgnacggctgacgtcccgatattctntaacgaccacnctacgcagtcatagtatataaatntgtgcgaacttctccagaccgacaccacacgagacgaccaccgacagcgtcgtactgttgtaccgactaatantcgagcgtagatccggtcataagtactgtctcacacaagccataaactcgaaggtatgtgctgcaacacacagccactcgcagagtccataacaacgagacatctatgcgtcagtatngactaggtacgatcaagagacagtatgataacgattacgcaccacagtcactcaaatcatacatattctactcagcactacacacanatgcgcacc

SEQ ID NO: 20654 - DNA, 2063 bp, Homo sapiens
  misc_feature (1)...(2063): n = A,T,C or G
tttttggttggngttttccnnccctntcnnttttntcnnttnnctcccnnnntntcnnntttcctcgtcctggtatnttgcgcattcttcctcntatttcnanngctcgctgcttgcnnnnnngtcgtggtcacgacgttcgccctatgttactactacaatattatgtatcacttcttgtcgcattctacttcgaatatgtttgttgctgtctacgccgcgtgttgtatcgcgntgataggataggacnccccaatcaaggagtaaaatacaatacaatcagactgtattggcgggcgagcgcgcccgattcttccctcccactccctattaatgattcgatgttctgttattttgggttgtgtgatcactcacttaattatccntatttntcatttgtcgttgtacataagttgttacaaacaccacacagttaagtaaggcgcgatggatgtgcgacgcgaacgcatacacagctagtgctacgtatatatatggaagtgacaactaacatgaggacgcgatctcgttnatatagtgtgacgagatgatatgttggtatatataataatatagtgaaaatgatatataccagccaaaataatacataatctgttgtcgtgcgccgtagctcgcgccggcagtacaacgataatatacgagctgcttaaatcaattactacacttaatgatctataagtttgctgcgacgtgcacgcgccgcgggctgcaattcatcgaggcgcgcgcgagtgggatatattnattatgcgtgtagtgagctgtcgcgcacgtagagtataatatacggtatcattattgtgtgacgttatagagtcgatggcagatgcacggcatcgtcgtaatttacagcgagtcgcacgatcgagtggtctattaatctctcgacgcgacataactttagacgagtgatagatagcgcatntagttctatcttatatcgacttcaatgagattcgtagctactacatcacacactgatatataatttataganattcagcgtatatatcgaagcgagccagagcacgagtgacggtccgtgcagtcgacattcatacnatatcgtctatcgtaccacgtagatatctcatgctactatagtgcatacangccatgagatattgcgtatcatgtgcgagtgcaccntcacgtgtatattagtcgacgctgtacntcgtagcagtgttagcgagatttgcagcaataagattcgtcgcgtngctcaccatagcccngcggcagatctgacatatacgcgcgtgtgaagcatnatatagtagtnattaanattatataaatatattgccacgtcatcgcgcggcgagcgctgagactatgtccncagcagctgcgtgttagttatagtctgatatatctatatnatatatatcgcagactgatgntatcgagtagtgcgtgtatnataagtattcatcagcacgtntgatatgtatagtgttcntgtggcgacaggnacgcgctcaatagttcgagcngttatggtgcatgagcgctgatattagcgcagatgcgtgcgcacgattaaggagagacagagtatgttataatctantatnacatcagtaattgcgcgcgagcacgcgtatatgagatngacgcgcagcacacgatattnattatatacantacgacacgctcggcgngngtcgcgcgcgcgtatatcgactgtagtcacgatgcatcatntacatgttcantnctgatagtaganaatagtngatagagatcacacngagacgaactaacgnntagaataataccgcacatggacgacgcgacgtantattagtagtantaactactgcgtgagtngcttgctncatcgtgtacaccaactncntcattcatgcatcgnctgttatctgnctcngttactatcactgngacancgtccgacgacgacagacnagacgatccatattatcatgctgcantaatcanacatctctcacgactncgntcgacgtagtcngatcgtccntacanacncgtcaantagtactgtncataacataatt

SEQ ID NO: 20655 - DNA, 885 bp, Homo sapiens
gggtgggggggggggggcgtggttgttatttccttttaagaaggatcgtcgggtgcggggggattgtgagtatcttgaactcccgcgcgatgtttttgtgtgaggagtcccgtgcccgccgttaatcgtgtttggatatgtgctaggggtagttatgatataaaaaatccatcccgccgactggtttaagatttaagaagatgattcgcccgccgttacgtcgcttcccttctatcgggttcggagccgggcggtcatcctagtcttgaatgcgcacccccggtattgggtatgttgtgccggggtggggggtttttagccactttaaactgaaccgcgttaacaaaacacggtgaggaggcagacaattaggtagtacatgaacatcacaaacgctcctttatttggtttgagtcccctagaacccatcttccacctccattttatgacccaacgccccgtgatttgccgttaggggttggggacgtggtggtttcgtcttgctcgttcttttttaaggcttttaccggttaaggagtaccaataggtgatatcatacatttacgacccacgcgtttatctctagcttcacggcatgagtaggggatggatgtagaaactagggactaccgagaaaaactgagaacacgtaacccctcctcacgcattaggcaaatctgtgtgcgtgggtgggacgttcccggtcccacggcacaggttaaagtgcaggggaaccgagaatccgggatagggttcccttcaaattattacaccgtgaaaaaagagacgttgcgggaattgaacaacactcgtatctggtgaaacgactcatcagaaaagccgcggacgaaccaccagcgataatggtatccccaattcattcaa

SEQ ID NO: 20656 - DNA, 876 bp, Homo sapiens
cgcgcgcattaccaactcagacaccaagacgaagaaaacagacacttcaggacaactggctcgattgtagcccttgataaccttcttgcctgacactgtctcattcggtggtatttgtgacctctggagcacatctgatcaatttcttgatctcctggcaggggatgataaagaacatgcagtactattgcgtaattactttctgtctctgggtaagaaggcctggctgttgatgggcaatgctattcctgagggtccaactgcctatgtgctaacttgggagcaaggtcgtcatttaatacggaattcctgcaagtggacattgttatggacaaatcgattcatttctgcaccttgaaaaatgtgcgctgtttaataacgttctgactatatgtaggcttaacattccaacgatatgtaatcttccctaaggatacaagttcgatgataccatgacccaacctatgagaatagtccctttacaaataagcccttccgctatcatgcgcctgtcgaggggttcaacacttgagaattcttattccccgccgcttatcaccaagcaaccagccacgtgaatttaaattacaggtaaagctaaacttctttaatcagaaagtccctttgactttacgccccccccatttcgacccgaagcgaaaatattttagaaccctttataagtcagtgaactttgttgacacctagctaaaatagagccacggcgtgcaagagtgagtatatggaccagtagactgatcgttgtcccagagagtaaggtattataagccccctcggattttcatgtttctttgcctttatcctacattacaaacttaacctgaggcccgttttggtctatggttcaataattat

SEQ ID NO: 20657 - DNA, 847 bp, Homo sapiens
caaaattttttttagggtagcacccaatatttttacaaaaaaaaacaatgtcaggggcacagtgccctcgatttcatgctggaatccccgccgcagcctactcagaagacatcgagcggttctgagagcctactgggcacgttagtatgagtgctgtaacctgaagtcaaaccttaagattatggataatcttcggccaattaatgcagagtcagccattcctgttctctttgcacttgatgttgtggtgatatcattaaagatttttttttcggtcaattactttgagtggcaaaataaaaaatagcacataactgtatataataagataacgatcctacaagttcgttttgtcatcaccacataatttaaatactgaccaataacaaaatataatgccgcaaagaatgaataagtatgataagcattccccgaccacttatcattgcaacaacatgcgattatctgaaaacctaaacaataatcgatttacaaatatcacttataccaaattacgacgactccattcaaatatgtgaaatagggaatagtggaggcggggtgacgagacattcaccgtgctttacaccgctcccgtgaagtatattatacataaacctaatatctaatagaagatccatttataaaaatagaataaaaaattctgaaaagatcgattataccaacctacacgggtcaagtgtaatttctattgtgccagcgatgtttcaaatgttattattatgccgaaattaactgtaagtagtcacgacgacatcacacctcgttgcttattactaactcctatatcactcgctgttataaaagtcactaatatataagatat

SEQ ID NO: 20658 - DNA, 1177 bp, Homo sapiens
  misc_feature (1)...(1177): n = A,T,C or G
ctttgtcctgtctctgcgcagtgtgcgtgtggtacgcttcgtgtctgctccaattcttcttgtctccgagtctcgctgtcgccgctgcccgcacttgtcggtgctgttgcggtgttccgtctgcgtacctgcggcgcgccgtcgggtcctctggtcgtcttactgctcttccttctctgtcctcgttcctcctgctggtctctgtcccttcgccattgtggctcgctcgcgcctccgtcccctatctgtgactcttcttttgtcgtcttctactcttcttctgtctcctcgtcactctctccgcgcgctcgtgtcnctggctgcctctgtcgtctccctctccgctccngccctctgctccgtgtcttccctccctcggctnggttcgtgagtcggtctgctcctactcgtcgcctgtccgctcgcactctcctctcgtcgagcacgtcagcgcttcgccctcttgcgagtatgtcttgtctgtctcgcggcgggcgacggctggcggtgtgcgctgctctctgcgctcctctctcgtcctgtgctgctcggcactggttttgtatatttgttctcttcttgtttattgtcgttcgtctcttttggctctcggcgcttctgctctccttctcctctcctcgtccccgtcctccgccctctcgctccccgccagcacactgcccccgctggcgcgcgcggcacgccggccggcggctgtcttgttctctgcgcggttcgttcgtctgcccgttctcggtggctcgggtttgcttgctttgttttttctctctgtaaataataagttctctggttttcgtcttcctttctcgcgtcctctctccgtcattctcatcttcgggtgtctccgtttcttgctctgctgtactggccgctcgcagcgctggcttgcggtatacagatgcgcgtggcagagtggttagtggtttgcttttatatggacgggcgagtgtgtagtttagaagaaataatgttctcttaaataacaaaagaaaatatgggaatatcaaaagaaacataaaaaaaacaagcatcgtgtcctcgcttggccaaacattcggtggcagatgtttgcccgccaacggccncctctttttttttgtctccctctcccgtctcctcccnccccnnccttcctccccnnncttttcctctcccc

SEQ ID NO: 20659 - DNA, 804 bp, Homo sapiens
  misc_feature (1)...(804): n = A,T,C or G
tttttatcttaatcttaaatttttcaccttttttctctccagagggtacagcgagagctgcccacggacgtgtctattatgttgaccacataccaagaccacctttgggagcggccccttcctccagggtaggtcatcaactgagaagacctgagactctggaactgacaccatgagtcacccaatggcttcttgaaacggtccctttctgcggaggtagcatagcacagtgacgtttattccgggtcacttgattgcttttcctatccacttaccttaattgctcccatgtcttaagactgcctcgttttatgagaagatctctgggaaacaaaaggcgcatgggaggccaatatttatagtgttgatgcattccgacaaaacatatgcccagtctgtccctaaaggcagagtgctttttattcggcagggctttgtgagaatgccgccaagttatcacaaaccacaggaagataaagtgcttccaatagagggaagactgtccatattcaccggaaagggctttggttaccttgtctgtcaggacaaaaagttatttacacattggtttcctgggtccggtttgcttttcaaaggggatgtttatttttccaagaaagattcccctaccttgatagaatcctaagaaagcgcccctgctctaatccggtcacttacgctgcccttattctgtagngggataggttcgttttatttgacactttataagtatcctcgatgacctgtatggtatccctcttaaacatttatctaccatacctctacctaacttgttgccactat

SEQ ID NO: 20660 - DNA, 820 bp, Homo sapiens
  misc_feature (1)...(820): n = A,T,C or G
tttttatattaaatgtganttttaaannntttaaatcaggacacattgaggcagttctaggctatgactttgatgtgcgtacaaggaagacactaaatttattatttcacctccgtgggatttcagggcatgcgaagtccaaaatcacactgcagaagaaacggggcttacgccattggaaacctcaaggaaaactccttattccagaccttccttggaagaaacctttgagatggaaatgaatgaaagtgacatgatgttagagacatctatgacagaccacagcacgtgacttcttttctttggtcctggctccactgtaccatggtagggtagaattccttcacatcctctgcatgacttaagactgacccacttcataacgtgactccaaactgcttctatacatttatgaacagagacccgccttaagagactggactgcacaccatatgctacaaatgagttctgaatatatgaacctacacattttttatacataagtgacatatttatggtataccatcaaaaaaaaataattatgccttatgtggactccacagagtagctattctagtctttgtcccttttctgtatggttaattcatgatccttgaatcactgactaattaagctacggtccgatggttgatatatactgcattatgctaattaaatggtgctattcaggatatacacaaaaaatggggacaacgctctaacgatgctgtcttcttaatgttctcattgggctgaacactttatagtcccctcttagtggattaatcctaagtctcgaacctctatttatactgtttat

SEQ ID NO: 20661 - DNA, 802 bp, Homo sapiens
cagattgctagtgtgacgtacctttactgcgcacgacatcaagggcagggtgcttactgatgtatagagacttttggtgtgctatccatgataggagaatgagagaaccgtgaaagaagaaggatgctctatttagaggcgaatcgatagatcacatctcgagggaacaaatatgctgacgttgatgatgctaatacgaaatctgttttacattagccgattagttatagctcgtactggatagtgagactttaatatgtgtatatacatcggctattgcaagattatgttctccagactatcgcttggtcggattgcagaagaatttgtgagatgaatactttttttaatgtgcattattaaaaatattgagtgaagcttattgtcaactttattaaggattactttgtctgcccaccacctagtgtaaaataaaatcaagtaatacaatcttaaaaaaaaacacttaaacacagatgagcggaggctcgcgcactccttccccttgaggggggaggaatttggttaattttctttttttctctctcgccgaatggcttctttgggcgccgaaacagggtaatcttttaccgcgtctgtctttgtggggggacaacaataagccgccgagagaaaaacaaatgcgggccgaggttggctatgggggggcgggaagcccctcctagagagggcggtgatttttttcttttaaaaaccccgggacgcctggtaaaaaattctttcccctatcagtgtagtgggggcgcacacccacatgaggcgctgtatgccccggcttccc

SEQ ID NO: 20662 - DNA, 767 bp, Homo sapiens
  misc_feature (1)...(767): n = A,T,C or G
caggtggaatatacccttacctcaaccaaagcaaactcctggagtactgtaagtccaaggacattgtcatgactgcatattctgccttgtggtctgactcagacaaagactgggtgaaaaaaggaaacccagttctccaggaggatccaatactcaatgccattgctgaaaagcccaggcgaactccagcccaggttgccttgtgctaccagctgcagcgtggggtggtggtcctggtgaagagcttcagtgagaagagaatcaaataatacttccaggtttttgacttctagctgacaccagaggacatgaaaaccacagatagcttgaacaagaatatacgcctttgtaaatgtctatcttttctcatcacccagattatccatttcttgatgaatataaagaaaagagtctgtggttattccagagtttattgatttgggttgaaatgaatagaaaatgtctcatggatgggaagttttctagtttattccagattgattagcctgctcagtcacaagttggcctaagaccccggatcagaaaataaaagtatctaaacctagttttctcttgattcccgcccccaccccaaccccacaaattgacaaataaagatggttttgaaataacccttaagaaaagataaaaatgtttggctccagatatcggtaaaatatttaacaacagttgagcttataatttttagtcatgccgttggccaaaagatgagntacgctttttgtgcctaatgaagggagggtcac

SEQ ID NO: 20663 - DNA, 462 bp, Homo sapiens
tgaaaactgacaactgtttagtatcaaagccaaagatgaaaccaaatataaaaccactgatgaaaactaagtgaaaaatataagcaaaatagaagaaaaataaggtcgttatttcaagaaaacgaaagacggtcaatgctgttctttgtattcacatacaatttggttcacaccagaatgtgagttgttctctataagatgttattaaatgttcctaagaagactcgctttagaaaaaaacagtattcctaaggcatgtccaatctgtctcttttcttaattactatagttctactttattattataatgtattcagcattaaaattcattatttcccaataagcttgactttatcttataatgaaatacaactgtcttcttggtgatttttataggagatattatggaaatattttattaacagaagtaaataaagtgtcatatcatttggcttttcaaaa

SEQ ID NO: 20664 - DNA, 829 bp, Homo sapiens
  misc_feature (1)...(829): n = A,T,C or G
ttatttattacttcagattgatgattcagcgtttgagaaagttngggaaacttcaggttaactccattcacaacctatgcagtccaacggaggttatggaggtggaatgcctgccaatgttttaatgcagctcgaggatacgaaggcggggtagccctggtcctttctctaaagtgtgatggcaccttgttcaccctagtcgagattattccagtgatgaagctactgttctgctctgaaaaaaatactgtcagacgaatcctgcatttgcttgagctggcatgcatgccttaggactcatggaccagatccttcggatcgacactgaattttcaatgttaatcagtttggatcctgatcctcggctgaccctttttgtgaatagctaacaccattatggcacttatttttcttctatactaaacactcttgtattttactaccaaccccactggtctacaaccacattgctaaccatagcacggctattatgtcgtcagtaagccatgatctcatgctatttacggaggtacgcgacccccaagtacacttgacattcaatttttgctagccgccccgcaacttgaagacaataatcgtgctgccatcgtaagtgaagccgccgctcagcgccaatacccccggctctccccaattgctatgctaggagttctgtccataacacccagcacttaactaactttaactgcggaaacactcctttttacttcccaccacaacccccgcgaatctacttcaccacagcccacttcggtgccattaccgccattccataccccctcacccctccctcgacactccataaaag

SEQ ID NO: 20665 - DNA, 303 bp, Homo sapiens
agctcctccaggagggagaagagggactggaactctgcttcgaggtcctcctgcaccttcgccgagttcgcctgggtcggaacagccagaatcggccaaagcccgtgttcagagagggaacctgagacctcccacaggcatcaacagcaatgggccagttcctaaggctgcaccctccagctacctcccctccctttacctccccaggactgccccaccgccttcacctccacgttcagcagcatctgtttcagggagtagataaagctctgaatttcttcattcttcacaaaaaaaaaaaaa

SEQ ID NO: 20666 - DNA, 847 bp, Homo sapiens
  misc_feature (1)...(847): n = A,T,C or G
gggggggggganagtggttacgggggaaatagtgtgcgtgnttttaggcttcacagacgagcatgtctattcatcactttgagaatgctccatcatgatgttgaagagggcatccagagtatcggggagggactggaagaaataacaaaggttgcactacttcagaaacaagacaaagtacaggtgaaccagcaatcccactcctaactatctataagagaatgagagcacacatccaccacatgtcatgctcaaaacgtctagagtagttttactcatgagagggagaagttggaggaacccaactgcccatcaacagcagaatggatgcacanatggtggcatgttcacactagagaatactacacagctggactaaagtgcaaactaacttgcacaggcagaaatgaggatgattctcacaagcattatatggcgtaaaatacatcaggcacagaaagtacactcttcactattccattcttatgaaatttgagaggaggccaaaacccatctacaatgatggttgccaggacagtgattacccccgggggactacttggctagaaagggggatgagggaatctacctataatgggtgaagtgggctcncttccttttctgggggggggaggcaccatggggggtaccgtgggtaaaattgcattttcctaacctttaagaaaccgggccggctctattgaggctgtggattccaatccaaggaagagacttggtaaaaaaaaagaggaaaaaagatgcgggaggggagacaccanagggggtcgttccaggactcggcgaggagggaaggctttagacnattaaaagggggggggggagggct

SEQ ID NO: 20667 - DNA, 875 bp, Homo sapiens
cagctacggtctgtatgtgatggtcggggcacccccccccgtcgctcaggcatgttgggacgaaacacggggagtcctccaggaagaaggatgaagaggaagttcagagcaagcaccggttaaggggcctggggagaaaaatctatgaattctacaatgcacccatcgtgaagttctggttctacacactggcgtatatcggatacctgatgctcttcaaccatatcgggttagtgaagatggaacgcttgccgtccacccaggaatggatcgtaatctcgggggggtttcaccctgggagtagaaagagatgagagagattctgatgtcagagccagggaacttgctacagaaagtgaaggtatgggctgcgggagtactgggatgtgccggacctcatcgccgtccttctgggttctggcggaatgatccctttgggtccaagaccagcccttgaggagtgacgggaggggaactcactgcgggacatgatgtactgggatatgcggggcctagacagctttgggggtaaactaggttttgggcgcggattggatgggggattggagaaattgatgaaggcacttgaggtcttttgccctcattcgtggcggggggctccgaatgaggttgtgggggtcggcacgggatggcgttcttttgtcgcaagagggggggccttcaggggaacccgggcgagaaggacttcgtgggtggcctggtggaggaatgaagggggaaggggtggccgaccacgcgggagggggggtgtggggaggccggatcgcggttgagggggccggggtctagggcgagccgcgggtggttccggtgggatgaggtccccgcgtgggcatgtggccccgccggattta

SEQ ID NO: 20668 - DNA, 871 bp, Homo sapiens
  misc_feature (1)...(871): n = A,T,C or G
acggaaccacagcatagaatactataataagcgccggcggtgatactaacacgaagattatgtatgttcataaactaaggagttgcaagaagaacacagaaaccagatttattgtatacagtgaaagaataaaaagtactactcaaggaggatggcgctctgaaggaagactgacatgttcctggaaggaaaggatgaaaactggggtccatatgtgatattttctcatgtcaattcctctacattaactcagtttgctaagttgccctgattccaggggggcattttcttatatgttaaggaaatttttatactgaagtataatattgacacagaaatgtacataaatcattaagcatacagctcaattaatttgtaaaaagtgagcacacccatataatcactgcccacccctggaaatagaaccctagcaacaccggaaagcctccttcatgctttttcaaggccttgattccttcccaaaatgcaaccccaattggattattattggtatatataactttggatatgtttaaacttgtataggggagggtttaaaacatggacttctttggtgccctggttcttttagatacaaatcatgtttgggggccttcactacacctgggttgggagaggtgaggaattcattctatacattcgcccatccttatcccggatacaacatttgtagatttcctcccattaagacggaccatggcggctgtttctgacttcagaggaagttgcaatgggattaacataaactctacgcgtcacgtaccccactcctgctctcccgcaccgacctagatgcccggtccacatggtgttagacctatattnttgtttcatagtgatgatgactgat

SEQ ID NO: 20669 - DNA, 777 bp, Homo sapiens
  misc_feature (1)...(777): n = A,T,C or G
aggaaattgggacacagacacaaagagaaacaatgtcatgtgaagacagaggcaaagagtggagtgacagatgtacaagcgaagaacctcaagagcgccggcagttaccagaagcttagagttagggaaggatcataatctgaagcaagtcctggcctgtcaacatgttgatttcagactactagactccagaaaaccatgaaagtggacaatgggaactccagctttgggacatcagacaaggcctgctttcactaaactaactggacacttgtcattcgtaaattgacaatatatgtataggactatttctagacaatgtgttttgttttattgatctctatgttaattcttacaccaatttcacattgtctatattagagttcctagacagaaagtctcaatatcaggtatgagtccttaatatttgttattgtttatcattgtaatggatatttgcattttttaattttcccatttaaatgttgaaatcagattgtcaatttctggcaaaatcatcaactggaaaagtggtttaaaatatttaaaatccataaatcaacttgggaccatataaaatgttaacataataaaatttttgattcataaatgcaacaaatatcttcatatatttagttttttctcaattttcccatcaatttttatagattttagtatacacatttttcttataatctgttatacttatgcctaagcatttcatattntattctattgtgaattaagtcatttttaactttagttttctgttgctca

SEQ ID NO: 20670 - DNA, 140 bp, Homo sapiens
acagagagagaacatgagaatcaccggaatacgaaacttccctgttggacttcccaacattcttgaatgcaccaagatagcctcttgctgtgagattaataaatgaataaatgcctccatatttttcaaaaaaaaaaaaa

SEQ ID NO: 20671 - DNA, 718 bp, Homo sapiens
ggactggttggacaatatcccttcttgaggtggagacctgtataagatgacctctgcagtctcggactctgttggcacagaacaatgacgaaggatgtccttgggaggctaacccccggcagggaaaaagacttactcctggatcctgtggctctcccactgcattatttacatccttacctgctggggaatcatgaagaacgacagcatgaggagcaccactgtcaacaggcttgtgagcgtggcttggatccttagggggagaatagggctgtgaatgaagtgtgcaggatagatggtggatttattattcactctgagaccagttttttttttctcattagagtactctcgacacattcacattatgagtacatgatgcataccacacagttgagccaaacaagggaattattatcaagtagaagaatatggtgtccttgctaagggaggacgaaactctcaattaaattaacccccgagatgttttctttaagcttttttaagctgagagagtaacacaagagggaactggctatttattgtgaaacagtatctattctaccccaagggccgggttttgacctctttccctttaaagaatagctttctccttaaaactgagatcaaacagacccttaaagttgtgtcttttaggacggaaaagaaaaagcctatgactatgcccttgccttttgaatgaaacgagctaatgccc

SEQ ID NO: 20672 - DNA, 790 bp, Homo sapiens
  misc_feature (1)...(790): n = A,T,C or G
cctagatgaaacaggatgtcactatgtggccttgcatggactggcatctgttggttcaggagatcttcctgcctcaaccttccaagtatgcctccgactatgagcccttgctagtacacctagcggttaatgaagcgcgagagaagttcatttgatggacgcgtcctatactaccagcagaatgcatatgatctaggatggcaactgaagatggcgggatccacagtctgcactcctaccacactatgctactctggctctaactatgaggaagcaggggcatttttttttttcttggtgactagattgataagatgacaccgttcgtgggtcctgatactctaacttatacgggactgcaggaaccgatcgctactatctgctgactgtctcattcaattaacagagactggaggtcatcctgtagagcactgacggattttatctgtctgaacctgngcagaccacgtccaaggcattccatatgtgtggatcttcgcgtgtgagcatatcatccgggcacatcaaactaattgctttttttgttctaaaactatttttttaatcatcagatttatgctagctatatgggtattagcgtatctgggccttatggctctaaaagggggtctactgggccggtacccttgagggagggtaattgaagaactgactaactgatggcgtgcctaagacggtcagcttgtggaaagcgaatcaaatcactaaaaggcgtgctttcggttttgcccatgaggccggggtttactctggattaactggggagcga

SEQ ID NO: 20673 - DNA, 771 bp, Homo sapiens
  misc_feature (1)...(771): n = A,T,C or G
tagctgcagccactgcatgaccctaggacccagatcccccacaggctttgagaagatgaccccaagtcaagccgagcgcatatgagagcagtggagaaagagctctgtttctgtcttcaagagggcatactgcatatttcccagagacaaaagggagcatcgaacccaatgccagtttgctaacagagccttccatatgcaagcaccagagttctatgcttcaccaggttggtcatttgtggaatgggaacattgaattgcaagatgttgttgattatgaccaggagtctgattcatatgctaatcagtgaaaacagtaacaaatactccaaattgatgtaccgtacaatttatcatggctttgggatgtattttggcacacagtgtactacagtgattctaagatgaacattttaattttaaagtctttgcagtcattgatggcatgttgtaatttaatggcacataaaacaatggtgcatttttaatcgatgacagattcgatgaaatatggctcatgtagattttaaggtaactgacagcctgnaaattcaaatcattttgaaccaaataaagtatgcatgaacatcantnnnnnaaaaannnaaanaaaaacaaaaaaaagaannaaaaaanaaaaaaaannaataanaaattttntttttttttttttggttttagtatccttnnantcttcttctnnccctcctacccgtttttaaggccccaccttcccgcttgcggggttatgtgggcgcccacctatcctcc

SEQ ID NO: 20674 - DNA, 780 bp, Homo sapiens
cctgactgacatgttaagaagatcagacactcctggaaacgtaattgttaattttataagctttataagctagattcatcttacatacctgaaaaattcaaagttgagacaagccttcggcaaaaaaaaacttatcatcttgtttgaaccaaagtttgctcatagctgtatcctgtgatggagaaacaatttggttagggaaatagaggcgcattcagcaaaaatgttcaatcaaatcactcttcaagaggaggaggacagaagcaatagttagagttttgttctggagttgctgtcccatgggccttgaagcatactcaagagtcagcaggtaggaagctggagacaaagactgcagactcctgtagcagagtgaaatctgccttctatttcccctgtattagggagatgggggtacagtgaaggaagagacagatcagagaagccaataccaactgtcctgtcttcgtctttctggacactaggaggaaggcagaggcagaagtcccttgcaagcgtatggcagccagcttccagggtggcccacaacaatccttgcctgctgaaattcacagccttgggtggtcccctcccacactacaccagggttggtctgccttactaacaaaatatgacagaattaatggtatacctctgagactgcatataaaagacaccgcggcttgcatcctgatcactcacttttcctactggatcactcactttgggaggaagcctgctgccttgtcaagcaactctacagaaaagtccctgtggtga

SEQ ID NO: 20675 - DNA, 855 bp, Homo sapiens
ccaacttcagtaatcggctggatagctctaaagtcgcaagaacgagtacgtagaatgtgaggccctactggttagcctttttgaagacaccaacctagtgtgccatccatgccaaacgtggtaacaattatgccaaaagacatgcagctagcacgccgcatacgtggagaacgtgcttaagaatacagtatgatagggaaacgtttcattctcaaaaaaaacaaagaacccctcttcttccggtaagtgggcgttatgaacgttagatattgtcttcccatggggttacatggtacctaaccctgtgattgcgagtggaagaatagtggacagaaatcaagtataggcagttttggccaatctcatttgtgtgtaaatcctgaaatcaagcgaggacacgttgaccattacggcattgaaaaatgttatatgggacttgttgggaggtgtaacctttaataaaggaattattaccacttgtaaggtgttcgcgctagcagcgcgctttgggatttttttataaattcaaccgatatactagtcgatgcgcatgatctggaagcatgtagcagtgttatacatccacgtcaccaacaagaatttaccattggtatataactgagatggagcacgtggatgttccttatggtagatgtataaagctagtgcggtggagagagaattttatattcgatgacgctcccactctacactatcgtgcgtgtgcgcttggtcgggttgtgggattcagtctttttatacagctcgcccgtgcggtggggcagcaagtggagctgaatacttgatgctttgactgcgcgacgagattagttactatttatatggttgagtggt

SEQ ID NO: 20676 - DNA, 797 bp, Homo sapiens
ctaggcaacatttcatttgttgcttttccagtttccaataccaactcacctacaaagattttaccaaaaactttaggaccaataaatgtgaatgttggaccccaaatgtgatagaaaacgggctagaaaatttatagactctgatttttcagaaagtaaacgaagcaaaaaaggagataaaaatgggaaaggcttgagacacttctcaatgaaagtgtgtgagaaagttcaacgaaaaggtacaacatcgtacaatgaagtcgctgatgagctgttgtcagagttcaccaattcaaataaccatttggctgctgattcggcttatgatcagaagaacattaggcgaagagtttatgatgctttaaatgtgctaatggcaatgaacataatttcaaaggaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacctagaagtactaaagcggatgggaatgtcgcttggcctgaagtcaggcaatgctctctggaggat

SEQ ID NO: 20677 - DNA, 631 bp, Homo sapiens
  misc_feature (1)...(631): n = A,T,C or G
cgtaggccccacttccttctgaggtgnactcccttctggccaggcctatttcaagtttgagggatgaagaattcacacaatggggctgacagtgaccaaactagaggagacatatatactccagcccaattctgcactgaaggacaaggactgctgcaaaagaaatgagtgagaccctcaaaataatgaaaggcacacagctcagccactaaggagatggacaagccatgacaacctctgatctgctactttttgcatctataaaatggtaacgctgctacttatacctcaggatgttgtgaggattaaaaattgagtaagctaagtgcctggtgtagtcctggcacagtcactaagcatttactatccttatgcagtttctttttgtaatgctaactgccctccaaattcctccaaagtaaacacatggattagtaaatgagaaagaaacaatgcttaaaacaactatgggtaacatacctgtttcaagtcgcgtagaatactgatataagaaatataaattgaccaaataaagaaatccagttcctggacccacagggaaataaaaggtggcagtgattggcctccaaatctgtccagatcaaaataaacacagcttgtagtttcgaaa

SEQ ID NO: 20678 - DNA, 825 bp, Homo sapiens
atgtaatcaattattaagaattttaaatcactaaccttacaacaaccgagcatattataacattaacagatttcgatggggtcctctatcatatttcaaattttaatggagacaaaacaaaagtgatggtcagtatttatttgaaattctacaaggaacttcaggcacatggagctgatgagttattaaagagggtgtacgggagtttcttggtaaatccagaatcaggatacaatgtctctttgctatatgaccttgaaaatcttccggcatccaaggattccattgtgcatcaggctggtatgttgaaacgaaattgtattgcctctgtctttaaaaaatacttccactttcaagaagagggcctagagagagagaacacggccaaaatccattatagggatggagaaaccacgtatctcgagtctaaaaaggaccgaatcacagttatcttcacgccaatgtttaaataagacttatatgtagtcagagcaacggtgatcactgcatgagttatacttaggccttagtagtaatgctatcagaacccctagtgcccaattagtccccaggatcctctccttgtcatctacaggactactccgccgtattcgatcaaatcataggactacacatactatcgcgaagaactatattaatacacacacccatcgtactatacataatatattaggtgagcacaaataacggccacctactagacccaccaccaagagtgccttccacaactagatcaccgtaccctgctgatcgaaaaaacagaaaagataatggatatttgcccgatcaccatatcttactatt

SEQ ID NO: 20679 - DNA, 781 bp, Homo sapiens
agcctttctgggaaccctctgtttgtaaagtctgcaagtggatatttggacctcttagatgccttcgtttgaaacgggatttcttcatataatgctagagggaagaattcttagtaacttctttgtgttgtgtgtattcaactgacagagttgaaccttcctttagacagagcagatttgaaagtctctttttgtggaatttgcaagtggagatttcaagcgctttgaggccaaaagcagaaaaggaaatattttcctataaaaactagacagaatctttctcagaaactgctctgggatgtgtgcgttcaactcacagagtttttttcttttcattcagcagtttggaaacactctgtttggaaagtctgcacgtggatattttgacctctttgaggccttcgttggaaacgggtttttttcatgtaaggctagacagaagaaatctcagtaacttccttgtgttgtgtgtattcaactgacagagttgaaccttcctttagacagagcagattcgaaacactctttttctgcaatttgcaagtggagacttcaagcgctttgaggccaaaggcagaaaaggaaatatcttcgtataaaaacccgacagaatcattctcagaaactgctctgggatgtgtgcgttcaactcacagaggttaactttttttttcattcagcagtttggaaacactctgtttgtaaagtctgcaaggggatttcttggccttttagaggccttcgttggaaacgggttttttcatgtaaggttagacagagg

SEQ ID NO: 20680 - DNA, 799 bp, Homo sapiens
agggggctggagccctgggcctagggagacctgtgaccccaggtgccgccgggagaacttcagcccagtggggaaatcagctctccgtgacccagcacccctacccagcagcgcaacagatcctgagaggagctacaggatgattctagaaacagcgcacttcaggaatcatgttgcaggtgttgtgcattggatccaccacagtcggctgaaactgacaactcaagacaagtgggccagccagcagggcccagatcatccaactctgttgatcctgagacgggaccaaactgctgccgaagacgaccgccctgttctggtcactccggaggctaaccagcctacgcatggctgaagtttgaggaaacaacaagccctgctctagtcacacactgaaagctgactagtctatgcacggccaaagcttgaggactcatcaagcaagtaaatgtagttagaaatcttagaactagtagttttccttgtaatattaactgttttactattgttctgtcactgtgctcaacctcctctcccaaataaggacctcttctgtccttactagatatgaatatactgtacattgttttactgttggtaccccaccttaccatgctagaagaaacacccatagaagggtggccccatcgtacaccttctacatggtcagaaaacagtataaccaggactctattttaccatacttattatgaggatacagggactcaacctaggaacttggactcacaatcagatcacctatgcaatctatgacccaggaaatggccacctacctagg

SEQ ID NO: 20681 - DNA, 887 bp, Homo sapiens
  misc_feature (1)...(887): n = A,T,C or G
cgctgatgtatacatccaanaannnnatttgaacannnnnttgcatgctgccatgcacactattgcccaagcattaggaccacgaggacaccctgcagcaccgcttcctcctcctcatttgctcacctaccaggcgccaacaacccagcagccaccatatacaggagctcagactcaagcaggtcagattgaaggtcagatgtaccaacagtaccagcagcaggccggctatggtgcacaccagccgcaggctccacctcaaaagccgcaacagaatgtgattgaagaattcaacaagcgatagcccagcagagcgccttttttttttttttaccagtatcaaggatattgggcaaggacgcacggtgggagacaccagctttgtgatatctctatataccacaacacaaatgccttgctaaccacgatgtataatagtacacttttaataataattaattctctatactagacatctgtatcagcgcccgtctactcaacactatacatatattatttatctatggacgttttttacatgtcgatcgttttaacggagagtctcattaaaatctccttgtaagagtggatgaacctggtgcctagcgatggttattcccttgcgtccatcttatgctatgtcgaggaccctccagtatactccctaattatgttaattgctgtcataagatacttattcactgttctgtatctcaacagttcaacctaanaacttccacagatggaaataaattagtacattattgtaatataggtattatgatagtaattgaatatctattagaattattaaatagcaatctatatataacatctaactaattagtgctgaccaccgtcattctcatacatgtaacaccgttcct

SEQ ID NO: 20682 - DNA, 836 bp, Homo sapiens
  misc_feature (1)...(836): n = A,T,C or G
tgttgtttgttcatataattttttnnttnttttgaaannnnnttcgacgaactagcgacacgacagctggacaaccaatgtgtgcgagcaatacacacctttgtgttcccaatggtaattatgaaaaagaaggtctcggggctacacaaccacataaccacaaaatcaatggctgctcctccaagctgtggtctgagcccactgctgggcctggcggtaaccgatctgtccaccctattatttttaactgaaacagcataggagggtaaaagtgccccctcgtggacatcgtaatgtgaaacgcctataaaaaagaaaaaagtttttttttttaagccgcgccactcggccttctcattattatatgggtccccccaccattatcatactatctattaagaattaaaaaaatcttgcaccatcttcacacattcccgcaaccttacgcaccagcactattactacacgttttgaacatgataaatagcctccggcacaataatccagcgattttggagcgtcatatatgacccatggtcccacacctacttttctgtttggctccgataatcactgatgaatattttcaagttaataaattaatattatatgggtccatatcctaagctgtcatagccaatacatcagaagatgcccgctatacaataaggcaaaaaccccatccgcgtaggaaacccaaatattgcgtcgtaaaacacgtaaaggtgttacacaatactgatctcacctctctgtccctattgcatcaccaccggacgaagggatagttttctcgaccgcgtagtcctggcccccaatcttttttcacccctaca

SEQ ID NO: 20683 - DNA, 864 bp, Homo sapiens
ttgtctttctcctacaatccaaataccaacaaacccggtggtcagcactgcgaagatacagttacttggagatctcatctggaagatggtagcactgctatcagccttttttcccaaatgacctcctggatcacagctacccatggcctgaaatgttgcccttggagatgctgcataggaaagaaataaacttttttcgatctttgagccacatatcatatcaccatatctccctcaacgccacttagccccctcgcagatatctacattcacctcttacaaactgtctcaattactaccacctcaaccgattcatttgctatcttattctatctatcaacaatgccattacgaattcccaggcagcccgcctatcctaaacgagaatcaccatctcccccccgaactcccctcggaaactctagtctctcccaacaccttcccctggcacatacacaattcaaatcttacttacctaccattcccatctagacacctccactccatctacctagtcaactctctgatcatttaaccatcagagtaccacatgacccagatcttccagcctctcttctctttcctcaccctaccgctatacatataaatcctctccccacctatatcttgcttgatatacactattttcaccattccttggtgttaggcccatgtacagataaccctatcacaacttctctaccactttactaacccgacgcccatctctatctcttctatcctctcctagttgcactcccaccttttgtagaccggccgccttcaccaccccggctcactaaaccaactatacacacatacccactcacactcgtgctaccaaccatgcacacccttatctac

SEQ ID NO: 20684 - DNA, 944 bp, Homo sapiens
  misc_feature (1)...(944): n = A,T,C or G
atttaaatagtttcttcacccctaaccacccaaaacatacagcccctctcgagtaanaacatttacaacagttgaagcagatgaacactaggagcagcgaaacccacaatcctcataatttatcacctagcaggctgacaacaggtgcatctgctgatgctgcctgggataatggcattgatgacgcttattttttagaagctactgaacatgctcaattaagctaaacctgcacagaacagtcttctcagttataacactgaagtggatgaaattcctcattaactcattataaaacccttactcccagtccctacctctccataaacactactagccaccataaatatcaccctgtctgatctcccgagacgcactccccacctccatcctcccaaccttccccacccctcaaccctacctctcttacctttgcattacccctccccccctcccatctcctccctatcactaccttgtcactacacacatcatgcctacccaagcccactactaatatatcacgattcccacactacctaacaccctcaccacatctcccacacctgacatacacctctgcccctaatcatcatctcatccactccacatcctcctcccccctcagccctcacctcctatatcactccctcctatccgttcctttctccccaaccacacatactccaccacactctcccctactccagacactccctcgccagcaatactcgccattccattaatcatcactcaaccctctcgctccctcaccaccccaaatcgcagatcaatatacttcacctccaccgctcctctcattccttccaattactctcctctcctcactctcatctatctctccttactcccctgtctacacctcccccgctacagaccacacgacaccctcggcccatcacacacttcacctcaactctttc

SEQ ID NO: 20685 - DNA, 829 bp, Homo sapiens
gtaaccccacataattacacacaactttaaaaaaatttaaaattcagctggctcaggatatctgttgtgcgtcctacagataccacaacctggatcaggtccaagcaaaactttcagagtgctacaaaatgttgcgttcccagtccaaaaagaagtggaaaagaatctgaagtcatgcttggacaatgttaatgctgtgttcgtagactctgccacaccactattcaaccatttgatggataatgagtctgatgactgtctctttacttggggaagaacctgcagcatttttgcctagaaggcttttttagtttttttttttacaagagtctttttatttattaccttcgtttctcgtctcgattctcattaatttagcccttcctctcctcttttttctccctttttagttacctccgcttctccttttatttttctttcgtctcttattgtatgccgtcgtttagttaccagctcagaccgattcacatattttttatctctaatacgtcatctataatgactccaaatcaattacttctgttcctcctctcttttttttatgcaccatcttaattttttttgtctttgttcctcccttatatacccatttactgtgtttttcgactttcctttgctgttattcatatttattattccctttcactctgtttcagtcctttcgtttatcttttatcacccttttctgttccagacctgtccatttttctccttctctactcgcaccccacattcatacattggcatctgctttcatgagaaagatcgtaaaccgcaatttaatttctattatttatttatttttttg

SEQ ID NO: 20686 - DNA, 1199 bp, Homo sapiens
  misc_feature (1)...(1199): n = A,T,C or G
aagaacacacaattataatgacttatataatcaacacgtgtagaaaagagtacgagtaaagtangttccaggtagacgnacaacgaatgtnccacgtattgctcagaattncatagcgacagnaacattaggatgctngggcatctcagagactagatacaattagtatataacaagagaattccgacaatcgccacacgcctatgcagccagtgctacacgttgctatgttctacgtatcgttagagtagtaaacaagtagcaacacttcatgaccggttactcgtgtatatcatcgccgcatcaacagagtacatactaacccgcatcgacaggtgccgaaaccgctacacgtctcgctgtgacacactatgaactgcagaggtgacacgagaaactggaagagcgactgcgcnactcnccgctacacggcgctcacaagatgtaatcccgtccggtcaccgatcactgacgcccaagatccgtatgtatatatcgcctgagcatagcacgcaaacatacagcgatgtaacctacactgctcatacatgctgattgcctggtgtccatatcaccggagatctctatacctcacgcgattaccgcaacgtcaccgtaccgcaccagactccgtatacatagatggcttcgcgctcgaccggcatgacgttcacacgcttatctgatcttacatttgcgccgctcgccacgtacctatcgatcctcgcgtgcgtcataataataccttcttcacacccgcgcacagcaatgtcaaccgaacaaacataatcgtctcagttccgtctttgtcgcggcgtggccacagtaaagtcagtataggtagtatctcatacgagcctaatccgaggataatgactcaccgctcgacttaaatcacaccagcctaagtccgaccgaatcaccgccgagagcacggtctacgcgcatcaagattaccactaatcactaatgatagcacacctaaacacccgcactgaccaccgctccggtccttggttcaaaggatgggcatactgcacggaccgccatagnaacagttcgtgaccgcgcctcaaactacgcactgctgccactgcgcgtccactcatgtgcgtacatagtgatttaggtagagtccaaatccgcagtcaaacgccactctctataagagacccgatcgaactccacgtctggcgtgt

SEQ ID NO: 20687 - DNA, 849 bp, Homo sapiens
  misc_feature (1)...(849): n = A,T,C or G
acgtatctttcgaggaataacagtttcctctggtacattgcaaatcgtaagagcactgtgaatgaaaataaggtagtctctcgtcgcaaccattctactttccatgcacccgtatctgcggcncgcnctttgcaccctagactcaggagtgctatccattagtaggtggaggacgtgagatgatggtatcgatttgtgaggatcgagacttggacacattagtaattcgtacgggctaaacactatccttatcgggctaggttgctgcatcttggccaagtctctcattcctgacactaaatgctcggattctatctttcataactagagattgaatcaaagaccttttgtatagttcaaaaaacaacaacatcacggcctccttggactacatggtggagctctgcctcctattctcttcacaggagtataatccatgatcctgggtctactgcctcccccattcggacccttccactttaccaactgcctcagattacttgaaaggggactaccgatctccccgcaattctcgtgaaccactaaaaacacttgttaaccagcaagtcactctcagtgccgctacccttcccacgccaaatcccccgctttatctcccaatggctagcccccctatcggcttcacacccccttgctctaaagtcataacttgcaaaatcccccactacgtccgctgcactccctgcggtatccacttgtagaccaactttacccccctctcaccaatactggcttccacccacacccccccgcccctctcgttctctcacctttgccctctctcccacccacccctccccgcacccacttccttatccattttatttc

SEQ ID NO: 20688 - DNA, 775 bp, Homo sapiens
  misc_feature (1)...(775): n = A,T,C or G
ctaggcaaactctgggaccacgtggtcagttcacttgccctccggtatgcgtgcagcaagctctggcctaactgggacagatacgcggcttgtatgatccgcctggagaccctcttcaaactattcagcgcttctggacgaagacaaggatggcatggttcagctctctctggccgagcggctgcgctgcatgtagccctgacccggggcttcagatatcattttttttccctgccccactgacggctacctggcacccccactttttttttttggnacatacatgctccagcgacatacactggttgccagaccctcccccgcctgcaaccccgccccccgccctgagcccagaggtatgcacacccgacccgccaggcccaaaagacgcccagccgcaaccaccgacgcgagcccaagaacaccctatccgctcttttgtaacaataccacagaatcgtatcccccacaccgcttagacgacgcgcactcccctccccaccacaccccacgcgtcccttcttcgagaccccttgacccacccccctacgccccaccccacagcgctactaccccccaccccccccgccccccctatccacagtatcaccttcgccaccctccccacccaacacgacaagcgcacacagccgcacgcacacgccaaaacacccaccccgccgccgctcagatagagagaacaccagaggcccccacataataatagcgttccaccgcgcgcgtttacaacataaattactataataacaagata

SEQ ID NO: 20689 - DNA, 813 bp, Homo sapiens
ttgtatctgttactagaggaaggctttgagggtgccacagatataattgtggtttttttgagacctctgcatccctcagattctgtattgatgatgcttttcatggcttactgagggaaattcgcaagaaggagtccatgccatccttgatggaaaagaaactgaagagaaaggacagcctgtggaagaagctaaaaggttctttgaagaagaagagagaaaacatttcttgttatccttgcttatgagctcctcacgctctctgaattctattacgaggacacttgcatatgcaggattctgctcgcataatatctgtctatgcacctctgcatctttcagtcagtgcgtagaggcataagccagctctgactacctcaccctttcgacaatacccccgctccgagctttcacacccagtacggcatgttcacctacctccgataaccctccttattctaaccacactttctctctcccgcccccgcgcgcgttcattttaaacaaaagaacactgcgcgtggttactaaacaacacagattaaatacacatctcgtcgcttgatcgtctgattagagtcagaggttagagtcgaaacactagaatttcatcgtctatttgttttcttcccaccacgctcacgcaccctcatacggtcgacccgtcgcctaggcggctcaagaacgcgggtcctccatcgttgctatactctatgtagttttggagtcaacgtcagagataatgcctcataagaatcgccggcaaccctccatcacgctatatcctgtcaagtcaataatagacacactcag

SEQ ID NO: 20690 - DNA, 880 bp, Homo sapiens
  misc_feature (1)...(880): n = A,T,C or G
ctacnaattgcccaggaagtctctgagcagcatctgtcccaggggagactctatccaccactcagcaccatccgagacgtgtctttgcgaattgccatcaaagttctcgactatgcgtacaaacacaacctggcttcctactacccagagcctaaggacaaggaggcttttgtaagatccctggtctacactccagactatgactcctttacactggacagctacacttggcccaaggaagctatgaatgttcagacggtctgaggcagtcttagaggctagcatggggctacatgaagcccatagtaactcccacaatataagcggggctccaaacttggcccacgttgaaaaaaaaaaacattggtctccagtcgcctcagacgcaggagcctctgcggccggcttcccctttcctgagcggacgaattcatccacctacacacccaagtcgcccccacggcctctcggtcttctccgagctgctacgtcacctcccctaagtcccacctacctccggcgacgactctcgccctcttccacactacgcggccacgtagaattattttaggatatgtccgtgttcagagacggcgcgcggaccggcgttcggatgcggcacgaggatggcacctccgggccaatcaatgtttcaattgtcctcatgtcgtagattggaggctcgcctctcaccacctcgtacgctccgtcgcgcacgtcgctcctcgatctcgagaacatcaccagagcgaccggctggcagcctcgtgtaggtttgcgtactcttctggcccgcgaccatcaggcgacgggaaactcctgcactcacagttcattgtggaacatgggctcgtgttgactattgacacgtatcggtgtg

SEQ ID NO: 20691 - DNA, 357 bp, Homo sapiens
ctagatgctgctgatggctgttgttctctagaacctcctgagaaaaagaagattctgcagcacctgtatttccttcacctgtaggaaaagagaaatttacctttgaactgctaaatttaccacaaaaaaacttggacaatccctagaagtataaatcttgccaacaggaatgttcaccgtacgaatattttcagaagtaaagtagtgaggtgtgatggaagcaaatgtgggttttacacccagagacaatgggatgtgtacttattcgctgtgtggctttgggcaagtcccttaacctctttgagtctattttttggttggttaatagagcaaatgtaacctccaaaaaaaaaaaaa

SEQ ID NO: 20692 - DNA, 877 bp, Homo sapiens
gcgtccacttcttcttcctttccactctcccctatctccccaaaataaatctagtcgctttgtggtacgtgctttccttcgtagttcaacaagtgaaggtttactactgaagattgatccattgctgcctacagaagcccaaaatgaagacagtgaaacagaccacgcctaaactgtggttgcactgcgtctattactttcccctggtctatgatgcattggtatcacacccccaacgcaccatgatttttccagtctgatggttttgggactcgtttctactctcgtacgtcccctctcattatttcttctctctcttccatatcgtctatgagactccccactcacagtcctcgtcttcctttcttctttcatcaccccaacaattaaattcatctcaccaccacacttcctcaagcctcggcaattagtttctcttccccttgcagtgcaaacgtgcacgtccactttcttcccatattccctttactctctgtccgcccctttccatctctcttccccccccttcctacttccctctcctatcccgcatcttctctctccttcttctcattcctccccccatactttttccctacttgctgagccaaattcccccatctatcacaccctacgctcccccctacccggtcgttccttccactccccgccttcatttctttcttccactccacctgtctcattacgaccatccagatacccattcctccctagtaatccccgaaatctggccccctacccccctttatttaactatattctcgctatgccagtccctagcctcttctgcccccctcctactctcgttgctcatgcaaccacctcccactctccaccgtttcgcatccaacacttt

SEQ ID NO: 20693 - DNA, 840 bp, Homo sapiens
  misc_feature (1)...(840): n = A,T,C or G
taccttccacctcccggcgtgcgggggggcggggggcttatataccaactcttanagctgtgagagaagaccaaagaaaaccatacaccagagagaaacatttcttgggcttagaaaagaaacttaagcagatggaaatgagacatgcacaaagagaacaggaacttcaacagataatacagcaaacacaccaagtagtagaaactgagcaaaacagagatgttgaaaaatggaaaagactggttcagctaaagaatggcgatttggagaagcgccgcccagcacgtcacctcgcgccggatggtttccgcgagctgcgaaggtatgtctgtgaggcgccgcggtctactcgctgtcggcgtgggggctcggtactgcgtcttttaccctctcgcggcacctcgagcgcgtttgccgtgtgcgcctgcccgtgcggcacgtaggccctctgatctctccttttgctgatggttgttggtgtgtcgttgtggtcaggctgtgtgacgtgcgctaagtagcagtcgagagggtttttgtggtgtggatattagtctcaattcctgcatgtgcgcgagctagtctactcgttataactcggacgcggtcccgcgaatgtgtcgcgcctagcgccgcctcacctggatactgagtgcgtgcgagcggcagattgcgtgatccgccgcgcgccgggcggcttgtgtgtgcgccgctccgtccctgcatccggaagcgcacgctgagcgccgccttagggaggcaggcgggcagtgcgcggagcagggtcctccgatcgcggctgcggccggttcgggtcgtctcgccggccgtagcttgccgcat

SEQ ID NO: 20694 - DNA, 1001 bp, Homo sapiens
  misc_feature (1)...(1001): n = A,T,C or G
ctgctcactatctcatatcactcctcaccttcgtgttagtatttggccgcggattttagcaatgcaccagtcctgcacatatcagatcagaatgaacagctttgtgtcagacttcggaagacctctggagccagattaggtcttatctcgccaaggcaaccacggagtccatgcctctcctttcactgctcactccatagaggcggaaccgctcggacaacagccaaattcttgccaccacaccacacacccccaactgagacctcccagattcagcacagacacccctgaccaccgggcacaacgacgtgagcaccataacctctgcttatcccagagccnacctcccccatctcttgtaggtcacgtcaacttcatgcttatttctgtgacncaatcctatccttctatttgtctctccattattcccctcccctccacaacacctccaaacccctccccnccacctacgcctcaccacacaccgacccctcacacccccacttccacccgcagccggccatcctcacctcttacatggattgtctgatctcatcaggatgctnacggagcgtgcttctccaacctttctccgtcgtnaagccacgacagataatctagggacggttgtatacgtagcccccacatcctcccncccacggcttgccctcagcgcccccccgcgttttatctgagtntatctagatatataccagagtagttgtgtgacgtttgatccccctccctcacctctcgttctntatcccgtgcatagacgtctgatacagtttctgcaagaatggacgagggatcaccgtccaccttctcatcgtccgcacnccaccttcacctcaccctcgatcagtcgcgntattcgacgtcaatcgtcctctccaccacacgtaccttccgcagcatncccagcgtacatacgcgccccgagacgcccgactacacgccttacatcctatcgcccgttacgtgtaagtaggtgctctcag

SEQ ID NO: 20695 - DNA, 1397 bp, Homo sapiens
  misc_feature (1)...(1397): n = A,T,C or G
ggatgtgagaatganagagaagtgtaaaganagaggaaaatgaantaaattataatgtaannnaatanaaanattttagagnaaagagaaaaattaaaaatannnnnaaaaaaaaagnnnnaaaaagtaaataanaangaatatgtanaaagaananaagaataaaataaaaataaatgaaaaatagaaatgananaaataagagaagatataaagagaaaaagaaaagaaaanaaagtaaaagaaaggtgagggagaaagagatgatataagacaaggttttatcttgccgatgaaagttatattgaaaagacaaggcanagagatatgatggagaggaaaagatgtncaaaggtgtgagatgacatagagtaagatagttataatatattttaataatatatgtaatatatgatntnaatatattaatatatntaaagtaataatgaaaaagtcataataccaatcatattaataaataaaacagnccaaaagagaggaaagatttatgaacatgagcaagtttaagtgtggatagacgctatgatgatttaaacaataatcaataagagaaaccacaacattcacaaaagtgacaatgcctaaccgcaacacacactataactacatattacaaacgtaagatcaagagccaccgcgaacaccatgtacgagaaaggatataaacataaatatnaccgaataaagaaaggagcaacgaacagacgaagcaagagctataagtcgaatgaataagatctaatatagatattaatagttatctgtaatcttctaataatattgtctcatctatatatcattaactatataatatgtnnctgttatnagttgtagtcgatatgttnnctactaatgtncaattagttatagagttaatgtgataagtaagttgatgagagatcgtaataagtgtancaaatcactaatagtagctagagcgagagcattattatagtaaatagtgnctacatagatagagnaccangaatagagagtaagatcccncgatataaggtantcctattctagtgtacacaacgctcatagctcgacgcaccgtagtgtcaatacgagtactgtcatagcanctatcgtcaaattagaattaagatgatatgtaatgtatnangtaataagacatagtatatanctacntagtgtccacngagaatgaatgatgagcnnnagcacantcaacgacgagagcgacacgtcgtatgtaganaatagtcgatgtagatgttnactgatgttgatggagtagagttagatgcnnaagtagtgcattgactaatgacagattagtntgagtgttgntgacgtagtntcacgagactacagatatgagtntagtatgatatagagacgaaagtcta

SEQ ID NO: 20696 - DNA, 1035 bp, Homo sapiens
  misc_feature (1)...(1035): n = A,T,C or G
ggtggtggttatggagattggtcagtggtttataggtcaccatagttaagagttagttgtgaggcaactgattcttaacttacctgngnacgtaccaaaaaggagcacatctcanctgatacatgtctttagaaactctgagaaaccccagcccagaagacctctttgatgagatttaacagtctcaaaaaatactttggaggttcacgtagactatagccctctagtgcattgtctttaaccgtgagtaaagtgaggaatggtgacgtcgaggagccctgatattcacccgcatcctgacatttttaattgacgtggcggaggggagatcggatgccatgtggcgcaccaatcggctggtcacctcgtggtgcgccggattacggatggttgatcgatggcacaggtgggagtgatgggatgctataaacgttagtcacttcgagggaccgcctgttacagcccagccacatcggccatggtgcctgaggtcgccagcggagggagcgtatatcgctcatgaggtaagatgtcaccaccgaagtatgagtgttaaaacggtgtcaacatgcgccccgcggttgtgggattatgggtggaaggctcgcggggagggcgggttctcatgagttgtgtaagccatggtgttaagcgggtgttctggagacgtaatgcgtcttatgagagtcagtgtgtgaaatcgagttatttgggggttataggtttatatgcgggtnagtgagaggtcagtgaggcagtaggcatattgtaccgtgtggnngcttggcgtagcggtggatggctcggcgtggctctcgggagggcanggtgagaggaaggcggggaggactaggttcatatgccttggcctctaggggggtgggtctatgggtggtgaggagtattgtggcataatagcatgagggtcttgggttntaaagtgctgaggggtnagtgggtgtggtggtcgtaaggtgctaagttagggtnttgtggagatggttgaggcncattggtgtttttagtgtgtgttat

SEQ ID NO: 20697 - DNA, 763 bp, Homo sapiens
cctaggtttacctgtgttttattcttggaaatctatggacttaccatagagatggctttagagattctacactaattctctcccaaactaaaactgagcttgcttgccgtctttcccaaggaagatggaaaactcccttgtgctgaatccactgattgggcctgccaccggacagaatcttcggatatgctctcagaacaaaatgaagtcatgaaaatgaaaagtttctatataaataaccagaaggtcttcttataaacaaagccttgctatgccaaatcacacagtttagcaacagagaagaaaggctaaagctgggatgaggctacgacagtcctcaggcagaatgggaatagccttgtttctaaccttatgggcatttttgccaggaaaaggtgaggacaggactgaagttccatccttgggatagactatttgcaagttcataaaagaaaccagaatcagagaggactcccagtgccatcttcgccaaggcttagaaggatcacaattaaagccaaaggacattgagatggtgtaggacattaggggaagagggtgcattggggaatttcattccttttcatcttctcacacggaaacagagaacaccaggatctacagaacagaagactgcctcatagtagactgtaaaaaaagacacattccaaatccatgtaaagagcattttatttctgagaaatacagagggacaaagggttaaaaaattaaacaaatacaaaaacaaaagggaaagaaggtg

SEQ ID NO: 20698 - DNA, 828 bp, Homo sapiens
  misc_feature (1)...(828): n = A,T,C or G
acccccagcatgcctgtttccgcacaatgttcagcatgatccgtgcccctccaggccccacacctgtttcttggcatgtcttttgtatgcagcccacaagtttcctggctttcatgatattcatgtgctgggtgggtgactttttccctgnctggccgcggctagaaccaaagcagtatccttacaataatctgtacctggaacgaggcggtgatccctccaaagaaccagagcgggtggttcactatgagacctgaggaggcttcaagggttgcgtggttctcaaactaggacnccctcactcctacaaancgagggcgcgccccccccataataaaactcattgcttgtaaattactnaaaatccccggccgcctttggcctcacgtgggggagctctactgcccgctccccttcagcgaccgcttaacccatgcaccctgcgctactggcttcgctgctcttcagtctactggcctaccgcgcgcggtcccggcatcactccaaggaagttaacactgtgcatcaccccactcaatggagttagccggcgagctcccccctcatgattcccggcaattcccgagtcagccccaccttagccatgccgccatgccgcgtatacactcccgaaccagttatcgaacctagcccgagagaagaaaggcccacattccggatctgacgcacccagtcacataacctattcagtgggaacacctccccacccgccccgggacgtacccatcataaccacagatggaccaccacgctctctctttcgccacacgagacgatatctgtacccacccctgtatatgtgctagg

SEQ ID NO: 20699 - DNA, 984 bp, Homo sapiens
  misc_feature (1)...(984): n = A,T,C or G
aggtcggatgaaaaaaaaaaggcaanntttcatcggcattatttgccaatggagaccttccgccacttgggcacctttcaagctgcttggttggggacccccagtgagaagaagaaaatgagccatcactcatacccatcatacctccatacattttttngcacacagtagagcggtgccacccaacggtntactacattttccagacactaggtctcgcaattagacaatctacgctccattatacacaatggccgaacctgaagcgagtaccggtcggttggactcacataccagctctagatggcctctatataccgctactcaagagaacctttttttctcttttgtctcatatatcctcgatgactacctgtctgcattatgtctctcgggaggggggcgccccccccaaaaatgttaatgcttcttctttctcgaaaaaaaaaaaactttccttgctccagcgcgctctcgcatgactccacttaaagccaggagctcacgtacaatatattactaattcccaacttacgcgagtggaatgtgttgaacacacatacaccagcaacctcaccagaactaaccataatgcaccaagataacatatataaatatttactacacgatttacttctgcctcgtactagaattataagattatcttccacccgcgaacggatgtgatatttccccctaagtataccactatataaccattaatattatctaattaccctagtacacctattgtgcgagcaccgtatgcatgaaccgatacatgtcccgtggataggatcgttgcattcgtgtactattttcttcatctctattatacataccagtttcatttcttacccttctcaccacacttatgcctggtctaatcatgtcagtaacacgtgtgtgaagccatcgtggggatacgatgatgtcccacttaacacgataatatgggcacgagcccgttgcttagggtcatgg

SEQ ID NO: 20700 - DNA, 328 bp, Homo sapiens
  misc_feature (1)...(328): n = A,T,C or G
cgccaacgataccggcgcacggnnnnnnntgcgcaagnnnnttgcaacacgggcgtggccactggggccaaacctgtcggcaacaacatcgacatctaggggctcacacccgttccaaaaggagcctgcttgttcggagccaaaacaccgaatttcacactgagacgacagactgctttggaattattttttcaatccgcaggcggggctacaaagcaaggaaagngcagcaaatgtctcatgatagatgttcacttatagccacaattaaaataaaaacattcctgttctaaaaaaaaaaaagcggcctcggtggcctttttttttt

SEQ ID NO: 20701 - DNA, 850 bp, Homo sapiens
aataacatacgattcgcacgtaagaatatggtagaacggtctacaatactagcaaccatgtggaaggcatataatatcccccaggagggactccagtggaagtaagcatggatgatcctggtgaagtaatgcagctcaaaagctcacctgaccagctgtacagttcctgttgctggtttaacataatgtaattgcacattgggggaacaaaaaaaaatcaaaactctggtctcgcttggcctcagaaggaggagctctcggtgcctgattccctttcattgacggttaatccatagaccctccgctcactgactccctgccactctttttttttctctgccgccgactggtatcaatcatactcatacgtgatgagagaggccctcctcataatcaggtatataacctctcaaaaaaaacatagaaacaacatgtccttttataggcgttgttccaaaaaaacgccaagttcacgattttcaacccatatttcttccaccttctcactaacagcttttattttacccttttttcacaacgtgggtatgccgcttgtactgtaacgatatcatgtgtccaccccaacgccgaactgtggaacgctcaacctatattatccacgtgaaactcaattgcacacttttaccacgtttcagaactgcatcactttcctttacaaccacttacctataccaaccgtatacatagtactttcttataactcgtatgatccaccaactttcccaccaataacatatagacgtttcccacctacgcaaccaacagttggattattaactagtacctataaatccttcgccatagttaccattccgtgcctacactctac

SEQ ID NO: 20702 - DNA, 791 bp, Homo sapiens
  misc_feature (1)...(791): n = A,T,C or G
gggtgactgtagcattgcaaaacttggacaaaangccatgacacatgtggcacaagtgtgggcgcaagggtacctcctgattcccaattttctagggacaatatgctgctactgactggacgtacctggaagggagctattcttgtttttttttaaaaggggggacccaaaaccaaaacttgtggctgattttatggctaagaagttttcattggatgcattaataaccatgttttaccttttgaaaaaataaatgaaggatttgacctgcttcactcttttttttgtatccgtaccattctgatgttcagagacaatacagagggggggcctcgtggcaaacttaaaacttctctacaaaaaaaaaatatagaaccacagcttgggattggtgttaattggaataataacaaattttaaaacgggtagatgtggtggaatttaaaaaaataagtactgatgtattacctttttcaaacacaaggtggtaccaggttaagtccccacctaatgttggccaactatacagcgaaatggggaaagttccccgtgattttataacggtgaatacaatgtccaaatttttcagccgtatacagaagaacagcaacgcactttaacttacctgagacttcacgcccatcttcacgttttgatcttaaaagcatgatgtggtccagcggtgccaaccattacaaggagagggttgcataaccccatacccaacttaatatagattgctgggagcgtgaaatggttaccaatatggacaggtacatcgaaccgcagtg

SEQ ID NO: 20703 - DNA, 363 bp, Homo sapiens
aacaatagttccaccggcatgttccccccatttccaccgcattggggtcttgctctgttgcccaggttggagtgtataggtgcaatcatagatcactgcagcctcaaactcctggcctcaaacaatcctccctcctcagcctcctaagtagctggcgttacaagcatgagccacagcattttctacctgtgaaatgagacagaatctcactctattgctccggctgaagtgcagtggctgcttacaggggcgatcacggtgcactgcagcctcgaagacatggcctcaatcacgccccctgccttctcttttggatctgccttaaaaatcgcctatcaaaaacctaatcgtgcggagtcgaaa

SEQ ID NO: 20704 - DNA, 393 bp, Homo sapiens
  misc_feature (1)...(393): n = A,T,C or G
accgcaaactcacatacaagatatttntnttttaaaacagcatacctgagacaacagtgaacagcgttatcgcctacttggaaatagtctcaacgtgcatgtagtagctaaactaatcaaaccttatatgaataattttgaaataactctgaaagatggtcatatgatttttcttcatttacagagacgcaaaatgaaattctgttttgaactaattctggtgaaaatgaacataaataatttgaatctgtccttattaacgaaattcgattttattccacaaatccatgtgcttcataatttttatttttcagagtcaaaacaaatactaactattaaccatactggggggccccctttactaaactcatctcactttcaaaaaaaaaaaaa

SEQ ID NO: 20705 - DNA, 810 bp, Homo sapiens
  misc_feature (1)...(810): n = A,T,C or G
aagcacccatcacataccaaacgctcatcntntttcaaaacgagtttaagcatcgagtgactgacagaacatcagcctacataattttacttcattgacgtggaaaagcactctgtgaatttttacagcaagattctaactaactatgaatgactttgaaactacttatactttatactcataaaaactattgcccgttgctaatttgttcatacccactattggtgaaatatttctgcaaattctgatatatgatcttcgcgtaaaccctaaaggttaaacctaagccctgcgggaaaggcatttcggtgggttgtaggaaatctatagcactaccttaatgtctctgcgggggcacgccccggtcgcgactgatcgtcacatcacataaaaaaaacactacccgtctccacgatataatacgcgtatcccctaagtccaattattaacatgaaccacccactctcaccaaaaacgctcgaaatggctcacttagatcattacagttcgcaaattacccccccacaccagaaacgtgcccacagacaatctaaaccacactcacaggtataactgccaatcataaccacccccgcacaagacaacgtacacatatttcacaattaccacatcacacataatagcatccggaacacctcattgtctccctcccctctctcaaaccgccccatcccacctctaataaacccccttatcaagataacacaaaacatgctgtaataaaacaaatctctcaacatatcagaacataacttcaatatgattcccatatatacacttcaaaactta

SEQ ID NO: 20706 - DNA, 795 bp, Homo sapiens
cgaggagagagagtcacaacacgaatgaatagtggaacgaagagtttgaaacacagatacaattactgagcatgccaagcccctctccagcctcactccactgattgctgcagctaaggaggcaacaaagaacaatcactaaaaccacactcaccccagactaattgagccaagccttctgtgagataaatgcacattacagaaagtccaactcctgatgccctcttcttattgccttgcttgtgcgatttcctgatctagcactcaacaatacactgaaccaagggaaccgtgcgggcagaattgaagagaactgaatttttttttttaaagagatgagggccatttctaaattagagtttggggggcccctcgatggataaggcggagactcacagataaaaaaaaatattaacgcgacatcgtaagccgcctgtgggattaaatctgttatttaactaaaaactccaaaagaatgatattatgtgaactgttatttagggaagagatataatcggtatggagcgagatagtgaagtgaagctgacaacatacatgaagcataaagacaaaaacgtcaagaattttagaatgggacgaaccgtaaatctcgcgtatgtgagaaacgacaaaagaaatgctgcagccctaaacttaaatcgtccattaccaaagtgggaggaaatgacgacaaaatgattggggtgtgagggttctcaaatcttactatggtcctcgataagtgatagtaggaacgtattataactgaactattcaaaatcaaagtgaatttgg

SEQ ID NO: 20707 - DNA, 404 bp, Homo sapiens
  misc_feature (1)...(404): n = A,T,C or G
ctagtcaacacccacaccccncccnnnnnnnttgtgacaatggctgtaaagtggcgaagtgtcccaaaacttgtggctgattttatggctaaaaagttttcattcggatgcattattaacccatgccccaccttttgaaaaaataaatgaaggatttgacctgcttcactctgggtttagtatccgtaccgagggtccacaaaattgagacaatacagatgttttcccttgtggcagtcttcagcctcctctaccctacatgatctggagcaacagctcgggaaatatcactcacttctgctcatcacagatttttttttttaaatgacctaacgggggctatccaaaaaaacggagtggggggccacctttattcctaagcacatgttttaaaaaaaaaaaaa

SEQ ID NO: 20708 - DNA, 306 bp, Homo sapiens
aacgcagatagtactcagtgaatctcatctgtaagtcctctacataccctgagcggtgaaatggaaaacaacttatccaaacagcattataagagaaggactaccggtctgacaaaattctgcctctaaggaacgtggtgaatattctgggattatgaaagccaactcggcatattacgaacactgacttttataaataacagatctttataagtgctaatagtacacgtttaatttggtaaacaacaacaacaacaggcatttccagcatcaaacagaattaaacaatttggatgcgaaaataaa

SEQ ID NO: 20709 - DNA, 437 bp, Homo sapiens
atatcactctgatgctcaggctggagtgcagtggtgcgatcataacttactataacctcgaactcctgggctcaagtgatcctcccacctcagcctctcgagtagcactacaggagtgcacaccatgcctggctttcattttcatttagtttaaaatattttaattttctcttgagaagaataaacagataaaattgtattgttcaatctccaagtatattgggattttccaactacctttctgttattaatatctagtttaatttcattgtggtctgagtgtagacattacattattttcattctttcacatgttgctaagttgtattttatagcccagaatgcgatctatgtgggtaaatgctttatatgactctgagaagaacatgtaacctgctactgtttaataaagtcatctatagatggcaattaccaaa

SEQ ID NO: 20710 - DNA, 825 bp, Homo sapiens
  misc_feature (1)...(825): n = A,T,C or G
agttcggcatagaatttgggccaataaagggtgaatacaatgccacagagagcacagagccatgaaccctgttctttacctgaagcaccaagtaaaaaaaatcataaaaagaggctccccacttattgcagcactggcggcccaaaataatgataaaactgtgaagctgtggaaagtcagcgagcgtgataagaggccagaaggctacaatcttaaagatgaggagggccggctccaggatcctgacaccattcgctggctttcgggagcctgacctgagacccatggacctaaggggcggcgcccccccacaaaaagtattcgccaacacaaaagagtaaaacgtccgcctccaaagctcggtagcagcgcactctgaagcctacgtggcccgttgacgaacctgaaggatagaccaagggaactccgaaataagcccagagagaggcgacagagatgtcacctaaaaagcagtcccgaagtcgagggagctaagccaccgcgggcataaaacgggtgaacacgggcccggaaaggagatacgacgaacgaaaaaggaaaggcaccagagtgaccacggtaacaaggagagagaacgcccgactccgggcatgacgatgccaaaacgcacaccaagcgggaatagtgtcgagcagtgtcgcgggttaggagaagtctgncacgagatgtagcagctgtcagtagaagggcagccttgaaagtcacggacatagaaggagcacagaagacgacgcaaaggaaatgggaagagcagaacaacgaatagagcacagccagagaccaagtagagggaaatcaatgccg

SEQ ID NO: 20711 - DNA, 712 bp, Homo sapiens
  misc_feature (1)...(712): n = A,T,C or G
aggcgggcgatgagtccttgttggccagggggcgcgcggcgggtgcgggatggactgagacacgagggacggggtgggtagacgtgttgacatataattttggtttgtttctcttacagtgggagagttctagctttatccctgtgtatcaagttgttctctgtgagcatggtgtccgtgtgtcaggttatggtagggtagtttctgtgcagtgtggattatctcgtgttgtataaatgtgagggcggggtgtttttgtctcttataagaaatcgtttcaacttggtggtggggccgcagcatcatctcggggtctattatgggggcgggctcaaggttaagcggcgaggaatatgagcgtacgaagcatgaggggaggcggcgcggtggggggttggcgtatcggcggcctcgctgggtaaggttgtgtttcaggaatcactgtnatgtgcattcatanctatagnatttattgttgnncctatccacctcaaacccatgagtgtaacaggaaacatggggagctgggtaaattaaataatagggatttttaatatatggttgaaattatagtgtaggtgcttctctgtatgccctcggcaccttttctatcattcttaatttcctgtcttctatattataaagcattggtgtgcgcgtcgcgtgcaacaacatctggacagtgggttagataaaaaaacgtacctaagag

SEQ ID NO: 20712 - DNA, 844 bp, Homo sapiens
  misc_feature (1)...(844): n = A,T,C or G
ataatgatacaagctacaaacataattggacannntttgcaatcgggcaagattgtagtcacaacctcactagttactaggtgacacctttggtaccacatacctactatgatgacgtgggcctgctatgcgaaaaagctgataccagagcactgatggcccagtttgtgcccccagctgttcttcctggagttcaatggggccctctagggcaatgaggtggtggtgatgatcctcataaaatacaggatgtttctaattatgaccaacatctactcttctaaactgaccattaatgacctgatcttccatatttcttttacattatggatccactatgcgcggattaataactgggggggcgcccaaataaattaatattcctatttagtgaaaaaaaactcaatctagaacagaatatggttgtattatccatttgaaaacagtatggtttacattttgttatcatcgtaatatatattataatatcatgtaaaagattggctcaacctacgcacttgcttctactagaactaactttttgagacccacttaatatcaaacttggtgccctttttgatcatacatgctaatataaaatgatcgcgaatcccaccattcatctttatatgattccgttgcactatcattatggaatgacgatctctgatcaacggaataattcgtgtcatgtatgctatgtatacataacgatcaacatatttgacattatatttgccacaacatcacatgtatattgtatataatttcatttatgataccatggtatcgtagctctgaattcttatgttatacctcatggcccatcgttctattttattcg

SEQ ID NO: 20713 - DNA, 665 bp, Homo sapiens
gtgttgtctatttgccctccacttgtaaacaggctggcctttgtgacttgctttgtacagctaatgtgacatcttgagacatccgaggtcaaggccttaagaagactggtcgttttttctggatgctaagagaagaaagtgattcaaggaggagggtgtaatcaacttcatcaagcgctgctgacaagtcaggtaggatgaggaccaggaagtggtcattggaaataccagtgtggatgtcatttgcgatttggtagatagtaatccgagtggagcatttggagcaaaatcctggtttaagtagatttaagaagaaattggaagaaagaaattggagacaatgagtacaaataactctttcttctcttgctagaaatccaagagcaacagagcaatgactgaaggaaggtgctgataaatcacaagagcattttttttcaaggtggtagaaataacatcagcttatctaaatgctgtaatacacttctgaaccttaacctataatttaaagacagtacagacttgttgcaaaaacacgatttctaaaagcaaggttaatccttaccacataatatcttggcaaaaattatcttccttgcgtttcaatttcatcatttgtaatatgaattaaaataaccactttacagaggaaaaaaaaaaaaaaa

SEQ ID NO: 20714 - DNA, 692 bp, Homo sapiens
  misc_feature (1)...(692): n = A,T,C or G
agcggtggggcaggggcggggggggcgggcgcacccacgatcgcgccagatacgcagcgcgcttgaatatgtcgtgcgccgccgggcctcgcctccccgctttccccggtcggtgctccggtatgggcgtccctgtggccctttcttttacctccgcccgccggggcggggtggggggcgctgcccgtggctgcccgcggggggcttgcccttccccgggtacgcctgcctatagggatggactcactcgctggangtctccggggtctctcttccgaggatgcccgggccggcgcgacgcgcgccctcccccgggggagccgctccggcgcacccgcggaccggggagggggggcgcccgcggcggcgggccgggcccggccccgggcccccccatgtaacccgccccacctcagttaagtgggacggagcaccccgcccggcactcgcncccgctgcgtgctaggtngccggcggctggctgcggggagggccgcgggggcgcgggtgggggactgtataatgagaatacggtactgggcggactgatgctanaaangcgggggggccacgggcgccggncccgccggcgccgccctgcctgcgcgccacccctcgactcgcctcaccgggggggggtcgggaaggactaactgtgccgccatccttaaaaacaacggtcctgatgccag

SEQ ID NO: 20715 - DNA, 1329 bp, Homo sapiens
  misc_feature (1)...(1329): n = A,T,C or G
caattatttatangngctgatgtacaatttgtagtatggaagntaacgaccaagccanatctctccgcagcgactccgtggaacgcacaagacggatgggcgacgagtgtgngagaaagcggacacatgccgctactacaacacaacactatcnacgcacatacgtgtancgctgtatattcgngntcagcgactagtgcagatgtacggncgatctgcgcgcacgggatagtatgatgaggaggacgcagggagggaagaagctagcacgtgagaaacgcgggtaggaaggcgagagagagtgggtgngggccgagtgcgctcgcgcgtcggcgtggctcgatgatgcactggtcagatgaacaggagtacacgaagtcgtgagcagnaggngcgaccaatcagatagatactatctgtggtagtggaaggatagtcatatgagtatatatgggacggtgttcagtacggatcaagatactattatgtatgacgtggcaagtgtcactatgatgtgnggtgtnactgataatgcgaagaggagcgtngannacaggcagtgaataagagtagcggtngagggcatgaagnaagacataactcacagacggctgtggagcgcgtaggacacggngtagagcggcgtcgcgctgccgcggtggtcgacgcgagatcacattgtcgngacctacactgctccctctgtacacctnctagctcggatcacatcgtcantacatctgttntntacttnttcgatatcttannacctttatctatcatnttagactcatattacgtgtcnacccgacnacacaccccgacacattgtcatcagcacgcttaagtgagtgcagacgaggnacacaggnggaganccggcgagagaacatagaggctgaggagtgacgtgagtagaacacaacacaggnggtaacacatgtatgtgtactataattgactagataagacacatgaataatccaaactatgacataaaccgtgacagatcttcanacatnatgtctatttgtgtggtgcantcgaacctctgttgcgatagcacaatacgtattagggtaaggtctctgatagganagcacaagggcagtctcggtatcactatataaagtttatgtcatttaatcacttaatacatcacactatcacattcnaattattcaacatatacattaacatgccaaaactcgnnaaacaatggctcttgntcagccttcancggtgnaacttctactcaccaggtcctnctncttcccatactannnnnccccttcttttcccctctncnnctnnnnnnnccnncccctc

SEQ ID NO: 20716 - DNA, 273 bp, Homo sapiens
tggcttgtgcaatgcctgagccctggcttacctgaacttccaacgctgagccacaaaatgaggccccccacacagaagcagctctcccagggacccgggggcatcgctgagctggaaatctcagagctggtatggagtaattccctaaagccaaagagatcatataacccagcctctcagaaaacacccacgtggatttcactaatcattaactagcctcatgacctgaaaaggaaaaataaattcttctttatttattcaaaaaaaaaaaaa

SEQ ID NO: 20717 - DNA, 800 bp, Homo sapiens
  misc_feature (1)...(800): n = A,T,C or G
tagtatctttacgcgttcagtattgttcccatgaagctaatggatgcagcagaactggtaaaacagcctccggatgtcactgaaaacgcttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatggcggggcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctntcagcagaggtggtagaagaggtggagaagtataagggcactctgagacggttctttaagagtcgagggaaatggtgtgttgtatttgagagaaattataagagccatcacctccagctacaggtcattcctgtccccatcagctgctctactactggtgacattaaagatgccttcattacccaggcacaggagcagcagatagagcttgtggaaatcccagagcactctgacctcaagcaaattgcacagccaggaaccacataattttaatgttgaacttgacacaggaagaaagcttttccccagaattaaaaaaaatttccttttgcatttgggaagggaggtcctgggcatgaagccatcctaatgg

SEQ ID NO: 20718 - DNA, 799 bp, Homo sapiens
  misc_feature (1)...(799): n = A,T,C or G
agtatctttacgcgtgtagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgctcatccacaggtagagatagcaaatcttctcctcatccgggggcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtnctcatcctgcctattggacactaccagtcagtggtggagctttcagcagaggtggcagaagagggggagaagtctatgggccctctgagaccggtctttaacacgccagggaaatggcgtcgtggacttgggacgaaatttaagcagccccccctcccgcccccgcgctctcctcgccccgatccactcgcccaccccccgcggccttaacgcacgcctgcttcccccgcgccccggaccatcctctccccccctccgcagagcccggaaccacccggcgcggcgccgcgggcgcccgtccccgaccaccaggcttccacgcggagccttgccccgatgtaccgtccccccccccttcaaaacacccctgctccgcgcgtcagaaaggaggccccgcccctccgccacctctccc

SEQ ID NO: 20719 - DNA, 727 bp, Homo sapiens
ttgggcaccgccccccaaaaaggggttagagggtttttaaaaaaaattccaaatttccgaagggtggtggtttaaaaaaaaaaaccgggttctttttatttacctgggggttcggccccccctaaaaatttgaaaaaatttaaaggggttttttgggggagggaaaggattttttaaaccaaaccccccccccacaaaaaaaaacaaagtggggcccccttcaacctgggggattttaaaaaatttcccccccccaagggaggggccggtttcaaccctttggaaaaattttaaaaaaaaaagggaaaaggggcctttttttttgtttttggggttaaaaaaaaaaattaaaaattttcttttaaaaatttttaaattttattaaaaaggggggcccccgttttttttgggggacccccccccaaaaaaaaaaaatttttttttttttttttaaaaatttttcccaaaaaacacttttggtttttttccctttttttttgggggggtttggaaaaccaaaatgttttttcccttttttttggggaagggtttaaattaaaaggttttttttttttttttacccccccccaattttcagggaaaaaccccccagggcccgaaaaatttttttttaaatttttttttttttaaaaaaaaaaaaaaaaaaaaaaaaaaaaaaaaaaaaaaaaaaaaaaaaaaaaaaaaaaaaaaaaaaaaaaaaaaaaaa

SEQ ID NO: 20720 - DNA, 756 bp, Homo sapiens
ctgatgctgcgactggaggctatgattctggatctaccgatgatggatcgctggggagagtccagcaaattgaaaaaccggacagttgtagatgacttactgctccaaaaaccatttcacaaagaaaacatggaaaggtggcccatatcaagttgcagactgaattgctgcatagggaagacgcattatatagatggtttcatctcatatctatggatgcttatcaaagacatacaaaggtcgtaaatgactatattttatactatggtggcaaaaacgaagacttcaagcgtttggtggaatatgacaagacagacttgcatgttatacgataaaattatatattcctatggaatgaggaggaccaaatggacattacttgggagaagagacttgctaagacctactatgatctatctttttatgattactgcatagctcatctcaatacctataatgataattagtcaggatttaggtggccagtctaaaatgaattctttacaagataaggtcagttttaccgggcatgcaatattgttataaaaaccaccgctcactcagatggcaagttgatattggttctattgacactgtgtgagaaaagacctgtactccgttaagttccacgttatgccagaaatgttctcttaaacggaattcccctactgatctaaaagaaactccgtcactaacctgaagccagacatcctctatacattggatcttgtatcacttatattgtccaattatctt

SEQ ID NO: 20721 - DNA, 807 bp, Homo sapiens
ccgcacccccaccgactaatatcacttcaccatcacgacacacccgcccttacttgggaactacagcacaagatagactccacctactatggcaggaaatactaaagaatgaaaaacacttagaagaaatcaaaataaacagccaagatttttatgaaaaagaaaaactccttagtaaagagaccagtgaggaactcctgcctctaccagttcaaactcaaattaaaggccatgcctctgctccatactttggaaaggaagaaccctcagtggcttccagccgccctggtaaaacctttcacgcaagatactggatgccaccagatggcacgagccacaatgaatgaatgcattacggccaaatccttcacatgcctacggatgagactatcctaacacctgacaaaagttacaaacgaacgacatcgtcccagacctccgccgccctctcccgccgtagaccatgatagccctccctcctcgcgacgtgcacgttctgaacctctctacctacatctgctaactccaatactggcaaatagacgcaaacgaacaacgccccttcatgttgacccgaggatactcccacacacattgaccccctccacccggactccactcacccgtgagtgaactggccggcccttacagtagtcacgccgtcttgcgcgcattttctgccaaaggtcacagccttattctctctttacagcttcccgaccggcacacctcggtcgcacgacactattatccacaaacaccaccttacacgttcctagtacaccaactcatatcatccctgacctc

SEQ ID NO: 20722 - DNA, 861 bp, Homo sapiens
  misc_feature (1)...(861): n = A,T,C or G
ttatccctccaaacgcattcacaatgaactgacagatccctataggactgnccgttctccccatggagccctgctgggactgaggacatgaaaatattttgcttctaccatatgcttttgttggcattatgcaggaaccattgacatccgttggaatgaattatgctctcattacctctttggttaaatctagacttaccaggctctgctcctcacaccttggaccttctgaaagaagacgcccgacaacaccattatcaagaccacgtcccccctccccgacctctcccccccaatcgccctaccacctccgccacatcacccccgcacgccgcagcccccgtctcctcacagaccgtaccgccccccccccaatcttgtcagtccccccacccgtactccaccctcaatccttaccctaccgcccatacacacgcccacctccatcgtcacgccccacccataccaccatgctgccccacctccattcagtctcgagccacgtacgagcgatacgcgcccccctcgctttttcctccccccctttcctccaccccgccagtatctcttgccagtcaggccttaggcacatcaaatctttatacagcccctccctgatccaccgcccgccccaccggtctcccccccgccccactcncacctcccccactccctaacactttcgtcgtcgttaacccaccacactcacggactccttcatgctcttgcaccacataccatacatctcgcacccgctcatgttcgccctcccactcccccctcacccgcacctcctccaccctccattcactaacagccctatcgatcataagcacgtcctcacgctctacatccccagta

SEQ ID NO: 20723 - DNA, 929 bp, Homo sapiens
tttttcccttcacagtggcgaacacacttcatatctaaatcaccttcctgaggttgtagatgccgtgatttgatcttgtctttggaaatggccaacaagaaggagatgctaaaaattaagcacagaacagctctatcgaagaatattgcttgcacaccctagaggacactcatacccctggaggctcgaattatcagccttgtcctgtcgagcatccgcagtcctcgaagaacacttcgtacaaccatcgctaaggacaaagacccacccaccgctctctgcttattgaccgtctgcctcatagtgaataacttgcttaacatctcttccctatctatctgcttactgctggtcctgcccccacgcattcgatcgccggctctccaacccgagccactccccctctaccccctgatttatcctaaatcagctcccccgtctttccaaccctcccaccagatgccttcgtccacgttcgcgaccacacagcaacacgtctaatagccccatacaatcgcctctattacgccctaccgtctctctctcctaccttctactctttcactcctcacggcctcgctctttcccctccttgtgatcctcccccccacctctccctctaacaccactcatctcaccctcgatccctcctcctccgcaccacccaaacgtcgtaccattccagcccacgtccacacgtcccctcccaccaagcacgtgctagcacccaacacaagtccctgagcagttacttaacaccgcgcccttccgaacgtctacgatctgcacatgccacactcacgcacgcgttcgttgcttcgctctgtctaacgccgagccgtaaccaccccagccgctcacaccctccgcttccgtttcgcacagctcctttccgtgtcgacccctcccgactatctacccacacgtcc

SEQ ID NO: 20724 - DNA, 1003 bp, Homo sapiens
  misc_feature (1)...(1003): n = A,T,C or G
cccgccccgatccaatctctccgcctcactcttcgacatacacaccacgcaatcatgcaaggctataggctatccaggtcctcttcagcattggggaactcagcttggccatcgtgatagctctcacgtctggtctcctgacaggtttgctcctaaatctcacaatatggaaagcacctcatcgcggctaaatattttagacgaccaaatttctctggtaagatccctcattatggctctccggcaaattatacccaccctcattcccgaaataccccaaacgtctggacacatacacaatcagctctctatcccttcacctgttgcgcttcgttcatgcaccgacagacaacgctctatgaccaccactcgactaacataccacctgctcaacccaccacgcaacctcacccacccccatcaccataacgacgacagactccccagccaaccctcctcacccctagtttgcacccgaccacccctacgtcagacaagccgagccactatacacttccgactccttcgccgccgcgttctcactcccgagcccccgtaaagaccttatcctccccccatctccacacccgatccccaaccatccacatcgctagccctccctccccgtactatacaccactcccttataaaactcgcccattaatttcgccagccactaccacacccagcactccccaccacgatatcctccttccctactgttccgtttcgttcacacttgcccagactccaccccgagccacaacaacgcacaacccgccgacatcagctctcgaccaccatatactgtccatcacccctctaactccgattacacatgcatccctcccgctcatctagtcgaacatacactaactacnctcagccccccgtagtaccaaccgtacctcgtcccgcacgccgtcgttcataaccactaaccacaacctacctagtgcacacctgctaccttctatccacaaccatcaacctccgccccgcg

SEQ ID NO: 20725 - DNA, 1048 bp, Homo sapiens
  misc_feature (1)...(1048): n = A,T,C or G
acccggccgtctccgcggccgcggtgactggcaacacacagacaacttcggttttgcgggcttgcggatgtgggacgagcacatttctattgtcttcactctggatcaaaagcagatcagtctctccgccccgcaccagatcaagtagtgtaggacatcaccgctactgaaaacttagcgattatctcttcagcttctctgcagtactcttcagtcaggatgcaaggaaacagattctctagtgatagaagacttattatttatggaacctctcgaaaggaacagatttgctttgagagaatccgtgtgaggaacgcacgcagagtcctagtgaactctatagtcgactgggtccccggacgggacgagtcacggtgtgcgtctggcgccgcgtaccgatttgatcggcgtacctcccatcaagtgcacgccgacccgtgcagcgaccgcagccccgcggtgacccgaccgtgccgagtcctgcatgcggcgtcgctggagcaacgccgcccaccgacgcgaccgcgttaccgcggtcgcatacaatacgcgcgcccgcgttatccccaacagatattccccctccctcccgcgaggtcgcgtaccatgcgtactcccatatcgtaatcccacacccattgcataatactcgactcactgatattcgcctcccccggcgccatcgcccaccgtacggtcacgccgtaagacctcgtgccggaccattccgctctgtattgagctgttcgacgtacgccatcgccctgtcccgagaccggacgttcaccacacagatgccggccgcccccgcgtcatcaaccgatctctgcgcctgccgtaganatacaataacaatcagtactcggcgtcggcggcgagatgcgagttggcggcgtcccgccttcccgcacgtcatccgtgtgataactgatttactcggatctacgtgacatctattacacgcggcgagacaactgctgcggtgtggattccacgcgcgtagtccgtcgatcatgcgttatcgaacgtctgcgcccgcgncgcgcgt

SEQ ID NO: 20726 - DNA, 937 bp, Homo sapiens
caaccttacaacaaccagcacccccttaaaaaaaaccaaaagctgagtcagttcaaccccagcttgttagccacacagaactgttccactgcatggaggaagctcaactgaagatcgaggagtcacaaagaactgactgaattcatcagggctaaaatctacaaaaatatactcgccggctcgtggagggccatggactgcacgttccaatggaaataaatacctcctccggatgcccaccgccgtctaccccaaacaagacatcctttgctctacctcatacacccatcctatgactaccataatcaattcccatcaaccacccagaaccccctgcccatcgacataaccaaagcacacccatcccaaaatcaactcctacaccacatattaatttacgctgatccccgatcacgagcaaccttcacactaattccacccctacccctccacccactcacaccccatccacaatccatatccatcacctccacctccctcccatccccaatccacacccataactaacatcctcccatctacacacaacaatccacactcccctatctatcaaccctctacctattatttgtttacccccattgcacatcccgcccctatatcacacgcttccgaccacctcaaccaccctcccccgaatacgactactcgtcctacatatcatacatacatacaatacgctccaccctgaccaaaaccgccaaaccaatttatccatggcacgctatctaaccacccaactcatagtaacatacaccaactacatacccaccccaccactatccatacaatgacgcgcccacccaacccgcctcgccaggctcaactttcacccctaacttctcaattatgtcaacgcaaaccctctatatatcacgcccaactcatcaccacattaccatcactaatcccccgg

SEQ ID NO: 20727 - DNA, 800 bp, Homo sapiens
ctcaccataaaggctccgccgacgccgagcctaccgcacacccccactcgagtagtcacatgaaaaccctgttataagatgtggccctcctctctgttagttttgaggacactgaagctctcccaggtgtaccccacgctgtacttgtcacctcgaattgagcatgcacttggaggctcctcagctcttcatatcccagcttttccagccaggaagatgtcccatcgattacgttcctcaagtatgccaccagctcaccaccaccgtgtcgtacgtgatacaacggtatcacacaattaagagatgttcacgctgctctcctcacacacattcgaacccggtgctagccccatgtgatcccccccgctcaaccacccaaaccctcatccccccctgtccccatttctgctttacccttcccacttaccacgctacctcctatatcagacacaactaccccctctcatccccttccgcgattaaccttcgccccccgtaccttctaacccacggcccacgaccaactccctgccatccactcccccctctatccgccattaccactcccgctccgccccatcccaccaccctttctcatcatcctaccaatatataaatcgactgcgacgcgtcgaaaccccacccccaatctccctccctattccacttatcgacgatagaccctgaaaccacccccacatattaccaatagttccccctgccattgccatcaaatcgccctctttcctactccaccccaccacgccggaagcccacacacaacttacctcgcacccccg

SEQ ID NO: 20728 - DNA, 815 bp, Homo sapiens
cgcctacaacaaccgcacccacctcttatacacttctcacttgtaggcctccagaccgctgttaccatggtgccagctgcagtggggaggccagcggttgtggcattagaggctgcgggggcagcaataacggtggtgggacccctgtcccccatgtctccaaggcaggcaactgagccacccccacctttgcatgaccaggcccataaaaactccagagtcggccaaactggagcagaggatggagagacaaagggagatgatgacatgaccagctgcagagaggagctgaccaccccagggttttctgtttgctgagaaccaaggagatgataggacgaccagctgcagggagaaactaccctctctgcctaaagctgggcacttgacgggatgacctgcctaccacacaggatatacctcttctgctgacagctgatcatatgagtgggggaccacatgcacacaggaactaccctctctgctgcgagcttggacactacccgggaatccctgctttggagaagacccctacgaccgcccgtcacctccgcaccgcactcctcgacaaagaaacgcgcatctgtgctgctttaccgctccaacaaaaaacaggccgcttttactgctctccccatcgaagtgtcaccacccctacctctatgcatcgtattctgacaaaccctcgacactgatattgcccacataaatccgtacctcagcgaaacctcgcttacagccccaataacgaccataataaaagatacacatcgcccccatactctcataagtaactacaacgcacccgcctcaac

SEQ ID NO: 20729 - DNA, 1847 bp, Homo sapiens
  misc_feature (1)...(1847): n = A,T,C or G
gggggggggnnnnnnnnnnnnnnnnnnnnnnnnnnnnnnnnnnnnnnnnnnnnnnnnnnnnngggnaaaanaaaanaagtgnnnnnagagaaggngantggatagntnnnntttatatatagtttgcnanaccacacaattnatattttaccatatatatnctctcctacaacaaccgctgangaggagagaggtatatnnnntnnntcntntnttatagtgttatgatgtctcncngtcgcgcggtcgctgctacgccccncgcacgatngtccntcaggcgatccacnacccagacgnatnctcatccactcctctactanctacgacgcatctagtcgctngcgtgcgcctcatcnttctgcgcaactagcgaggncgccacaccgcccnctagagagcccgcgctgagtgtatatatttacatataanagtgtcncnccacgaagcagagtatacacggtgcataatatctcatgcaacacgtgccncncncgcaaggnctccgcntcacgatcctnctcgctcgtgtggncactcacgcgaccaccgcagccggacgcgcncacgtctctcgcccgctaccnnnctagatatangngnacnacaanattaacgantgtgtggtnctncgcgtctcctctgactgcacgtccgcncatnatcagagctatctataatagagtgtnnacatntagtgtatcagagactcgtgttgcccgctcgntgacgaaggtggtncngntgctctaatggtggcttgcgagcggcgacgctgcngtcantgactcacgcacgaccacgcanncnccgttcatattctctnntnntcgtagagtatgtnantgtgttcgatttgagcagcatgtagtcnactgcatcgtacgngagcggtctcacagctcgtaacaagacacttctctnctacacgtctccgcacgcacgcgcgtcncacagcgcagagacgagngcgcgcgacacgagcggtcgcacggcatatgtcgatctgcgaagtgactgtggcagcacntcagtgaggcctcactcaagacacctatccgcgcgnacacgctcacgagtatacatatccgcgacacggtncggtcgactagctcagcaagccgcgcgccgtgctgggtcgtcctagtccatatatacctatntaacnactacantcaagtctnaatagagatnattagcttagatgtgatatggttgaatggagctactctgcgtctgagcactcnctcatacacctcgagagcggtcagcgatcctcgactcgncactcgtgcatgacgacgtacgctgtcgctgcncagatcgtgccatcgttctcacgacgtcgttcagtctcttcgcngntagaagtcantggtgtacgcgtattcatccgtacgcgtcatacgcgncntcnctcacgtcgagcagctgcgtgatgtgnctgatgtgcgtgtgtacgangcacattacgggntattggttgncggntgacgtgtgcacgctacgtgggtatcngtatagcgtcgcaccagaccgatgcncncactaatcnanantancacacactgctacgcgatcttanntcgatgagtcancacaccagcgtcggcacgcgccgacacaatcggacgatcgcnnccntcacgtcaccgcgctaatcacatatancancacacttcacgacgcacggtcgtggtcngtcacacgagcggcacaatcagcgctcattcgcgagtggaggctccgtcatatcgtacgcgtcacgtgtactcgtagatgctcgatgctaccctccntatcacacactcacnccacacgcagagatacgactgggtacacanact

SEQ ID NO: 20730 - DNA, 839 bp, Homo sapiens
  misc_feature (1)...(839): n = A,T,C or G
aaggaaagaaagaatattggagggggagggaggaaagggtgggggtggggaggaggaggaagaggaggtggaagatggattatggggggatggaagggtgtagagaagagaggaagaggtgtagtgagagggaggtaggggggggaggtggtaaaaggaggagggaggaggaaaagagtggagatantggaggaaggtggagagtaagagtgagtgagagtataaggtggagggaagagggaggagggaagaggattaaatggtgggtgaggggggtgaaggaagagttagtaaattaagggagagaggggtgttattgtgagatttttgatagataaaagaggaaggggtgttgaaaaaggtaaattggttataaaggtggtgttttgtgggttaagaaaaggggaagaggggttgtaaaaagtaaaagaggggatttgtaggggttgtagaaagggaaaagggagaagggggaggtaaggtagaaggtaaaagggggggagtgggaaaaatggggaggtnnaaaaatttttatatttgtgaaatagaggggtgtaaggccaccccgcggagattagaatgtagttttaaagggaaagggggagtggatttcccaatataaggttcttaaatgaaggtggacagggatcttgtttcagggtggtattatggaggatctttagttgtgtnaagggggtatttataggtttggcccccagatccaataaagggtgataaaattaaaattgaagttaaaaaagaaagggaatttataaaaaaaaagggagggggcgagtttgtctgtttggnntttggggaaggaaagatatgatggaata

SEQ ID NO: 20731 - DNA, 808 bp, Homo sapiens
  misc_feature (1)...(808): n = A,T,C or G
tactgagacatgtattatacagggtttatagtattanatattaaccagctggtatgcatggtgtgatcttggctcatgacaacctccacctcccggattcaagtgattctcctgcctcagcctcctgaatagctgggaatacaggcatgcaccaccacacccggctaattttgtatttttagtagagatgaggtttctccatggtcaggctggtctcgaactcccgacctcaggtgatccgtctgcctcggcctcccaaagtgctgggattacaggcatgagccactgcgccagcctattttattattattttttgagacagagtttcgctcttgttgcccaggcacaatctcggctcactccaacttctgcctcccaggttcaagcgattctcctgattctcctgcctcaacctcccgagtagctgggattataggcgcccaccaccatgcccggataatttttttgaatttatagtagaaacggagtttcaccatctgggccaggccggtctcgaactcctgaccttgtgatccatgcatatcagcctacacaagtgctgtgatttcagggttgggccaccttgcctagggcctatttttgttttttaatagagaataggatttttataagtgttggtttagacggtttgaaaccactatcttaaggtggagttgccattcttcggtgcctatgtggttggaattacagggttgatctatcgtgcgtgagtagggttgataatcgtgtgtttacttaataaggtcctataataattacccttcgacttgaactagttatagttccg

SEQ ID NO: 20732 - DNA, 789 bp, Homo sapiens
  misc_feature (1)...(789): n = A,T,C or G
cnnntggnannnccantttntccntantngantattaaaangcngcnngtnnattgtannccnccancannaggnagttgaggacanggccnccccnnaggagnagncggtangttanggctnaaangnccanagnggcaatcncantttagaattgntaancccagnnagtnttttctggccncnaccagttatagaanntaagccgcccnngnncntnttnttaattnatacccngggctacagtaantaangnnncttnagcnanaangaganaagaagtancnatnttagagagacnaatgatgntnangtaaaatgaatgnggnagaattgccttatnatgagatttgaaaatgcagnnantnanantannnnaaggtaaangagaagnnntgcatgtaangcaggngncgggttttnttggtcnatatgcgagganaatcatnnttntcnaangctgtagaccagcagcangcaagaggttngaagatcaanagctgagatnattcntcaangcaaataagcgtctttatcgcnnatggggnaagnaaaagaggntganccgcntcaggctnatgganangcgangagatagnatacatnacttcatgagtgaacctgttgaaagagaaacttgncnatgaagatatgattattgctagagatattgcagaagctnaggntgaatgggnanaaagagaaagaganaaagatgncnacgancatgagcagnattaaanacngtagcagnntatcgagcctntgtgatgnaaaatagagncggat

SEQ ID NO: 20733 - DNA, 911 bp, Homo sapiens
  misc_feature (1)...(911): n = A,T,C or G
gtggcacgaacgcaatgggnnacacaaaaaaaaannnttttttggatacaaagcctnacaatgtattgaaaaggcctgcgggatacaaaaacggggcttatccagtgatttttctgggcttatgagccaaccctacctaaagggaagccgccgcttctggttttatcgcaacaaccaaaaactaagcttccagggggtggatggggacccccacgagggggtctttgctagtctggctgatatgcgaaccccggtccctccgagatttttttttgacaatagaaaacacactgtggatcaatccagctctcgagggggtctcttggaatccggtattagattggaggggagctaaatacaggggcgggggttgaggcttttcctttttagacataaggaacctgaacctgctttctcaaacatgtaggaaaaaagaataaagattcccactgctttatgggaaagcctcatcccccgcccatttatttgattcccccccaacaaatactggataccaatccaccaccccgggaggggagagagtaaccaggtctcttttactatgtgataggtgaaaatctcggggggggccctgcgtgggaatataaatccaaagttatactccctcctctttgtgcggggcccataacacaaagtggaagttattttttagacttggaagaaaaaacaaaagacggcctgggcctttaacgggggagggggtatatggctaaaaaataactgatttccccccgtggtagttcgcccgacccgnttaagaacattaaaagcttgtaaagggtatcccaaagcccgaagaccccaaannnnntnatcctgcggttccccggatttcgcgatgaccagaccccaacacaccccgcgcgcgtcaggatatttgggtgtattct

SEQ ID NO: 20734 - DNA, 1263 bp, Homo sapiens
  misc_feature (1)...(1263): n = A,T,C or G
cgctcttattactcattcaagtcttagagacatccagctcgcagacttgctgcttggtgcgcatcgccggtgctcggtttcggttctttcgtcgatacctacttcgctgactcatcttattatatcatccttataatacatctcgcgctcccccgtaagctccttgatctgttctatccttctttgtctgtagtcttttcatctgtatctagcgattcttcttacctcggtcacctctctgtctgcattatatggacaatcgatcaaatccagctacatcctctattcatctatatacatatcttcactttctcgatcacctcatgatccgtgccacagatcctacgatgaatgaccacatacttgttatgcttacagtattctacttccgcatctattcctccctcgtttcgctcgtctccatacctacaataacctatgcgctgctagcatccgagatcggcgcacgctccattactaccactcttcctctgctataattcctcataactcatagtccttccgctctaccgttactcgccatgcattcagcttctcttacatctgctcgtattctctctccaacactacacatgttcacgccgtactaatctgcctccgctccgcctattaccgctataccttctctcacctcttctacaccgcagctcagaccactgagcattcgctctccatccactcgcccacctcgttcattaccactctctcctgcacttcgcgacgtccccgtctctcctcgtcctctcttatccctacacctgcttattatatttgtagagaatcaacgataccacaccgcctccctgctcttcagcctatcgacgtactccgcctctctcggtaacactctgagcgtcactaccataacactaacattagtttgtagtcgttgtacctcgtcttcctatcgcgctcgttcttgtgcatatctctcacgtctgtatcccatctctcgcacatcggtctaccttggctgatcacggtacgcgctcacatagagatcgctacgcgacgcggcaacactatcaggcgactaagacgatcataataattctgcgcacatgcctactatattcgtcgcaataacacaaatacaacaaactagatcgccctctcctgtaagngacactcccacgtcggcgtgnggagtctcactcagcagaaacactgtcacnttactgccatctctctctctctctntattcgctatattgctctgctatactctctacactcgtgagc

SEQ ID NO: 20735 - DNA, 728 bp, Homo sapiens
  misc_feature (1)...(728): n = A,T,C or G
atgaaggatgtgggcctcccatcacttgccctgacatggtgtgcctaaaccacgggaccctgcaggaagctgagattgcctgtttggtacctgtggaccagtttcaactttatcagaggttaaaatttgaaagagaagttcatctggacccctaccgaacatggcgtcctgttgcagactgtcagacagtgtgccctgttgcctcgagtgacccaggacagcctgtgctggtggagtgcccttcttgccacctgaaattctgctcgtgttgcaaggatgcttggcatgcagaggtctcctgtagagacagtcagcctattgtcctgccaacagagcaccgtgccctctttgggacagatgcagaagcccccattaagcagagcccagtttgccgggtttatatcgaacgcaatgaaggctgcgctcatatgatgtgcaaaaactgcaagcatacatttagctggtactgcctccagaacttggatagtgacattttcctcagacattatgacaaagggccatgcaggaataaacttgtccactcaagagctttattgatgtgtacccgacacaggtggtggggatgttttgtaggttgggtgatcattgtcttgtgttctttagccttgctacttctgggctagccatgtatantctgaattgtctgcaagtactgtctggcctcgatgaaatgcgtccacgtgtgcaacctaagggtctttttgtct

SEQ ID NO: 20736 - DNA, 1630 bp, Homo sapiens
  misc_feature (1)...(1630): n = A,T,C or G
gtggtccatgatattttatcagttataccatcttataatatatatagatttctatatgtatatcaatcacgatcttacctaactngtgcttngtntaccagctaaataaatcgctagcaatactacactagtaatctacgttactttaaagnataataagaatagtacatatatattgatttcatangctagccatggctccttagcgcacttctcttagtntatgantagtatnctcctcatcctttagatattaacacacgcggcgtgntactaccantgaactcatatatgtgtantatcatnatatatatagtntatctcatcctctgacatacgccgctncgtctacagntgnacactgatactncgacgacctaaggctttcngacanagcattctacgcgagctagacgatctcgtgagtacagtactctatgtgatctatgtctcanctatacgtntcactanctcgtcantatgtcgtaatcaagtacagactntatagtgtatantgacatgnttnagtcngtctantgcactacgtantatacgtagtcacgtcangctctataaactactcatatgtgtatangaactctgatgtnatatctatttcatcantgtacatantcactacnagtgtaatatatantcgttcgacgtactataactactcatactgatcnttacanctctatatcatcatatataaactgagcatcgaattacgatcctaatatgaattcatacatgacgnttancgtgtacctacgtatatatanctcctcaacttgtatttacatatacattgtcactatactagtaataaacctcattatctctcaaatcttacacttcacactcgagatcacacactgtgatcatctctacagtctactntacatcatacacaagatattntcgtcnctcttgcacgtgcagctcgacatatcgtntgancatattttactttttntctgtctgcntcttcatcatattctagtttntatagtatattcacctattatgactctatctgttttactatacatcatcatgtacatactactactgtttgtcantacatagtcatatacnanantngttaggtcatacgctatgtntctntatgantagatataacatatctcatgacaatatagtctcattnttaatatagtactgcacatctgtgatntactctgattctatgtcatcgtacntcanttcgcttagcaatctgcatagttcgtactctatntattnttctatgtgcattgatagtagtatagatctttcatnantacatcatcgcatagcgtagataccgtccctatacatatatgtactctctccatacacatgantncatatctgatgtcgtgtgtcntcatctagtcatcatgtctcgtgtgtcgtgtagtgtganaggtatcattgatttagttatgtagaatacagtatnatgtcacngatcgagtctctctcgtatgtctnacttctatatatctcattgatattctcaggctatagtgtanacgactaataatagtacacactatcgatgtttatcagtgttaacancgtctgatacgtattgtccttaatatcactccacctactacat

SEQ ID NO: 20737 - DNA, 957 bp, Homo sapiens
  misc_feature (1)...(957): n = A,T,C or G
taaccccgcgcactcaaccaaccatcatacttattctgacacaatttatgcagcaggtctgagcaactaccggtagggcatgaactcttcagatcatgtcacctattacgaaggagtggaagaggagacatttctgcatgaatcctcatgatctacaaaacaaaatccttgctgccttggactccacagctcgaagacggttcgactacgcgacacatgcccgatctcataagaatccctctcctgaatgactagaaaacccacttaccctaaaggcccttgcgaaaaaaaaaaataatagcgcctcttctggcccccatacggcgcattctcatgcagctcgttagccttaattcgtgggttacataccatgatcctcgactcactaactacaaagacctatgcaactctaggctgcctgcgaccggcctcacacccagctcaaaggcaagcgaaacgaataatacctcccaaaaacacgcgatctaccccacgaaataagcttcgcgaccactatccgccacgtccaacgcccctcaccccgtaactataggatcgtctacgctatacgcacaacncgatcacgctccgcaccctctcgccaaatcatcacaaatacacacatcacccgaacctcccaggatgcgccctatcctgtacagcgactactcactattcaccggcccaattccgcaaaactgctggccacgtagtcgtcgcatattaacatcacccctggcccacacaccatgacaccctcgtctattccacttcccgagtagaagtaagcagaacgcacttagtgaaaaggaccgcaaccgcctgcgcgatatcaaacagtctcgtgttgtcgttattctgtaagacctggacttgtcgcctacgccactccacagtaacagacacgccctgtacgtcgctcgagtcggaacttagaatctgagactctgccgcngg

SEQ ID NO: 20738 - DNA, 892 bp, Homo sapiens
  misc_feature (1)...(892): n = A,T,C or G
cggccgcggagccacacaacagaatcgtctactaagaccgagacacagccctgagtagccacaatgaaagtactttaagnagcacttgcgaagaagagaaagacaaggcattactctgtcagcagcctgctcggtcagcagctcgagatcaccaacagtagcttaccttgcttctggaagctcccctagagaacatcactgcagcaccatggaacaagcagtgagggcatgcctacaactgctgcacttcatactctcctggaaatagaatatctgaccttcaccccctccatgctcccaatacgttagccagaaccctacattactctccacaaatactccttattacttaggagcaattgacaggcacgaccaccaaccctcccccgaccggccaccacccctagcccgccgctccaaacaactattaccccactccccccgacaacccccactccccgaacaaatgagcgaaaatcctcacctctttcctacccccgacaagaacctcttgatcgaacgcgcgagcgcgccccgccgcgccccccctgatccacacacagaagtggaaaacggaataccgcccaacgtcgcgacagcacccgcgcagcgcgagcggggccggcccacgcacctgccctgtccgctcgacccctccgccgaccgtccgcccgaccgagacgagttcccgtcccgcgcccggcgtcctcgcttacgtatcacaccccgctatcaacatcgaagacacacacacgacgctgcagtcgcacacgcaactcgcggcacgtaatgtataatagaaacacacgcaccgctgccgcagctacgaaccgtatcctctcgtctccgaccctctgaggcgtgcattcgcgccacccaaccccctcggacg

SEQ ID NO: 20739 - DNA, 943 bp, Homo sapiens
  misc_feature (1)...(943): n = A,T,C or G
ggcgccgaccgaaaggacgattcaaaggacgcagaaggacaacgccttgcagggactcccaggnatgatgatcctcctgtgacccgggctacctgtagccaaaatgcaactaggatccagttaatcgctctcatttaatgacccactcttttcctttggaaaatacaataaggacgtcccccatacacggagtagaatggtaaaaaaaaacacagagacaggaaagagagcaagacgaggaaggaacacggaaggcgagcaccccaccaccaaggagtcggaagaacccggggaagcgccgaaacctgggagaagggggcgcaatgaacacgaagcgacaaaagacgaaaactaagcacgtgccacgcgccaacccgagtagcgtgtgaagcctcaaacaactcatcgacataacgaaggagagtatcagaagtaacgccaagatcaacccccaagaacaatagaggcacggagggtaaggtagcagcgattccagaccctggcccaggccctccgcgcgacccgatgtcacgacgcgggcggcggggcacgacaagggagaagcagaacagagtgtgaggggcagggaccacgatggcgcaagcaccggcaagacacgcgtgagcacgacgaagaggacgcgacgcccacgacgacagccgacgatacagcaacaaagcgaatgaatcaaacacctattctcgtccccggccagccctcgcacgacacctctcgagctcgccacacgtgatgagtgaagcacctgacgagaggggcggccatacgggatggacagcgacaaaaaataaagcaaaccagacgccaccggagacaacgatggacggacgagaacggatagccgagttaagataaccaccaacaacaaagagaaaacgtcgtaactaccatggcaaaaacggagaagagaccgcatcgagctgag

SEQ ID NO: 20740 - DNA, 911 bp, Homo sapiens
cccctccctcttttctctcactcgctaccccccgtatcttacgctctcccttaaggctagtacaggaaagcatggtctggtataggcttcacggaaacttacactcatggcagaaggcgaagagggaggaggaacgtcttacatggccccaatcatgcagatacatatcgaatgctgggaggtgctcttccctctttaaactaccatatctcatgtcacttcctgtttcaaaaacatatatggatatctcctccattcccgcgccacactcccactcctttctttcactctccctttcccctccttcgtccatctccctttttttttcctcttcacctcgtcctcctctcctacctttcacttcaccatttccttcttttactttctttctcttccttcttcttttttctcccgctttctccccttacccttttcctcccctctcctactcctctattctcccctttcctcacctccggctctccttctcctctctctttatttttctcctctctctttttctttttaccttttccttccttccgtttttgtctccccctccctcactctctcttctcattcttttcccccctctttcttttcctccccctcctctctttcttctttctccccccccctcttcttctctctctacatttattccccctcactcctctcctctctcttcgtccctccactcctatctcccccctcctcctcctcccttcacaccctctctctaccattgttctcttcctccttaccttctctcctcttctccacttctctttcctctccatattttttttcctcctttcaccactatcttattatttttctatttacttcaccgtttcctttcactcctccttttaactctctcccatctactcctcctattcctctaattg

SEQ ID NO: 20741 - DNA, 775 bp, Homo sapiens
  misc_feature (1)...(775): n = A,T,C or G
ctaggtgaggcaagctgaggctcctgnacctaggcaacttacctaagcgtcacagctcagaaacagatgcagatttggaggccagatctgggaggccacaaggctgggtccttggcacagcctctacctcctctccaggtcatctcctgcaacccctccctgacccagccactgtccagtcaccacggtgcccatggtcacctggcacacctggctgtgtcctacattaatgcatatcctcacgcttctgcttctcctgcctggaacgcacctacctatcacctaatgaacttctactcagcccagaaagctctgctctcaagttatctcctgcaggagacagaccttcaccccggggcccccttccataagagaaaaacgatcccctttggctggggatgtggctcacacctgtaatcctaacactttgcgaggccaacgcgggtggatcacttgaggttaggagatcgagaccatccttgccaacgtgcggaaaccccgctctctactaaaaatccagacatcccccctgtgtaagaccctcacacctgttatgcccggtttttggagtggtctaggcattcatcttcccacgcccccgctcttcaacctcttaaaccccacggcatactcccatctctatgtctacgcccactaccccgcgagtgcgcgccccgggcacctggacgtcgtaccatccagcgcggccggcacttcgcccgtgccaatccgagttgtctacgtcgttccattcccgacgtaccattgttcggtt

SEQ ID NO: 20742 - DNA, 857 bp, Homo sapiens
agaaggaccgtggagaatgtataccacacccacacgccgctgggcaagacacgaatagccttaaagagaggagaaggatatcaaatttattgaacataatggaaccaagcctccttcagtttatatttctcgacagtggctcaataaacttaaaacctttgccgaacctggccctatttcaaataatgactttctttagtttcatggaggtgttcctccaacacaagccggtaatattgaagacctgattatgaagatcaataaaaaaatttgggacagcctcacctacctgactggccgccggacctacttaaaaccaattatggtcattactcctacttcccacgcagtagcgaacccatcctaccaccactcctataaatgaactcgaatcctgaatcccacccaataattaagctgctcccaaaattgccgctcaacatgacaaaacacccgtctccacccccacgatatatatgaaatctgcctccctcatacaactgcgcaatgagtacacgcatataattatcaagactacacatgaagagctacatcagcggcacacgccagaccgcctactccaacgaaagcaacgtcggcggcgaatcacactcctactaggaacttgagatcgacaacaagaatacagcgcgcaatataatagaaatcatagccgcgcgcacgctatactgcacaattcactcacacacataaccaaccttgtcatcgaattgttcaaacgctcgaacttccactaaaacgtcaatagtaaaccagacgccgaagctagctgaagatccgcaagagcgccaactaccgaatacttaagccttaaccctattacgaccaccacagac

SEQ ID NO: 20743 - DNA, 168 bp, Homo sapiens
aagaagatcggagaggaagacataatatagggaagggaggggtacttggaatttaccacgtgttagcaagatagaggccccctgaatagtactgttcacgaagactaaaaggaactgagtgtgcctgagcttaagcatcacgaagaccagtaataaagaactatttac

SEQ ID NO: 20744 - DNA, 885 bp, Homo sapiens
  misc_feature (1)...(885): n = A,T,C or G
tacggcaatttacttacttatattcactaaaccaccagagtaggtgtaatctaacttactccttcctgctactttgatgaagaaggtgccttgctttcctccatgatcgttaagtttcctgaggcctccccagtcatgctgaactggacagctcttatattgacaaagccttttctgaagacgatgaacacacggcgagctccacaacgtatagcagatgttgcacagtcaaaggcagagtcttcagctccaagtacaatcacgactccccgtatccatggcaatggagagtgacaggcgcacattcctgaatgatgaagggaaaaccccattttcaagcaagagaaaccatttgtgcctcgacaggtacaacgacacttgtactcaaacgcacgcgaaaattgcatctgagcctctcttcaccacgaacttgtccctcctcaagcgcttctgttttgctgtacagacagcgccgtcgcccttgtcatcggcgggttccaccattgcagcctagtcaacccgattcttcagcgatgtttttgttcgacaagatgcgttatcgacaagtactgcaagggatcgtgtgagtacacaatctgtagtacctaccctagccatgatgctagtgaaagcttcagacggcatacatatcagggacctcccaactttttattactccccctactacgatccggtccctgtcacgcccgttatccacacggcacgcccgtatcgcatttctatcctgtcgacctgcatcggaacgccgcccgcaccgagagccagagtgttagacgtccgtaacacccatacacgacgaaccgcgcacacccggcatcccagtcgctgtaccncccgttgtcaaggccaccgcagaaaaacaag

SEQ ID NO: 20745 - DNA, 846 bp, Homo sapiens
gccccgaacattacgatataacaccatcaacacaccaaagcacacaacccggctagccaattcgtgtctgaaatattgaacttcttattcagtttttatcaaacttaagtttaactgcagatgggtttattggtcactacatattcaggccaaaaaaactgcctacaactacaggacagcctgtcaccaccacattccctgtaaccacgggtttaaaacccaccgtggccttgtgtaaacaaaagcgcagacggacggggactatggacggcaattattgctcaactgactctacattagccaggcctgccatcacacccatcactacctcatggcaacacgcacgccacacccctcaatgactcacatcccatcacatggaaacctcccgaccaactacatcgtccataggatgccccgccccacgacagcaaattgatctgcaaagcctcatctacaatcacacataatcatccctgatcctagcgacgacgccctaaatctaggctcatagacacaacgtgcccaaccaaacgcccattcatcaaaacgcacgcgacacccctaccatctctatttcttcaacaagtccagccatgttatctctgaccacctatcactttctaccaaaccacaccgcctccatgtccttcaccaagccctataaacctactcataactacgctgtacactacgcgcatcaactgaactaacgtatatctcccactcttcgacactacccccacaatcatctaccctgacgtctaaatcgcgcaccccccccacacccgtaccgctcgaacccaactgtgttacccacactacaatcccgcaactataatcgag

SEQ ID NO: 20746 - DNA, 835 bp, Homo sapiens
ctgacaagaataacggatataattagttgttgatttgtgtttttgtgttattactctaggtgcccattctgcatttatttcaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaaaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccggggcccccgtcctggtggtcgggagctaccgagatctcctgtctcccctgtcagtcatgtctgcctcccaggctctgcatacagtggccctgtcggcagtccacggttagagctcaaagcccaacctgagcactgaaggcttcggcctttaacggatcacctttgcgctttgacaagtaccagaacttatattttggccagtttatttccttgacagtggtataccctaaaaccacttggatctcaattctaccctgtctgatctggactgcggctgcaggtctcgtttaagtatcatgttttgtggt

SEQ ID NO: 20747 - DNA, 1512 bp, Homo sapiens
  misc_feature (1)...(1512): n = A,T,C or G
gagggaaggaggnnaaggnnnanngagnaggngagggnnaagnnnaagngagggnaagatgganagatgagagaagnnnnnnnnnaggnnnnngagaggnnagaggnnnnnnnnagggagnngagttanagaggnnnnannganagtagnaagtaaggatngnntnnnnnagagngagagngggatgagagagnntggagagagnnaaaaacagagaagagganaggngcgaagtggnngagagagagaggaggggagaggtaagtagnttantcgagaaaaanagaagannaaatgtatagtnaatagtacacaagannataaataaaaagtgtgaanataagaagggaagggaaggagaagagaagcaaggtnaagaagatanacagttagtagnatagtaaatagtagaagtattaaatgagatagttaataatatanataanataattataattaaattataagttagttagaggatatgaaggtagtgnngtgggatagtgntnttatgtntgttttatgtcatgttatgtttnttatgtggtattgtagtatcatgatatantgaataggatgtnnccnaagtgttttttattgtgtatgatagtttcaggtagtttaatgtncnncgagtcgntcntctatgtttgaattgttgttaagtatccctctattctttgttgnttcgctatatcaaatagcataantatagactagtacatactntatacttgttacttagagatatttanaatgcatnaccatatcttaactagatgtctaattcacgatggaactnacagtcagtacattgtgtgtgaaatagtatagttgatgngtnntcgtnntatatgtaggtgtgtnggaggattgtnttatgctgtantgttatatgttatgattgtgcgtatataatagtgtgtagatatgatgtatggatctattggtgtncatttgtacagtntcnacgtatgttgtagtatgnnnnataagtagatatatgtatgagtttgtagtcgtgaggatacatttnatgtgtggatagtnatgatgtacgnanttgcctgtgattatttttatntcactgcgaggaccagagcgcacagacagagcacacncgagagagcaccacatacgatagccatcgcntagagcgagcncaagctatagagtatacacgtgancgacgnaagatctcatagatcgagatagntntcacntctngtctatgtgtncactggtaacgcgcngtgtcaacgacgctnctcngntagtgtgttactacactgatatcactgaaccagagcgagngctgagctctctcacagtcatcagtctagtantntcttntgtacntattcgcgcgatatgatgacgnatactatatacgttagcggcactngatanctctcgtggactgtcctcgtgtgtagtgtcactntagagaantcagctgctcacacgccgcgacatcacaagagatccagtaacaagcaancgtacaaacat

SEQ ID NO: 20748 - DNA, 860 bp, Homo sapiens
acctactattcatattgaccatcataagaggcacaacaccaccacccacacacggaactttcatcgctctacatggaaggactattgtttccagcatgactggcagcactagctcatgtaccttatcgagtcgtactttctctctcttactcgccttggcaaatagctgggcgtcgtagatatatcatcaccattacctggagaattattcattcacatggacggcccggctcgccttctcctatgccccatcacaaccaccgatgatgtggatattattttatctattccaatgttcttaagactctatatgattgccacagtcatgcttttacataccaaacttttcactgatgcctcctctcagaaacatatggagctacttaataccaccaactttcattccccgtcccgttatgaagactcccactgactagatgacccgcaactgatcctcctgcatttccacaatcttattatacccacacttaacgcttcgagtgtcccgcgctcgtggcaccgctcctgatcaatccgccgtttccaccccctcccttgtatcgatgacaccccacatccctaaatccccccctccctgcgctatgcagccatgtactccacccaatcatgcggatcgcgaccctgttcactttctggcacccctgcagacggacgatactcaacccgggcagctgttctccatgcgcactcccccctaaccaaacgccaaaaaccaagcccactatttagatctctcaaccccacacaacgatgcgcatgccgtccccccaattttatgaaccaacccgaccacgacccaccccccaagccaaataaatcattcaccaatatcacaaacc

SEQ ID NO: 20749 - DNA, 878 bp, Homo sapiens
  misc_feature (1)...(878): n = A,T,C or G
aagacaaacagaccacccacacatgtagacacaacccgaacaggttataggaggacacactccctagttaaagcggctatacgagctaccatcctgctagggagagcctgaaagcttaatgctgacttgactagctctggtcaatgaaagaaatcaccagtggaaaggctaccagggggctttctcaaaagagagggacagtaaactgcaagatgaacaactcactgccatccacgtgtggatgacaaagaacaccccacagactgactttttttatcgaaaacactcaaagcatgaacttccactctcttatccggctgccaggaccaagggaaaaaaacagaccttcacgacgacctgcacgaccacaaccaccgcccccacaaaagcccccagggaccctgcgtgtcgcacagacggaacccagcaacgccagaccggaagctccgaatgaaccaaacacatgccatcaactgaaagcggggcagcacacaccaacttacacccccccacgtataaccgccacccttccgattataacgataccaccccaacgacccacgcacatccacaacccagcgtcctacacagcagcggcccgaggagtatatccctgactacgccatgcagtcttaacacaaagcgccccccacgccgtaatacgcccaagaacgcattgacgtcagcacacaccgcactagcctacaatatacatgcacgcccaatcaccgctgacacacaccagactcaacaccacacccctccgccaagcacgacacacgaaaccggaccgcccgtatatgcaacgtcccaccgcccacacctccgtcctgccacctcgagccacnccacacgaatcaccacgatgtctcagagat

SEQ ID NO: 20750 - DNA, 746 bp, Homo sapiens
tctgtacccaggctagaatgcaatggcgtgatctcagctcactgcaacctctgtctcccctgttcaagcgattctcccgcctcagcctcctgagtcctgggactacgggcacatgctaccatgcccagctaatttttgtattttttagtagaaacggggtttcaccatgttggccaggctggtctcaaactcctgacctcaggcgatccacctgccttggcctcccaaagtgctgggattacaggtatcagccaccgtgcccggccaatgccacttatttagcaactacatgctactcagtgctgtgagctttcttgtcatgtgttaccactatcagaatatttttaaaatccctactagattacaaactcttcgagggaagggatcatgtctaataatgctcttgtaactcctcaaaggcctatcacaatggtcagaataacaggaattaattgaacttctctgtaagcctcttttcttgcctgtgaaataatggtagctacgaactacactggtttcaccaatcgtatgttactgttgccagtattcgaagatttgccttgcatatgaccactaataacttcagaattctttgggctcagaaacttactgtattattgaacatgaaactgtgttaatttctgtactttcgaataaaaatagcagaagcttccctattatatataaaaatccgcctcctttgccctcactagttgtgctttcgcggttttttctttattgagggt

SEQ ID NO: 20751 - DNA, 851 bp, Homo sapiens
tctttttatttcacacaaccacaatatatataacaaaatataaaattattctagcacattttacatatgggataagctattcggaaagatctcggaaaatggtaactagaagatcaaagtataccaacagaggaatgtacatctacctaataactgtctaaaatttaaatatgtataataaaataaatgttttaaatattaaaaaaaaaacaataaataaacaaaacaataaaaaaacaaccaaaaaaaataacaataacacatatccaataccctccccctcttgccctcaagggcgaatcttttgattcaattatccttttaattagggttaacactataccttcactatattaactcaatacgttatttctataatatgaattaaacttataactcaaaccaaaatatttttactatccattatccacacactcatagataaacccatcaaatacatatacgctaaacatccatattaggccatctccctttaataggtctactcgcataaactcaacaataacaactgcctcccctcatatcattccaaaaatatttcattacaacaataagttacaaaaacacaacttgttatacattttctcacttattaccatatcaattacaccttatactctttctgataacctcatattttaaatgtgatattattaatacgtatatttaatacttcctttcgacacacaatattatttctcattataaacaaacactatatattcaatcacctactccccggacatcttctcaccattgtactcgctctacattaaatttccccttaacaccctatccaatttttttatttttatattattataccatac

SEQ ID NO: 20752 - DNA, 886 bp, Homo sapiens
tactgtgcgcaataaggctcatatgtttatgtatttagttagaaataacctagctattctcacttaatgtactcggtttgaagatgaacctcgcttccttgaagaaggtgatacagtgcagatttaatgatgagttaaatattgagttggctgaaaatgtacgatattatgaaccttctggtcaagaagaagtactttctgactctgaattatcaaaaacatacctaccttgagcccgctgccatctattgttaactcgctgagaataaacgacatatcttggtttttattccccaggaagcttgagagaaatgagtctattctttttttttctcacaaagacaaaatgtaactttgggccagtttaggtttcacgataacgacgtgtgttgttaattaactgcttaaatgcggacgctcgtagtattttgctatattcactggcactttacgtacgaattacatgatccaatatttggattttcctctggaataattgagacctcgactatcatcacactgactcgctactcctccatatggttattatcccgcgtcaatccggatactgcgtcgtcggtgtgctcactaatatacgtcttcgaacatttcatactgtgctcacaaacactgtcttggtagcaagaaataatacaggtgcggggagtctcatcttgatgtccctcgtcaagcaacgcggtatctattgatgtagaggtcgaggtgtcctatatccccattctctgttgttgtgatgctcagtgctgctctcatgccgcgcctcgaagacgttgcgaggtgacaacaatcatattcacctttccgcactccatccgttcatggccctaaccatctcattcttaacgccatttttgttgtgcgattt

SEQ ID NO: 20753 - DNA, 400 bp, Homo sapiens
atgggtccccctcctccctggtgcaggtctgtcagcactgccactgccactggaacccacagctgggaggagagaccatgccctgttttactacaacagcttttgttctgaagtaccttctaccctgattttcaagtctgatgttgctgtgactgccatactacatcttaccaaacaactgccaagcgcaaaagctacacttactcctgcaaatgacctacctgggtttctaatggcccatcagcaaatggggtggaggactcctcacacactgccaggctacgcaccaactttagcttggaattagactgaaaaaaacaaaaaacaattttcaatttttttaatgtatcttatatatttcttccctcggtgaacattcagaaagctaaaaaaaaaaaaa

SEQ ID NO: 20754 - DNA, 1094 bp, Homo sapiens
  misc_feature (1)...(1094): n = A,T,C or G
cacctcacaacgatctaccccacctaatttaactactatgcccctcggcggcgagctttagggggcacccgctactcatacttttcgccaggccctatgcccgttctgacactacactggtgaacaccgagctggcggtaggcggcaaagcgcgctcactatagatccgcctatcctcgaacgccgcatgtcttagcacgaactccgcgcaagttgcaagccccgtacccacgctaggtggtctcggcattctccaaagtacacagcatctccgcctgccgacgcgcctccatagaattgatatactgaccttcgaagcgtcgcaacgacctttcctcttctcgaagcactgcgtccacacagcttctcgcatccgcggatcgactgacagaccaacattaatccacctgccctgataatcgaccaccccacagcctacactcacggacgctactctcataccctctcgtgcacaccgaccaccctctcacccccgcttcgttctccagcgcactctcactcactagctccgcccaccgtctgtcacaacatgaaacaatcctgcgtcttatcaccgctcccactaccctcaacgtaactttcaacgccacacccccacgtttcttcggtatcgatccacggaaatcactaacaatacgcccctgccgcccacgagcactcgacagttgatgaccctcacactcctcctctcgctcccctcgctcctccattttgctccgttttcacctgcaatattatatgtggccccccctaccctccacttccatcctttccctcgccgctcttcccctctccctctccccttcctcctcgatgtttcacctatacaacaataccctaacccaatatctcacatgccgctttctaatatgcagacgtagctagacgcccattgatcatgatatacgtgtacacatcttccacgtacacgcacgcgcatcgaccctcgctcccactcccatctcaccatctcacccatgcgctccggtcttgtatcacctacgaccgacacgagcgccagtccgcccacgcgtcaccctgttcctccgtcccacctccgccnacgcatcccg

SEQ ID NO: 20755 - DNA, 766 bp, Homo sapiens
tcaacccctataaaccctcctcctcacatttatcgaatataaagagttacatgctgccagcgcctttacatgaccttggacagcgcggcggtgggtgaaagaagacagcttctatgccaacgttcaagacggctttaatggagacacgcccctgatctgtgcttgcaggcgagggcatcgcgagaatccgtttccttccttttaagaagaaatgctaatgtcaacctcagaaaccagaaagagagaacctgcttgcattatgctgtgaagaacccatgcaccttcattgatcatctactacttctcctcttattttttgttctgctccttggctattccctcatggcgtcaaataccaatcacaccgaggctattgtaccactcgctcttgacgctggcgcgctagtcgacgccacagaccacctcggctgcacctcatcccctcctacccagccagatgagtaaccacgtctctcaccgcccccgccctgggaaaccctactcccacccatcatattacaattccgcggtcgagaggtacccggcatccgcccggctacgtaatattcgcacacccacccttttcgttggtagcacagcgcccccccgtgccccaccgctaccgcgatcattccacgcacgtgaccgggatgctatcttcccttatacctcctccgcgcggcttagcctttctgtagctcccccgtcccactcgcacactccgctgcaccgcccccagggtgcagagaccctgaccagtcaccct

SEQ ID NO: 20756 - DNA, 807 bp, Homo sapiens
cagataaaattaattaaccacattatctctatattctattaatgaaacttaggaattgactctctctcatctttgccagaataataaggcattaccatgcttgaagtaactttagtggagggctacacattttcctgtttagtcttgctgccattagacaatccatatggaaaaatatttggtactgtcaagaggaagttgtcttcaagactgtgacattgtggccaccaatgggagtccactctcagctagaggaattccttaagtcatttgtgatgctggagatgatagcatgtatccatgctaaatctcacatttttttatcgacctatagggcgcacttgcctccaatatgaaacaggttattccttatacacctattttatcaaggtattctgtggattacctcatatgttatctttacatggtttaagggtatattctcctttcccacttctgttcaattttataataaaataaataaatagtcgattatgacgatctaatgccttactaatcagtacccttcttatatctatttttctccataccctaatatagtttactcacgtttgctcatcacttactataagagcacaccgcctcaatgctctttgttaacattcgtacctctctcccttttccatccatacaatgtactgatacacactgcaacttagtatttaacctgtcctcatgcctcgtcggccgtatgctcgtttagtatttccctttttgactcatccttcctgacatcttctttatactccccacatataatcatcagctccgcatctaaagatcacc

SEQ ID NO: 20757 - DNA, 892 bp, Homo sapiens
ccaccacaatcaatgacaaattattaataaataatcgaatgtcttgtactaatctgaggtagattctgggaccctgaaacatgaggagaagggagagaatgggaacacccttccactcctggctctggactgaaccctgagtcaccccaatgctcctgcacactggacttcagtggaatcagccacccaggaagcacatgcaaactgacccatgcagacacgtgcgttatgctagacacaaggcactgcactactgaaccgatgaagtgactgacaccccacatcagattgaacaaacaaagttggacattttttttagacaagctacttcttaacgcgaaaagaagagaatgaaagaacaacgcaatggtataaatgaaccagcagacgcaccactggattagtataactgggatgtataatgatacggtcagtaatactgatgtgggtatgtacactagtgccatgatagacattaatcagtcacaacaaaccccaaagagtagaccgcgcttacgcatcacattaaactataatcaacagacatacaagcttgaaaacacactccacgactaactaccaaacattatgggctctcgtactgatatcatgagcaggagtacaataacaaatcgagacgcctcagatctaccatcccaccacgcactaaccataaaatccatcaattatactccctaacctactataaaacacacactatcaaagtaaatcacacacccatcataatagttaaattagaaacaaactactcactccagcacgccaagtgaaatcacattacgacagacgcatacagcaaatatccttagtacataaaaacaccctttaacctaaaagatccacgacactccacgacacgctaacacaaatg

SEQ ID NO: 20758 - DNA, 854 bp, Homo sapiens
agtcatcagcagttattatcgacaattttttataatataataaaacgtatgttggtacaagatcataattgactttacccagctggattgaaaggctccacagagggaagtgagagctatgaagaagatccctacttggtagttaaccctaacttcttgctcgaagattgagatagtgaaagaaactgaccagagctgaggaactgtggcacagaacctcgtggcctgtagcctggctggagctctgctacggacagaagtgtttctggaagtgatgctttcaggatttgccctcacaaacaacaatagatttgatggtcgctatctgtcacatatatcactaggtataatatcatctcttgactatacactacatcggtttgttcaccctgtccaacagcatcttaaatcccatcattgggtaatttatatatcattcccccatctgttaactagaaactaactaagacataaattatataacgtatgtatttttcttgtgaattctgtcgacttacattataatgatatattgtctgaaacaggatgaggagaagagaaaactcgcacctgataaccacataacacaatcgaataataccgtatcaaagcgtatacataaaaagataattgaacatgaacaatcgaaatatacaaattaaaaacagtttattaaaagttattgcgagccccatatatataagctgtcgcccgtttctaatcgcacttaacagacaaacttctactcgctcctaatctagtaatatgtaatatttaactaaatcaaagaactattggtatgattgcatttagtccacccataatactgatatactcctcctcatgtttatctc

SEQ ID NO: 20759 - DNA, 203 bp, Homo sapiens
  misc_feature (1)...(203): n = A,T,C or G
atcattacttacacaccataaacccacaccttttaactacaaaaaaacaacttcagaggaacatcgntctgtcttcaggctggaagcaggcgcgtgatctaggctcactgcaagctctgcctccaggttgaagtgattctcctgtgaaagggaattatttttgatgagtcattaaagtatatccattcccaaaaaaaaaaaaa

SEQ ID NO: 20760 - DNA, 879 bp, Homo sapiens
tcaatataatctatgtcataatttagttttcaccaatatttatcattcattgatgccctccgtctggatagattaagagactggagtggtgtttggtgccagcctattcctgctgctttcattgacagtcttcatcattgtgagcgtaacagcctacattgcctaggccctgctctctgtagaccatcatctttaggatatacaagggtagtgatccaatgctatccaaatattaaatgaatgccacctatttagggcaatatctggaatctagagttgtcttatctaaggagttggttaacaatacctacaatatattcttttttttcatgtaaacttgtattatttaggatctgttgctcttattctaagatggtgaaatagaaaattttctaaaggagcaaatatttcattattatttgtacttattactaatacaggcgtaactagcatatgggtcatacacaataaaaattcattgtaaagtaattccaatgcgtgttttaaacggttatttttatgtgtgttggtaaactaatatcatatgagttatatactaactaaatttatcgagtaacaggctatttaattcatatttttattctattgaatctatttttttatctgactgtgatttctaccgtatttcttcttgtatttgcgttcgtttttactataataatcactcctgtattaatttctatagtacttaaaaacttctatgttcacccgtccttacggttgttctctcctatttcacattaataatttattctctatcacatactctttatatatacgatttttcttttaatataacatatcatctatttcaatatatttattctaacgtctatctgagactcataagtaatatca

SEQ ID NO: 20761 - DNA, 167 bp, Homo sapiens
ttgactcatttctaaatatttactcctcattatgataattagtttaatatatttttaggcctctacgacccaagctaagtcctcatatcccctgtgacctgcatttacacatccagatggccggttcctgccttaactgatgacattccaccacaaaaaaaaaaaaa

SEQ ID NO: 20762 - DNA, 865 bp, Homo sapiens
  misc_feature (1)...(865): n = A,T,C or G
cacaatgttccttggggtcgagaaagagaacatgccggcctagatcaaaaaaaaaaaaatggggtgagcgggaacaacagcacgcgtttccctagactgagctgctgattatctggcagagaagttgaatctagatccactaattactcatactctgaatcttgataaaatcaatgaagcagttgaattaatgaaaactggaaaatgtatccgctgtatcctgttactttaagtacaatgtaatacatgccagacccaaaggatatttcaccaactcaatggcatttgatgtttttttcatgatttagaagaattattcacccaatcccatttctatattctgacttctgattcactccgcagaggacctatatctggnttctgacctaaccatttcatcaaaattgctcttacgtaacctagcgtgaccaaggatcagcctacttcccacagctagattaatactggcttgtatcactcacctctccatcctctctacataataggtcaacgccaatacgttgccattatcatgagttcgtctacctgcagaccttaatgtggaatggccccttttacattgtttcgctcgcctgttatctccaatcttgttcattttctcataattaaacgtctcctcctttcttatccttcatttttcagaagtggttcaaattcctcgtccttcatatctaatttcaagaattaatttattcgtattttcccgtctactatctctcccgccagcaacataagtatacaaatcccgcgtccttgttgtatttttctcttttctaccttttctgtttttctttgccccgctgccttcccccgtgtcgtatacactataggtagcgccaacccc

SEQ ID NO: 20763 - DNA, 836 bp, Homo sapiens
tcgcccaacaattcccacacaggtcactaacacagaatgcaaatacttataaaaactgtgtggattttatcctatattcataactacattgtggatggctgggtggtatttcaactcaagtttttgctacttgtctgggtctggtgtacatatatggccgtcacctatacttctaggggatattcacaagctgctaataaacggaccaccggattccgcctgagcctggggatcttggccttcgccaccctcctaagagacctgggaacatgaaaccacctccctggctgagtacccttcatctactcttcgcctacctcacgagatgcaattctcaccttacctctcccctatttacgcatgacataccgatcccagcttgagtgccccacgaaccgcgacgggttagtactcatcggcgtcacagtccagaatataaaaaacgagatgggcccgccgcgatccccccataaatccacggtaaggcttctcgataacagcagacccaatgttactccaatcttccctatcactccactatattaagaatgtcagtacagtcgtcatcccatcactccccatactcaactttctgtctctcaaacctgcacccatgtacccacctttcacagcatagccatgcctcactcaccgcccccccaagtctaacaatccccgcctcgaacacgaaatctacgctgagaggagggcgtcaccgtatataatatcaacaattgttattcattatccatacgtcccaccgccactcactaaaccaccgctccacctctcaaactttaacaccgattctacctcccaatacggagaatcgaccg

SEQ ID NO: 20764 - DNA, 838 bp, Homo sapiens
ccaatacactcacaagcactattacaaaaaaaaaaaagaaagttggggctactttgccaaccgttaagggtacaaacgcatgaacatggctcacagctgcctcaacctcttaagctccagcgatcctccctcagcctcctgagtagctgggaccacaaggatgcgccaccacccctggctagttctgttcatcttttgtagggacaaggcctcactatgttgaccatgactcaagcaaaccttctgcctcagcctaccaaagggctttttttacaggcgtaagaggcacacagccaggacacgatcttggttcataatgccattatccaacaaagggaacggggcacctcttgacacaacagcctgaaaacacggccccggtctcgacatatgaaatatgaccccgtcgcattttaccgaccccccaaagataaaaccccaacatacactccccaccgaccaacacacagtagcccaaccgtactctcgaattcaacctcacccccccgcacaagatacttaacggagacagctgcgactccccgacaacctcaccccccaaactccaacccctctaccccctagatccacacacggtattccgcctaccccaccactaaaacccttcataaagctcaagcccgcgactagaacacaagccacccactcaattaccacaaagcacacctcccacccctcatccgagctcaatatcaggcagacgagcacaccaaacaagagaaagataccgataacaaaaaactaacccaaaaagatctctccaaaaccctcgatatatctgctcgacatcgattatccacaattttatcatccacaa

SEQ ID NO: 20765 - DNA, 849 bp, Homo sapiens
ccactttctctttgttttaattattttagttagaagtatatttctggggtgcattacccaggtctaagccctagccaaaaccccttgtgttagaggagctcaccctttactgctgatgaaatctccatgatgaagtgctttcctggtgacgcccagagatcgtttgctatgtgaatgcttttcttgctcaaatttcaacaaacatgattgccaaaaaagagaaaaaaaaagaagagaaaagagaacagaaaagaagaaaagaaaagaaagaaaggagaagggagagaaagagagaagagaagagaaaagaataatagaaaagaaaagaccagaccagacccatagaatcctatgggatctgctgacatgtttgtctgaacttcgtcttccatatcactgccaagatggtttttctaactcaccactccaaaaatctattgaaaagcctgcataagcccctatatgccctccaaattataacttgttttgtttcaaactattccctccacctgaattcactatacttcttatacaagttttaaaacctcctatcgccttggagacctcacttcaaaaagagtttctttcttaaatggctatatgatctatcatgcgctataatggcattatattacatatgtagggttagttcacaactcatccaactactttctttatatcatatagcgactacccgatcctttcctttcatctgtagtaaggacctactgacgaagacgtaattccctctctcttcctaattcaaagttctatacactaattatgccttatacttctcactacatcctagaacttccagcattcatgattattactcagtccctcgag

SEQ ID NO: 20766 - DNA, 847 bp, Homo sapiens
tttattatttctcctctttactttatgtgttattttaaatttaggtattttgggttagcataaggaacatttgtagcgaactaggatcagtatgccgtaggatttacagaatattttcacatgcttattttcatcatcggcagatatttgatgaatatgaaaatggaacatttttgtgtcatcggtttactaagtttatgatgaaatacaatttggatgtccaaggataacctgattgtaccaattttagaagaggaagtacagaatttagtttctggggaaagtgaagcatgatgggaatcatacgacccatgtactgatcatataactaacattatgccctgtatttatcattttaaacacatcaatcttgtgttcatattatggcttctttgcataatataggtttatgtatgctcggattgcattttaaaaagggaattactcctttaactctttctactatgtttcgctgccatcgtggcactgttgtgttttaacactgatccctcctatcctgtgctcaaggccttgtatataatacgatttcgcattcttggtcactcctaaatcacaataggctcattattttcttagttgtatgtcctttcccgcctttttgtcttttaatgatgcaagatccatcactgtctaatcccctttctgatctcgttgttgttcacttgagcccccatctcctattctttattacccaacgccggaatacgctacttatctttaaattcatcataccattctctttttacttttaacatcttatccgtttcgccgaagctgcataacgttgctatgccaccttagaaaccactcgcacgataactagcgg

SEQ ID NO: 20767 - DNA, 449 bp, Homo sapiens
cttgtatgaaacaaaaccagtagtatatattttggatgtattattagactctcagaagcctgttgtaacttacagctcccaaacctgagtggacaagcatgcccatccataggaaagttaaccagcctcatgggacagtcagcattgatgagagaaatgccacctgagaaccgtaaaagaataccatgatacactttgttctaaaagttgagttcaagttttcattgctacttactataaataccctcttatgatgctacagccatctgtacctggaacggagtccccagaacacctactggtccatcctcaatgtaaaaggtggagagcatcagcctttccaaatgacctctttacagttttaataaaatatactgataatgatgttgccacaaaagacaattatgctttaggttttatagacatactcaataaacttttatatggaa

SEQ ID NO: 20768 - DNA, 684 bp, Homo sapiens
tgataggacgggctggagactatatttttagatcgatcaatagcacatgcctgggattatcatggccgtcttggacaaggccctaaaggttatatctggtctggaactgagagaattgttcgggttcatctggctcgtataggacttgccactaacggatataactggcctagaactgagcgagttgttcttaatgctctggctgcatcaggcttctcaacatacatgtagccttatcatatgacccagcctgatatcctgcatgcacaaacctgatattactcacccagacggacggcgctttaggatttgacccaggcttaaagactgggtgtaccatccaaattgtatttaccctgaggtactgtagtatatcctggatgatggaatctggatcgggcgtgccttataagctgactcttctctgagtggcataggcctctgatgcatgcttggttctggcatggtacctgattttctgggcctcacaactttttttgggaaagccctttgaccccagcttgctagttgcataataataaattttctgttcctaaaaaaaaaaaatcgaccccgttggccccaggggggaacctttggggccccttccctttagggagggtaaaacaaagaaacttggctccctggcccctatacgctgggccttctgggtccgttccacct

SEQ ID NO: 20769 - DNA, 148 bp, Homo sapiens
  misc_feature (1)...(148): n = A,T,C or G
taatagacgtcnttcttttacactccctggaactcctataactaactatggagaagaaattggaatgggaaatattgtagccgcaaatctcaatgaaagctaagatattgtaagttgaatacaacttgacaattcatcacagctataa

SEQ ID NO: 20770 - DNA, 654 bp, Homo sapiens
ggtggcacccatacatgcctgcccatatgcgatgcaccacatacagccacttcctggaaccgctgaatgacttcacggagcgatcgctacacagcacattttgcacgcgccacgcagccccgacttgctcgaaactcaacttgagctggctggtggtccctggatcctggagcccttcagttaggattactccctctttcttgcgctatatttgatagttggaagaaatatactgacagttatggtgcaatctttatgcggggaaagtaaagcctcacgaatgcccacagcctttctttcaaagactttgactctgacacctcttaagagataagattaaaggcccctggatggtgttgctgtgtagatgatgtggagagaagagggggaccaaaaatagggcctagctcccccaaaagtagaaaaacctgcagcgatcaccctcatgaggggcccctgcctgtaccgtcgcgcccctcttctgcccttctgccagtgtgtattgtagaaatgagatgttgtatggcgcatccccttatacgaggccgtccctgtcgatggggcagatggttctaaaaaaatgtcaataaatgaccaggataagtgccctcctacggccacgcaagtaacatgagaagatggaatctgagagtg

SEQ ID NO: 20771 - DNA, 767 bp, Homo sapiens
  misc_feature (1)...(767): n = A,T,C or G
cctagngatctaattactactcagtaacacctgtgtatgcatcgtgctctcaattctccacctcctcgttccaccactgctgctgctgctgctgctgccgccctatcattacaaaccagctcagcttcctcatgggcttgtatttaagcgcctgcctgtcacaccaacttactacagctaaatgatgatgcaaattctccaggtttgcatcagccacatgagaagcctccagcattactcagctcttttttttaaaaaaagaaaaaaacaggaggagcttgttgctcaactgaccttagctttttagagaacaaagcacacactttaaagagattttagccaatccagaagtagtaaattcggaacagaccttcccagagatttaaagcaactcgtagtgagcaacaaaagctgttcaaacaaaatgaaacaggaaatagttacttcattctaaggagcttctttttctttaatgcgtgaataaaaacatttcacaatgcgattgttatgtgagtccgatgtatcctaaagctacatcgttgatcccaccacactttgaattgtcccccctaaatcgaaattcaggcccagctgacctctcgcgttccgagtttgtgtttgctgcccatatagtctgggtagatccgtcgaccgagcgtatgtagaacccaaaccgcgaatgttctgctgggcggaatcgggaatcggatccccaaagtgcacccgaacatcgctcgacctcagtccgggcccactcgacgatgacg

SEQ ID NO: 20772 - DNA, 255 bp, Homo sapiens
ctaggttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacacaaactttttttataaaatattttgtacaattcgttaaaggctaatttatgaaaaatacaaaaaaaaagaaaaaaaaaaaaa

SEQ ID NO: 20773 - DNA, 777 bp, Homo sapiens
  misc_feature (1)...(777): n = A,T,C or G
aagggggtcctcaacttttgtgaanattccagtatnngtcagccgcttgtccccacaaacataagaagaagttgagagagtcgatctcgagtgatcccgcctcctatgggtagaagccatcttccaattattagcattaacaggaatgtctgatggagtcccaatgtccaaactttctcacatactgtagataagttattcacaaaaactttggcctgtttaacagaaatgtcatacagacaggattatcagccactacctgagagagaaatattttcctcactgtgctttcaatcaagagtttgcttttgtagagagtaattttcaggagttattctttacttactaaagaaagtaaaatgcctttcagctgaacactctgaaaagaataaaaagctaatatggtccttaagatgggggtgcctataactagcaagtaatttgggccttaaacttacgagtgggattgtaccatatagtatttaaagaaccaattttacaatgttttaatgtctcattttattatactgtgtaatgaaaaataacacatagcaaagttttataaaatccatattaatatcacaaaaacttcctatatttttctttaatagatttttaaatctgaatgtactaatcttgaaatatttttagcattgtacgaatcttctctttgtttttttgcttaaaaactctatgatagctaaacataaaaatgtaataatgtttatcgattaccctaaagtaaagaaagagataactgttaaaaaaaaatcgcct

SEQ ID NO: 20774 - DNA, 310 bp, Homo sapiens
gggatattcaaaaggacagccagtaggtgaggagaggccatggaatacccgccaacaagataatcatcgctggaataatagggacctgtctgaataacccaagaagaggggaaaccagcatgtcaccagctgctgtgatggagtcaggcagcacagggtagtggctcagagcagggactctggagctaggctgcctgcgtttgagatcctgctcagccaattactagctgggtgatcttggcaagattttttgttaaaactgttatgccttaatatctttaaaatagggataataataaaaaaaaaaaaa

SEQ ID NO: 20775 - DNA, 803 bp, Homo sapiens
tagatgctctacttcacttcctactctgaatggaagcagctcgagcgtcttcaccacgaacatatgtctgctgtcaagcgtgttctctccagcctacagaactgtgaatcaaatacaccctttctgtttatgaatggaaatgaaaatggacaaaagagcaaaggcttatttcaaaacctttgaccctcaaatacaagaggccctctttgcgcctcggagagcggtactatgcacccgttttcctatgtggacggtcaaactgtcagcccacatgcctgactccatatacatggggctttctgcatgccgacagcgatgtcatctcactcaaaggctgggatcacacgtgtatcctctatgcacgccgcggaatcacgccacggaactagctcgttgtgacacctaaggcctggctagggcccccaacattctaaaggccttcactttggggtacttcctttggctcgccccccctgactagcttgacaaaaataaccgccaaattatggggcggcaaacccccacgggacgttaaagcactccgggcgcccccccctttattctccatcctgtgtttttgagacccaaccctgcctattactagatacccgtccctctttttccttttagaaaagataagacttttttgattcttcacgccttaaggatctaatttctgggaagctttcttttatcaaggggtactgcttgccccaaccccccggacatcccagacctctggccttttcttggtgaatattggtttagctccatcctcggtggtacattctttttttcctctg

SEQ ID NO: 20776 - DNA, 571 bp, Homo sapiens
  misc_feature (1)...(571): n = A,T,C or G
cctgtctcttcntactcaggggtaaagggcctaacccaacaaatnatcanccttgcaaataatcacagattagctgttggcaacattgtacaagtcacccagccagaaggaatgcacagtactgtttcaaatcgaacctcagggatttagagatactgttgttacttctgcatgttcattgcaaacagaaggttcctttagcacccaaaaaccgtcacgaaacccagaggaaaaattataacccagaaacaaatcttaaagtgtaccaatttattgatgttgtgaaaatcatgtgtacaagtggactttgttactttaaaatataaataaaccccttggcctcgtttgcctaacgggtggacctttgcggccctttcctttatgagggggaatcatgaaccctcctaattaattccttgccccggcagtttggttgcgggaacgggattaatttattaaaagcgggattccgttttccccaaaaccaggggataacccagaaaaaaaatttagcacaaaggcccccaaatggccaaaaccctaaaaggccccatttttgtgcgttttttct

SEQ ID NO: 20777 - DNA, 890 bp, Homo sapiens
  misc_feature (1)...(890): n = A,T,C or G
cgagcttctagactagaggtcttaacaataagagagcaaacaaaagaaagaagctcgaggtagaaccatgtnacttcatttttgaggataaacgcagaaaagtgaaagatgcaagcatgcaagactcataacatttggggctaggatcctcagaatccantgaataaaagaaggagggaagaaagcaaaaagctgatgagagagaaaaaagaaagaagataaaatgagaataatgataaccagaacttgctggaaatgtgcctacaatggccttgtaacatccattgttccggggggggcacttaagggtgtgaaaagaagtatttatgaacctgttgtctggttttgaaaaacaattatcttggtttgcaaattgtggaacgatgtaagcaactgcttttgggtactgcaacatgtgttgcttcctacctgacctgttatatcgctaaatcggaaataaaatagctttcgcttccacattagcaaaaaagaaaagaggaattaaatatgctgtgagtgagctaggagggatagcgataatcggagtgcgcctcgtggacctcaataggtgggaacccttgctggcctgtttccttttatggggggggtagttcagagaaccttcgcttcactgaacccgctggcgcttggagacatccatgctcgaggcgatcacgagaaggggttagcaaaaaggggggaagtacagggttatcgaccggaatctggggaaggcggccaggacaacaccctgtgtgcactaaggccacccagagcgtcgggaatcccgcataaagggcgcccgtggtttgcggcctcttccattgggcggcacagcttcgcgagacagttccgcaaaatcgcgccggtgtacctcgacaagcacgcnc

SEQ ID NO: 20778 - DNA, 501 bp, Homo sapiens
atattgtgtccggaattggtgggctcctggtctcactgacttcaagaatgaagccgcggaccctcacaacttaccacggtggagccctgcaggggctacagtacaaatggctgaaacttcaagagaagcttcctgtcttcctagccagaggaaccaggataacttgccccattaagctgcagagtgtaaggagattcctaggccaaaaacagtcagagaaggggatcctgtaactctgtgatgagcctgcacaattttcaggctctcccctgaactacacttatctggaacaaacctaaatcagcacagcaaaagtattgagagctgaactgagatttgaagcactgcctacatttcaaactgtcctgtgagccatgggagcacagaaaatttccaacaaatgtggcaaatgccttaaaaagtggtatgataatttgaactgaagcccacaaaaagtgagacaaaacttacaggctgaaactaactggggtaactgcctga

SEQ ID NO: 20779 - DNA, 938 bp, Homo sapiens
  misc_feature (1)...(938): n = A,T,C or G
gactggtgtcatggccgttcactgaggtgcagcccgccgcacgacggtttgcacgnctcgaccaaaacctgngtgcagaaagtggataattttgtgtcaacacatctggacaagcaggaatggaatcctacggtgagcaaaaaccagttgcgaaatggtctgaggcagagtgtggttcagtaagttgggtgattgtgggtgagattgtgcagtaggaataacagctgctggttgagaattacccctcaaaagtgaaaatagcgtgagctgtatatggccagggatgtgggaagctagagtagacaggattatttctcacgtggtggatccaaaacttaaccacatcttcaggccgcaaatagagcgagcaattcatgagttcctgcggcccagaaaaggccgctgtgccagcaccccctccagagcccgaaggccaggaccctccagcttcatctgaggacgcttactagaattccgcccacccccttttgtggggtaatttttgggtgaaaaaattggttccccgtttgcttaacgagtgtcaccttgtaacactgtaacattgtgcccaccggtcttcnactggttctccaaggatgttccatgcgttggaccctgcccccttcttaccatatttgtaatcggggtaccattgttcnccctgtgtgtgggaagtgtgagcccgcggtcgcctccgtgccgactgtcgctgcactttatgtgccacacctggtgccaagggtcgttctcgtgctatccncacttcttgtgtgcgagcagaatgctcttcgttgactccccatgggttgtgtgcggacaccgagcctttttttctgggcactcggctactgttcctcggccctttggtctcttgcgcttggtggtcttacctctatgcgtatgcggcagagcttcttgtctccctaacatattgttta

SEQ ID NO: 20780 - DNA, 745 bp, Homo sapiens
atgaagccaaaaagaaaaaggaaatcaatgggaaaacgacaaatccttgctgcccataatatcaaggaaatagccaacagaaggatcatatttccacacccactatcttagaaccatttctctgacctccttaagttgatctgtactgccccaagatgctgagcgcttgtgagaccctttcttcttttcagagtattcttcagcccatgcactctctgtctgtaatgaaaaaagaggggaggtgtatttaacaaaaatcatttcacaacaatgtctaccatatttttctattatagaacatatttccattacaaaaaaattagacattaaaaataattaacacaaattactcaaagttctcctggcaccagttacttaactggtattaattacaattaatattttggcatacttcatttttattgctaataaaaaattagtatttttacataattataattatactacaaataaagcatttatggaacaaagttaactatatataataactagaggtaccatagttaactaacatataatagctaataatgtcagttattattagcacgcatcaggcacactaataatagctaacattcttgggctcttatgtgctaggcactgtgctttcatatgctttatctgacttaacacacgtaagttgcctaaagtgttaccaggcggtaagccaagaattaaacctgagactccagagcttggaaatacggacttctatattatgcca

SEQ ID NO: 20781 - DNA, 1156 bp, Homo sapiens
ctggggagggatatttggggggaaattataacctgggcctttctgccaggatcacatcactggaagctccatgactctctttttgtaaaagaaaaaaaaatcacagaaacacccacctcccaaactattctcttttacttcttcccccaagcccacccccaaatataactgttatccagaagctgttatgtcctgttcccatacatgtttttgtacttttactatatctacatacatcaattaaacttatgtcctattgttttgtgaatttatatttgcgtatacattatcatatgtaaaatttgcatttttttattgaaaattatgtttcttgagatttatccacattgaaacatggagctctaaatcgttaattttaaccgctatagagtatttccataattttgaataaaaagcataatttggtttggtacaattcttcccggccaaggggaaaaaattaatttccaaccacttcatccattgaacaaggaagccactggcaaaaaaattaaaaaaatataaaaatttaccatttcccattacaataaaaaaaaagtgggtaccttgggggccctccgttttgggccccctcaagccgggggggggaagccttcttgggcgggcgccggccttttcccccctttttaaaactgggaaggggggtctaaaaattttccaattggaaatgcccctttgggggctttacaacctggggaactttcccgcctttggccggaccttccgggggtacccggttttccggggggactttgggacgggggcccaaaaggccccgggattcatttcccaagcgcgtttcacaacctttttcaaaaaaaaggggcccgagggtttcaaaatataaccggggggtgttagaatttcccccacccgagggaaaattcccaaggggggggggagaatataaaaaccgcgccaaggggggaaaaaggggaaaacccccttgggggtggaaaaaccccccaaaacaagggggggccccacggctcaaagaaaaagggggggcccccaggggaaaaccccgcgcggtagaaataaaaaggggggccccggggcggattttgggggttccggggaccgggtttttttaattttcccacataagaggggcctcttgccgggagcccacccc

SEQ ID NO: 20782 - DNA, 378 bp, Homo sapiens
cctagttagtgggtggcaagagtcctggctcctgggctttctccagctgggagtaccgtccacactctgagttgtttgttctgctctcctgaccctagcttaacaggtcttgacagccctgagagaggcatttctggacttgacagatgtcaggattctcccaagaatggccagccacccccctgctgttggaatgcacagagcctttcggttggaataaacatgatgggcatcccccagggtactccaaggccctgattttttcccacgtagggccccccccccataaaaaaaccttgagcaggattggtttttctgcgcctttaagaactttccttgccccaccttaggggccggtgtttgtccttaactaccccc

SEQ ID NO: 20783 - DNA, 912 bp, Homo sapiens
aatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaa

SEQ ID NO: 20784 - DNA, 849 bp, Homo sapiens
cggccgatctctttttatttttcaaaacactaataattagttaaacatcagtttatgtcccctcaacctaagagtaactaaagataatttcttctgttaccatcttcatcattggatatggtgatggtggccatgttattctttccaattctagctccactccagtggtttccaagaggaaggccgaggtagaccctgaactgttcctctggctcaaacatggagtcatcgtggatatagaccgtacagttcttcactttgtcccctttgagaaatgtaatccgtgaagagtctgcattttgtctctcctcaaagtcctccatgacctgagcggaatggctctgagtatagcacctcactgatgactcatagctcaggtctccgctccgagtgatagggacatgcaggacaccctccttctccttcactaggagcaaatccttggcaaactgcatgctgggcgcatcttggaatgtgtcattaattgcaatgactgcctggaagggtttggtcagttccggcttccttgtgctgagctgaagaaaaccccaaatgtctccagtccttcaattaccggatactgagtgtcatccaagatagtcaaagtgcaatactgttcaatgacaccaggcccaaattccactcttccgagagctgggaacgtaatcaaactcctggtgtggcagaagctggggtctgagggccccgttgcacaccagaccgatgcaaaagtagagaaggcagtccccatgcggataacctggaaatcttactgtgcccgcattcctactgacagtgaaaaccccggttgcccaacggacccagttgaaggaatcgttgggaacccct

SEQ ID NO: 20785 - DNA, 1770 bp, Homo sapiens
aactcagtacgaacaggttgttcagagggagttgagaggtagggattcatagatgtaggtatttctataggccaggcggctctcgctcgtcaggctccgtccaagtgtaggctggacaggaaagtcaagatattgggatcaggggggtcgaacggaacgaccgcagcagggtcgccctggatgcttatttctcattaatgagccctatcttcaagtttcaacccagggcagttcataggccaaggcccacgtagtagtatagtcatggcccacgagactctggagggaagctttgcttgtacatctcatgtggttgatgcagaaggcatcaggattgtttactaagtcattttccatcggcattttagaagtcagatccccaccagtcatcaccaccaataaaggactggtcttggatgaaaactcagtgaagaaaatcaccaccctgcagctgtctgccactgaccaggacagtgggcctacagaattgatttacagaatcaccagacagccccagctgggccacttggaacatgcagcatcaccaggtatccagattagttcctttactcaagctgatctgacttcacgaaatgttcagtatgtccattctagtgaggctgagaaacattcagatgccttcagctttacactgtctgatggagtcagtgaggtgactcagactttccatatcactcttcaccctgtcgatgattcgctgcccgtcgtacagaacttaggaatgcgggtgcaggagggcatgaggaagaccatcacagagtttgagcttaaggcggtggatgctgacacagagattatgacagcagcacctcagccgttccgagtagacatcctcccggtagatgatggcacgcctagaattgtcaccaacctgggactccagtggctggaatacatggatggcaaggcaaccaacctgatcaccaagaaggaactgctgaccatggacccagacaccgaggacgcgcagcttgtctatgagataacgacgggccctaagcatggctttgtggagaacaagctgcagcctggcagagctgctgccactttcacccaggaggatgtgaacttggggttgattcgttatgtgttgcacaaggagaagatccgtgagatgatggatagttttcagtttctggtgaaagacagtaaacccaatgtggtcagcgacaatgtcttccatatccagtggtcactcatcagctttaaatataccagctacaatgtcagtgagaaggcagggtctgtcagtgtcacggtgcagaggactgggaacctgaaccaatatgccatcgtcctgtgtcgcaccgagcaaggcaccgccagctccagctccagggtcagctcccaacctgggcaacaggactatgtagagtatgctggccaggtccagtttgatgagcgagaggacaccaagtcctgcaccattgtcatcaacgatgatgacgtgtttgaaaatgttgagagtttcactgtggagctcagcatgccagcttatgccctgttaggggaattcacccaggcgaaggtcattatcaacgataccgaggatgaacccacattagagtttgacaagaagatctactgggttaacgagagcgctggttttctgtttgcacctattgaaagaaaaggagatgcaagcagcattgtatctgcaatttgctacacagtccctaagtcagctatgggaagtagcctctatgctctagaatcaggctctgattttagataaaaagggatcggcag

SEQ ID NO: 20786 - DNA, 2600 bp, Homo sapiens
ggcacgagcacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaataccggaaatgtaaagtggagtgcacacacaaagctcaagttcatgtggggaaacctgactttggcttccacagaaaagaaggatgtttttggttcccctgcctcaaaggccgggccatgttggaagtggtatctgtgggagttcattgcccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtat

SEQ ID NO: 20787 - DNA, 3964 bp, Homo sapiens
  misc_feature (1)...(3964): n = A,T,C or G
ggcacgagatctcctgttaccctcacatctctcttaccaatggtaactgcaggaccagctgcagggaagagcagttcctcaacctcgtgggatactgtgctgactgccatcacctgtgccagcactgtgcagctgatctccacaacactgggagcatctgcctcaggtgccaaccatcaccacccagatgcttgacatccgagatgatgacaacccacaggatgtggtcattgaaataatcgatcctccacttcatggccaattgcttcagacacttcagtccccggcaacccctatctatcaattccagctggatgaactctctagaggccttctccactatgctcatgatggttcagacagcacatccgatgttgcagtcttgcaggccaatgatggacactccttccataatatactgttccaagtgaagaccgtgcctcagaatgacaggggtcttcagcttgtggctaattcgatggtgtgggttccagaaggggggatgctgcagatcaccaacagaatcttacaggccgaggctcctggtgccagtgctgaagaaatcatctacaagattacacaagactacccccagtttggggaggtggtccttctagtgaatatgcctgcagacagccctgcagatgaagggcagcacctgcctgatgggaggacagctacccccaccagcaccttcacccagcaggacatcaatgaaggcatcgtatggtacaggcactcaggagccccagcccagagcgactccttccgcttcgaggtgtccagtgcctccaatgcccagacccgcctggagagccacatgttcaacatcgcgatcttaccacagacacctgaagcacctaaagtgtctctggaagcatctctccatatgactgctagagaagatggcctgactgttattcagcctcattccctctccttcataaactctgagaagccaagtggaaagattgtctacaacatcactctacctctgcatccaaatcaaggtatcatcgagcaccgggaccaccctcactctcctatccggtatttcacgcaagaggatattaaccagggcaaagtcatgtaccgccctcccccggcagcaccccacctccaggagctcatggccttctcgttcgctggtctcccagaatcagtgaaattccacttcacagtttcagatggagaacacacaagtccggagatggtcctcaccattcacttacttcccagtgatcagcaactgccagtgttccaggtcacagctccacggctggcggtcagcccaggaggcagcacttctgtaggacttcaggtggtagtaagagatgctgagacagcgcccaaagaactcttctgtgagcttcggagacctccacagcatggtgtgcttcttaagcatacagctgagttccgaaggccgatggccacaggctagcactttcacctatgaggatgttgagaaaaatgctctaccagtatatacatgatggttcctctacccgggaagacagcatggagatctcagtcacaagatggcctcacagtgacaatgctggnagtgagagtagaggtgtccctgtcagaagaccgaggccccgactgggctgctggctcctctctgaacattacggttgccagtaaaagcacagccataatcactaggtcacaccttgcttacgtggatgattcttcccccgacccagagatctggattcagttaaattatctgccctcatatggtactctcttaagaatctcaggatctgaggtggaagagctctcagaagtttccaatttcacaatggaagacatcaataccaagaaaatcagatactcagctgtgtttgaaactgatggtcatctggttactgatagcttctatttctctgtctctgacatggaccacaaccatctggataatcagatatttaccatcatgatcactcctgctgaaaatccacctccagtcattgcttttgctgaccttatcacggttgatgagggagggagagcaccactctcatttcaccatttttttgctactgatgatgatgacaacctccagagagatgccatcattaaactaagtgctctgcccaaatatggctgcattgagaacacaggaacaggtgatcgttttggccctgaaactgccagtgacctagaggcatcatttcctattcaagacgtcctggaaaactacatttactactttcagagtgttcatgaaagcattgagccaacccatgatatttttagtttttatgtgagtgatggaaccagtcgttcagaaattcacagcatcaatatcaccattgagaggaagaacgatgagcctcccaggatgaccttgcagcccctcagagtgcagctgagctcgggagtggtgataagcaattcttctttgagcctgcaagacctggacaccccagataatgagctcatttttgtattgacaaaaaagcctgaccacggtcatgtactctggaggcaaactgcttctgagcctctggagaatgggagagttttagtccagggctcaaccttcacctaccaggatatcctagctgggctggttgggtatgtgcctagtgtccctggcatggtcgtggatgagttccagttctccctcactgatggcctccacgtggacacagggaggatgaagatctacacagaactgcctgcaagtgacacacctcacttggctataaaccaaggcctacagctctcagcagggtctgtagcacgcatcacagaacagcacttgaaagtgacagatattgactcagatgaccatcaggttatgtacatcatgaaggaagatcctggtgcagggcgcctgcagatgatgaagcatggcaacctggagcaaatttctattaaaggccccatccgaagtttcacccaggcagacattagccaaggccacgtagaatatagtcatggaacaggagaacctggagggagctttgcttttaaatttgatgtggttgatggagaaggcaacagattgattgacaagtcattttccatcagcattctagaagacaaatccccaccagtcatcaccaccaataaaggactggtcttggatgaaaactcagtgaagaaaatcaccaccctgcagctgtctgccactgaccaggacagtgggcctacagaattgatctacagaatcaccagacagccccagctgggccacttggaacatgcagcatcaccaggtatccagattagttcctttactcaagctgatctgacttcacgaaatgttcagtatgtccattctagtgaggctgagaaacattcagatgccttcagctttacactgtctgatggagtcagtgaggtgactcagactttccatatcactcttcaccctgtcgatgattcgctgcccgtcgtacagaacttaggaatgcgggtgcaggagggcatgaggaagaccatcacagagtttgagcttaaggcggtggatgctgacacagaggccgagtctgtcacattcaccatcgtgcagcctccacgccatggcaccatcgagcgaaccagcaatgggcagcatttccatctcacctccaccttcaccatggaagatatctaccagaaccgggtcagctacagccatgacggcagtaactccctcaaggaccggttcaccttcactgtttctgatgggacaaaccccttctttatcattgaggaagggggaaaagagattatgacagcagcacctcagccgttccgagtagacatcctcccggtagatgatggcacgcctagaattgtcaccaacctgggactccagtggctggaatacatggatggcaaggcaaccaacctgatcaccaagaaggaactgctgaccatggacccagacaccgaggacgcgcagcttgtctatgagacaacgacgggccctaagcatggctttgtggagaacaagctgcaa

SEQ ID NO: 20788 - DNA, 1857 bp, Homo sapiens
  misc_feature (1)...(1857): n = A,T,C or G
ggcacgaggccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggatcgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacagaaaaaaaaaaaaaaanaac

SEQ ID NO: 20789 - DNA, 275 bp, Homo sapiens
gcaacagagtgagaccctgactcaaaaaaataaataaataaataaataaaatttaaaatgaagacaatctccctggtaccaccaggtgggagaagaggttagaattatgctcaatcagccacgttcaaagtaccataacaagcagttctgctggtgaagacagtctggcccactgctcactggctgtgtatatggggtacccacgtccagtgcctggcagaggaaaggaccaccttcctaaatcatgcttatccctccccttctcagtcataaat

SEQ ID NO: 20790 - DNA, 459 bp, Homo sapiens
tgaccttggaactggtcgcacaccccattgagcatgcagccactgaaactatccaattgatgacacggcagatgccagccaccttctcaaaggaacaaccggatggacatggacatgtatagcaacgctgtgttctgaacatacatccggtgttactgagatttcaagtgatcaggacgggtaaggcgaccacagggtcaggccttgcatatcacggataggcgaggccacagagggaagaccatctgtaactaagagtcggagcccttcactgggccgtgtgggcaagccccgtgtatacccaaatacctggaaaggggagggccctgagaatgcctggctcctatcacgacgaatgtggcaggctgacgcagataacatcacttgaacccaacccggggaaaagtgcagagaccccatcattgaaacagtgcacttgacctgtggctacgagtaaag

SEQ ID NO: 20791 - DNA, 1964 bp, Homo sapiens
  misc_feature (1)...(1964): n = A,T,C or G
ggcaccaggggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggaccctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctggatctgtgcgacagagtgagcgaaatgcagaagctggatgcacaggtcaaggagctggtgctgaagtccggcggtggaggctgagcgcctggtggctggcaagctcaagaagnacacgtacattgagaatgagaagctcatctcaggaagcgcaggagctggtcnccaagatcgaccacatcctggatgcccctgtagcccctgcccgcattctccaggggccccaggggcctgccttttgctgtgcngcaatggttggtgngnnnngag

SEQ ID NO: 20792 - DNA, 535 bp, Homo sapiens
ctgaggaagacagaatctatgattcaaaaaaatgttgctatacatgtaagaataattgcagatcttcccttgtaaatgtgactgttatctacagtggttgcaagaaaagagttcagatggcaaaatgcacaggggaatgtgaaaagactgccaagtacaattatgatatcttactcttggaacattcatgcctttgctgccgagaagaaaactatgaactcagagacattgtacttgactgtcctgatggcagtacaatcccttaccaatacaagcatatcacgacctgctcttgtttagacatatgccaactatatacgaccttcatgtacagttaatgctgacatcaccttcccagttttaacaggcctggtatttattttataagtgaggaaaaataatcatttaaaaagtgagaataaactaaacaatgtgagaataactcaaaacaatgagttctcattgtgaggaattttgttctcttgttgactggatctgaaaaataaacacaacttgacaagcaaaaaaaaaaaaa

SEQ ID NO: 20793 - DNA, 4029 bp, Homo sapiens
  misc_feature (1)...(4029): n = A,T,C or G
ggcacgagagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctctagtcctttaggtggtcgctgattcattacagcaacacgtcacagtcagtcataagaaaaaaaagccacaggcgcctggggtgaaagtttcctctcctttcccggagctttctcacggtgtttccctggcatattggccaggtccccctttctgcagcatctgagctctggtggtgctgaccagatcacacttggcgtaggaccctctggtccatgttaaggggaactagtttttcctgggaagtaagccacaatgggtaggtttatgttccattgccacctttatccagaaccagtactcagagttggtggtagggtgtgtgactgaagtataaatggaatgtatatcttttgtagctagaagaaggaaatctttctgcagtttcatgttaaatatattatgtagcaaacagtctttgtgattcctgccatgtgcaggcaagtgtccctgtaggaaccgtggttacaaaaacagggacgtaaagtgagtttttggtgggagatgatgcgtaaaccatctgaattctacagggacacctatagtgacaggagtggaagcagctcccctgactctgaaatcaccgaactgaagtttccatcaataaatcatgactgatcttgtagcgtaagtggtactttaaagttttagtttttaaaaacatggtgataacacactgcgattgcaagaatatcatggaagtttagggctgaaaatttttatctgccaggaatgaaagtggtgaggtcttgaatataatccagaggttgagagagaaaagaaagtagtgaggtcattgtgggtatcaaatgggcagcccttcctccaagttgcagtgcacctcccagtcctgccctggggatgacagcttggggagcattgtcactgggcagttgtctcaatactgattactacattctggtgccagtctgaccagttctggggcggggaaggggagggtcctgaattcttagacccttaatgttttatgtacctgtaaattttggagatcttgaaaggaagggacagaatccaccaattgtggcacttgtcatttctgcagagcctcaggttttcatcaggaagtactttagaaactgacactgcttagagaactttttttgttgagtgctgcttattctggaattccttcaaagttggaacaattgccaaatagacgtcgaatgtttgtctattaagtgacagggtttgtaggttcataaagtgcaataactgtgggcactgccacgaaatgtaaatgtcctttgagataactgtgtggactgtgttggcagaagtacgcattctgctggtgaggtatcaaatgagggagtgtcagtcatctggggtctggaataagaaccaggggtatgggtgtgtggttccaccgctcctgccctaaggcctgggcagggggacctccctgaatcctgcacaccgtgtgttcatcaccagtgggcctctggtgctgggtcagtgccggtctgacctgctgatcccagctgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctggactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccactttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggttggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcataagctacggggcactatattccggcccgacctcggtgtgtactctaacttaagaaataaatcagtaaggcagaacaagagacatgctttgcttctcattctctttatgtcattggccagatgggaagcgtctgaacacgttgctggcttgcttgtgtgcagtcagctgaattgtcagtgccgggtgctcctgcaggtgagcagccttgactcaacagacaacctgagagtttgtttaaaaactaaaaaaagagggctttcttctttaatagggaaccagaatctnttcataaagcttcaaatacagggttctcaagcag

SEQ ID NO: 20794 - DNA, 741 bp, Homo sapiens
gtgggggttggtggcggggcacctctagtcgaccgcagctgcagcttcaggttgagagtgtataaaagaaagcttctctcatgcagtgtacatttccacaaatctaagaattgccctataaacatagcaggattttgagaagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaagg

SEQ ID NO: 20795 - DNA, 151 bp, Homo sapiens
gggtttatataatcatagagcctggttacgtatctgtgctttatgcccagtaataacaccacagtggaaggtctatgggggttgaccctctgaaacttggattagcataccagaccgctcatgtggtccatacatgtgattaccgaagctg

SEQ ID NO: 20796 - DNA, 3357 bp, Homo sapiens
gcaccaggtcggcacctccctgcaagctgagggagccggctccagccttggccagcccagaaaggggctcccacagtgcagcggcgggctgaagggctcctcaagcgcggccagagtgagtgccaaagccgaggaggcgccgagagcgaaggagggctgtgagggctgccagctggctgtcacctctcagtgtagcggacaggaagaagaatgttgccaggcagctcctcccacggttcgtattgtgcactcaggcttggcctgtaacattgaagaggagcgctactccgaaagggtctacactatccgggaaggagaaacccttgagttgacttgtctagtcacaggacatccacgtccacagatcaggtggaccaaaacagcaggaagtgcctctgacagattccaagactcaagtgtcttcaatgagactttgaggattacaaatattcagcgacaccaaggaggccggtattactgtaaagcagagaatggcttggggtctccagcgataaagtcaatcagagtggatgtatactatttggatgatccagtagtaactgttcatcaaagtataggtgaagctaaagaacaattttactatgagagaacagtgttcctccggtgtgttgccaattccaatcctcctgttcggtatagctggagacgtggccaggaggtcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactgagagcctatccaatacgggtgctgacctatgagtggcgcttgggcaataaattattacggacgggtcaatttgactctcaggaatacacagagtacgctgtgaagagtctttccaatgaaaactatggggtttataactgtagcatcataaatgaagctggagctgggagatgcagctttcttgttacaggaaaggcctatgctccagaattctattatgatacctacaatccagtatggcagaacagacaccgtgtttattcttacagtctacagtggacacagatgaatcctgatgcagtggatcggattgttgcataccggttgggcatcaggcaggctggacagcagcgctggtgggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcgctggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaaatgaaaaaaaaaaaaaaaaaaaactcttcttt

SEQ ID NO: 20797 - DNA, 492 bp, Homo sapiens
cgcgccggccaaatgtgttgtgtttttgaacattcattttgcttttccaaaacaacctttccaggctattcctgttattcacagactgcagttcattgatgatgccttttccttgtctaaaggtacctattaaagagacttaatttaatatggaatatttattcaactataattcgtgaaaatgtgttggcattacaagatgactacttagctctaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaggattcaacttgcttatgcaatgagctgcagcaaagacccatggatacttaacaga

SEQ ID NO: 20798 - DNA, 394 bp, Homo sapiens
tagcgcgtgaatcagatcggggggggggggccaaaagagacttaatttaatatggaatatttattcaactataattcgtgaaaatgtgttggcattacaagatgactacttagctctaatatcactggaaaaactttttgtaactgcgtgttggttgggccttgaagactgccttcagctgtcaaaagaactttttgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacaga

SEQ ID NO: 20799 - DNA, 1975 bp, Homo sapiens
tttttttttttttttttttttttttttttgtgaacaaactacattataatatgcaagaggagtgctgaaagatagccacaagctatgtgtttctccttagccacgcagctatcctggcacttagcttcttgtttttcagattttcattctttattgtctgtaagttggcatgaactctgatcctctggtgttcctccaacatgttactgaaaaactgctgcagctccacaatctgtaaatctgtagttacggttctccctattgtatatattagattaatcaatgattgtgttccataccttttactcacagcttgccagttgttgactaagaagtcttttgcgacataccggccaacttcagatgaagccacaacctcaattatatttgtttcattagaagtgaatggagatgtgctgatggcatactccatatatctgttaagtatccatgggtctttgctgcagctcattgcataagcaagttgaatcttttcttctttgtttgttgtattagtgtaagtatttaacaagatgtcccactctttatcacttcccaaggcaatgccataacataaaaccacatctttaattggataaggtatttcattttctggatgatccacccattttgcgaaaagttcttttgacagctgaaggcagtcttcaaggcccaaccaacacgcagttacaaaaagtttttccagtgatattagagctaagtagtcatcttgtaatgccaacacattttcacgaattatagttgaataaatattccatattaaattaagtctctttaataggtacctttagacaaggaaaaggcatcatcaatgaactgcagtctgtgaataacaggaatagccttaggatccttttcaagttgttgatttagtttcttccaacctaatttatcataattaactctataatatccagtcatattcaaattcaaaatcacccagtcatggtcagaatctgaaacttgcatttctgggaatactttgctgctttgatctagccagactaaaggttgtgtagttccattttttatccaaagaatagggacaatccatgtgtcattgctggttagaagagtccgatttttaatgttttcaagataaaatggctcctgtttcatgacgccagtagacacgtttaaagtgatcactggaaaaccactctggtgtgtccaactgtccattatgttttttattgttgctggcaaaataactgtactctggtcatctatggccatttgaaaatgcctccatagatcatcttgctcagcgtttgagtaggaaaatgtcttcaaatatgacttgagtgcactgacaaataaatgctcattcaagaaacaagaaagcatccgggccatagacgctcccttgctgtaagtaaatatgtcaaagagttcctgtatttcacttgttttgaaattttccaccttcatggccacagctctagtcaccagggcgtgatcttctctgaggatattatgtaaaatgttagaaaaaaagatctcattctttggcaagtcatttaacctttcagtacttcagtctcctgatctatataatgacgtccaaactttcctccaggacaagcagggcctgtgtatagtccatggggaggaagagagaggcactgcggagtgacctcgagtttttttttttttttttttttttttttttttttaagaccctcatcaatagatggagacatacagaaatagtcaaaccacatctacaaaatgccagtatcaggcggcggcttcgaagccaaagtgatgtttggatgtaaagtgaaatattagttggcggatgaagcagatagtgaggaaagttgagccaataatgacgtgtagtccgtggaagcctgtggctacaaaaaatgttgagccgtagatgccgtcggaaatggtgaagggagactcgaagtactctgaggcttgtaggagggtaaaatctcgtgcc

SEQ ID NO: 20800 - DNA, 489 bp, Homo sapiens
aacgagttccagtcctgcaagcttcattcatgagaagcatgttgaagaacagtgtcaaactgaagttggtatttgaagtatgaagcaactttaacagctaacatgtattgagtgttcactctgtctcaggttttaaaatcagacttgttccattatgaagagacaatcatggaacctaccggttgcctcttggtggacacatacgacattctctgtgtggaatgcagcctggattttctaggcacaattatcttagtttgcaggtctccttgcaaaaacaaaatgtgtttcttaattgaacatcaaaaaaatgaaagaagccagaggttgggagtcctcatgacaagaaaggccatcgtgaatgaccctagtagttcaggtgattctcattttgacaaagctctatgactataacctggggagcatcacagagagctcgctttggaggtcaaccgattatggaacaacctatgagaagctgaatgataa

SEQ ID NO: 20801 - DNA, 2131 bp, Homo sapiens
tcacgatacgtgagtctagcgtgggctgaggaggttgggcgggaatacggagctcgactcggcgctgagggcatacaggagaacgattatgcttcaatgccgtgctcataaagaagcagaacggtcttttcttactctttgtaggggacgtcccggcagttggaacattctacataggtaggccatgtcctgtgtgctcccgttctccagccaatagcgacaagccttgcgtgccaaaataggaaacataccctcaaaggaaagaaaaaccaacacgcagttagctggtcatgaagtatgatgcccttggcgagagcgagattctttcttgataagcaggtggcctgtagcctttgagggttttccttaaattgcatactgtgccccagcagatccccgctttggcgttgaaggcggagtggcgtgtcttgctctttgcaatcgcagagatgagtcaccaggttgagtagaaggggagggaggggagggtaaagctactctcctaagagaaaacgtgtaacacttactcatttaatgacactggaaagggaaaggtgtcagagactttgcaatgtgctgcgatatcttcctggagaaggaggaattactactttaataaagcaaacagaggctgtgcttcataccctacggaaatgcgactgagaaccaaacgatccccaaaaatgcacttagaagctttaggaatgagtagacagggtgaatgcctctctggacttgaaggcagaaaagactttttttttttagccccaagcaatcacacatttattaccttgcctctccaaataaaagaaagtgcactgtgaaaatcggacaccagatgtgactgcagttgttatcattatctatgataggagccagtcactgcatttacatttccccttaacacagccacagacctttcccatattcatttaaagagggttatgtttccgtttacatactcattgttttccaagtaagattaaaaattttatgtaaaggccttctaggtggtttggcattatcacattagagtggagcatgaatggttatataataatttattcactgttgtcagcaatgcaggatctagatgtaaacatataaggcttcaactcctaatgccaacagacaggaggaaccagacagagaaatggatcagcaatagtggcttcataggtttgtctagcttcctggaaaatttctgctgcaataaatagcagaatctagcaagtgaacgtcagattctctatacctcgttgttggattcccatgcctacttcacaggcagagagagagccattgaaatatgagaaagtccattttacaacttctggtaagggacagtctaaaaagaggaagaaatttgctaatctgctctgtaatagtctcacccaccagtggtctctctcaggatgctccactgcctggatgtctgcaaacattatgcctcttgtcctcaatcttaggttccaaatctcctgagggaaagttcctagactaccaatagatgtaaaaaaaaaaaaaattccctggaggatcaggctggccactctcattatgtcacttctctactggtgttccagagcagtttgccctccttaagagctgtatccagttgaggctaccatgtttcattctagtcaatacataccatgtcctgcaaaccctgcccagccctctggtccaccagccttagcctctgaggcctctccttcttatatactattaaagcaaatgctttgctctttgcccataaacatataacattttaacattttaagcccaatattttagggagggttttgcaaaaggaggaataaactaatgagagaaaaaaactagatagaagcaagaggtttgtttgtttttcccccatcccaatcagaggaagcagggaaaaagccatcttagctgtttctctcaggggtgttagagcaaaagaaagtggttatgtcaagccagaaggggttagagagagagtcagccattgcctactcaaccgaacagctggtggctactgggaatctttacctatgagctgggattccacttctcatctataactggccacgcctccttatttaatccgaggacactggccctgtttcagaagactgacggactgtct

SEQ ID NO: 20802 - DNA, 1837 bp, Homo sapiens
cttggtctttacctttctcggatcttctccaatcatcaaatcttgggtctgctttgactaaggaaatcttgggaccccaatcaggtttcctgtgttttcccctttttgtggatggggttctgggtgaggcctggaaaacagactctcatcatgccagtgttgggcacttcagcccccgctgtgaaggcaactgggccaaagtagatttcaagtccatttttgatagacggtgtgccaaaaagaaatacagaccttggcagctgcacagccaggggagagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttatgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagctccatgttcctttccatgaagatgccagcactgacacctaagatgtgttctgctagaaaagatagtaagaagcaagcaactttaccaaaatagtgttcacagcatatataatgtcctttagaatatatgtaacaacttgtaatcttttgaaaaaatacaggataaacacttctacaagtggtgtggaaaacatctaaaatattgtcaaaatctgtcaacagtttcatactcatttcagtagaaaagcacatggttctaattgagattattcttatatgcaatgtaaattttatttagttttgttttcttatgcaaattttttctcacaaagcatgtgttcattgttgaatgtcctttgatgcaagttaaatatatgaaacgtactttctgttaccagataatttttaaatttaaatttccttcttaaaattttgtaaataaacacagatgcgagccg

SEQ ID NO: 20803 - DNA, 3179 bp, Homo sapiens
aaaaccggaatgcccagtgcacccaaccgagttggtgtttgccctggaccactcccgggatgtcactgagcaggaatttgagcggatgaaggagatgatggctttcctggtgagagacattaaggtccgggagaacagctgccccgtgggagcgcacatcgccatcctctcctataactcccacgccaggcaccttgtgcgcttctcagacgcctacaagaagagtcaacttctcagagaaattgaaactattccttatgagagatcctctgccagcagggagattggcagagcaatgcggtttatttccaggaatgtcttcaagcggacgcttccgggggcacacacgagaaaaatcgccacatttttcagcagcggtcagtccgcggatgcccactccatcaccacggctgccatggagttcggcgcgcttgaaatcattcccgtggtgatcactttcagcaacgtgccctcggtcaggcgcgcatttgcgattgacgacactggcacatttcaagtaatagtggttccctccggggccgactacataccagcattagagagactccagcggtgcactttctgctatgatgtgtgcaagccagatgcttcttgtgaccaagccagaccaccccctgtgcagtcttacatggatgctgctttccttctggatgcctcccggaacatgggaagtgctgaatttgaagacataagagccttccttggagcactattagatcactttgaaatcaccccagagccggagacttctgtcactggagaccgggtggccctattgagccatgctccccccgacttcctacccaacactcagaagagtccagttagagctgagttcaatcttaccacctacagaagtaagcgcctcatgaagaggcatgtgcacgagtcagttaaacaactaaatggagatgcttttattggtcatgccttacagtggactctggacaatgtatttttaagtacacccaatctgagaagaaacaaagtcatatttgtgatatctgctggggaaaccagccacttagatggggaaatcttaaagaaggaatccttgcgagccaaatgtcagggatatgccttatttgtgttttcccttggccctatttgggatgacaaggaactggaggatctcgccagccaccctttggatcaccacctggtccagcttggccgaattcataaacctgaccacagttatggtgtgaagtttgtgaagtcctttataaactcaatcaggcgtgcaatcaacaaatatccaccaataaacttaaaaataaagtgcaacagacttaactctatagatccaaagcagcccccacgaccattccgaagctttgttcctggaccacttaaagctaccctcaaagaagatgtattacagaaggcaaaattctttcaagataaaaaatatctttcaagagtagcaagaagtggcagagatgatgctattcaaaattttatgagaagcacctcccatacctttaagaatggaaggatgatagaaagtgctcccaaacaacatgattaaaaaaatgcttgaacaacttagccttaggaagcatggtaagactctggacttaaatagtaactaaatctgctgccagaactcaagcaacagtttgtaggttatcaggtgacttgaccccctgcattcattggtattaagatatatcttgttcatttatttgaccactcctgacaattccagcactctacgactgatatgtcgaagaactgtttcattagaagacagaagaatgaaagaagtgttttgaaaagtctaatggagatataatttgaaggtaaaatttatatgatgtatgcatatgtgtacatgggtcaatgttaattcttttatctctgtccagttcattttctgcaaacccatcctcctttcctaatttagtaatgtctaatgctcatctatttagtcaaagttattttttaatgttttaagctactccaaaatttatcctagaaatggcatgctgtttatatgtcgtatttttttaaaacgtgaccttctattccacttaaacacaccactgtgggagttgtttgcttggactgatgagaagagggtaattttctccatctctaaatcctcctgaactcactgaaaaactcattaattcccgcagaacataaattattgcttttgagctggaagttttctcttcattaggaagcttactgccattttgatggagcttgaagcccccattttgatggacttctagtctgtctttcctgttatggtcatttattaattttcactaatccatatattctttagacaaggagagtcaagaaactacttgtcatagatgaagctctgagttacttttacccatcaggtagctgtttagtcaataataaacagcaccaaaacaggattagcagagctcttaaaaacagccttaaatacacactgagtttagaaaaatgtaagaaaatcattgttttaatctacaaattcatatgcagttgcagagatgcaaaagagatcagagtaagttaaagtaggaaaggttttataaaagtattgatggctgtgtcctcatctgcatttttgtttttatgatagggctgatttttcaacaacgaaacacccaatgttcagaccttacctcagtctaagagctggctccacagttggtagcaatggccctgttaggcagactgtccccctctttgggaatggaaagaagccctgcctggatgcatggagcagatggatactgacaccaaggacattcagattttctttcctatacctattttcataaaatttggaaagaaaaactatctgcagtatttttttaaaacgacttctgctattcttacttagagaaatccagtgatagcacctcatgtcttcagaggagcaagaagttcaaggagttaaatgtcacattcatactcaggtaatagagaagaataaaacacatcaggtttgcttcatctatcctaagtggtgcttaggggttcagaaaaaatgtttcaagtacaggaaattaatgagcaatatttacaatgtattttaataaaagggatttttctagttaactctgagttaagcacgaactcctttcttttgttaattgttggaaataccattaagatgtattctgtctggtttctctgcattggcc

SEQ ID NO: 20804 - DNA, 1131 bp, Homo sapiens
  misc_feature (1)...(1131): n = A,T,C or G
tttaacttgggggcctatggttaaatacagggatatttggggggaaaaaaggtgggtttttccccccccccccttagggggggggggaaaaaacccccccacaattggcctttagagaggagaataataaatctccgcgttattagagggccgccgccccccgcggaggagcggggcgacatataatataaaccccgcgggggggggttgtgggggggtttttacccccgcccgagggtggaacccccttttattttttgtgcgcggaggcgcgcctctagagagacgcccgcgcggnncttnattggggggatatttcttctctcctccctctttctttanctacgaacagagcagagggggggggcgggtcttctcttctctcccgnggaggaattaattttataatgagggggggggggggggggcggcgccgnccgcactcaatatataattattatntggatagggagggtggggggggggagttcttataaaagagaaagagaagagacgggggcggtgtgtctcctcgctccgctccgggggaggaagaaaaaagaaaatattttttcttctgtccgcgagatggnaagagnaggggagaggagggcggccgcggcgccgcgcgttgttttntatttttatatgtgtntattctccctctcnctcctncgcncttgtagagagagtgnggtgggtgagncgcgagananacgacaaacataccaacacacccacccacctcctctttcttnattttggtagtggggcgcgggtgggnctgtcgtctnaagatgaataagagatagaacatatatannaanatacatagatnaataatagagnaggaggaggagatgggggnaggagatattaatnatattattatatatatnatatctcatcnctaatncttctattatagtagngaggtgacaaatnataatnnatatatatatnacataaagtatatnaatcaatataaagaggaagtaagaggtnnnagagagagtagataggaagaaggnagtgatgggcggaaccggcgtacatcgcgaagacaaggnacgaggagagaagacagagnagacttcgaagatgattattnatatatantcatataaataa

SEQ ID NO: 20805 - DNA, 4000 bp, Homo sapiens
accggggaagacggagactgggggccgagccctccacacccccggggccgctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatattggaatgtgaggaattccatcaaggggacctctccagagatatggacactctcttgctttatatcaggaaaacatctttatgtatggaggcagaattgaaacaaatgatggcaatgtcacagatgaattatgggtttttaacatacatagggcagtcatgggagtacaaaaactccttactgttcttggacatggtcagcagtatgctgggggagggacattcagcacatattatggagttggatagtaagaaatgttggcatgatcataaatatttggatattctgcaatatatggttatacacgcagcatacaggaataccatatttggggagttactttaaaaattgtaatttctttattgattgggaatgtttttctctttaataaaatcttcatatgaatttagtcaaaatggtgagttatttgagattgaaattataagctgataattaataatttttaatataagcttttttgattatgttagattttgtcctttaatatttaagcttacctttttaaccaaatgaggggaaatattacttaatagtctcattttctaagatttgtgaattttttaaaaaaatatgtgaaattccagtaggtggtgctatttctttggattttatttatgaacgaagtactgaaactatcccagtctctttactatgcattgcatggtttcaggattttttattttttagcattctatttctaatcttactgctatatctttatgtatgtattacttctttaaagtcagcttctcaaggatagtctgctggcttctataagagattattatctgttatgtgaaggtgaaggtgtctagggcaatctacatgtgagtttttgtactatacctttactccattttgtttttctggtacttcatttttttgaattatttataacatttttaaaacagtggtaaccttctttattgtttttagtttgtttacaaatatatgccctatggtggttattcagattcaagaaaataattcttttctggctctggccagtatgatgaactcaaattcttggctcttttgtgtatggacaactatatatacaactatttagagtccttgtgcagtcttaatgagaaaactcatttgcagaccaccattagcaagagagtacttgtatgctcagaggaagactccccttcgaaatactccactgtttcccttgcagtcctttcaagtgatggctgtttttgtttacatattctcagtacagctgggtcaaaagtgggttacatatcccctttacttcttattgccatttccactctattctcaattcctcctcctttaaattgcctggctttgactcttacatcatcagaatatatcacctattacttcaccttcctgcactcatcctttgctctcagatggctgtgttttatttcttgaggaatttagcttctggcttactgtcactgtgtccagaatacataaggcaaatatttttatgttgtaaatatgcacttaagtacttctcctacctggcctgtcaatttcttgatctaccaaagattttgttttccatcctccttgagccactctctccattgttacgttctagaccttgttattccagtacaatgagtccataatttccatatgaaatatcttacttttcaagtcccactgatctctccagcttactgtttctaatgcccacactctgacaattctttgaccttaccagagcctttagtctgttgagactatcagtttttccactatctctcactctttttttgtccatatttctaatcctacctttttaatccatacttctagccctacccatacttctaaacgtacctagctttaaatttcataattactgttctcaagttgtttttttttttttatgatatccggtacttactcagctgtaagtttataattactcatgtcaagttggcccttaatgacatctggaacttctgccagtgtagcttggtctcgctcccagctctcctggatgactatttcataccttttcctctctcctcaagtttcaaacacttccttctctatcatcactcgcaattgatgaccttagttcttattttactgagaaaacagaagtaatcaggagagaatggctattgatgagaacacgttggagggtgatggttaataagcaatgctacattgaataagcttgcttacatacattattgtcataacaaactcatgacaacgttgaggcagatgtgtggctgagttattccaacttttgaaatgggcccaggagtttttaagcaagagttaacagatgttctatgtagaagggcagttttcttttctgattttgttattaatttttggttttattatagtgctcaggaaatgttggtcttatttctactttttaaatttattgaaattttctttgtgcctcagttttcacaaatatttgataggcacttgagaagaagataaatccaataatatcaaggtatggagtttgatattatttatttataaaatcgactttattgattatattgtttaggccttctgttactgacttagtattttttgttcttgatttatcttgctgcgaaagtggaagtaaaattttaaagtgttagtgtatttttcatatttctccttatatattctggaatttatgttttatagaagttgctattacaaatattaataattgttatgtgcttattgagaattgaattacttactattataaagtggggtggttgatggggaaaaaaaaaaaaagagaactgggctctagattgcgaggcgggagcataagtgaggactagaacaagtcccgaaggaggaggcctgagagccccaagccaagggcttaacctggaagctgagaaagggagccagagagggcagccgcgggctgggggtggggagagaaaatgttagcaatgtatggagggaggcgggggggggacttggttaggatactgatatcccatgtcacgagatacactatcctgctccagacataccctct

SEQ ID NO: 20806 - DNA, 655 bp, Homo sapiens
tcatgggttgttgacaaacatatgatgaaggccattataactgcttttctgccccttgcaattacccacactttggtagtctttctttaaatgtaaattattaaggtcacagcttccatattttctcagaatcactttttgaaatgaatcttttatgtcatgatccggcaatatctctgcagtaaaatgaaaagaaccagctgggtgtttggctactgcctcctgtctcttcactttccaaggctcttttctttgctccagacaggtcatcaagtctggcttaaagatagcaagacccaaggagaccaggtttccatagttctctagcatcacatccctatacaaacgctgctgagcagagtccaggcattcccactcttctggggagaattttgcagccacatccctgaatgtcaacactcccatttcccagcctccagatgttccgccgtcctccctatggatctcccagtacctgcaggtcacaggataacagaagctatagtagagtcaccgaggaactccaggaacggaggagatggaacagtggagacgcgaactaggatcagagcccggaagctaggagacaaaggccccgccatattgaagaggccgcctcttcctctgtagctgcgcacttgattggacagtttcc

SEQ ID NO: 20807 - DNA, 490 bp, Homo sapiens
ataagccatcactcctggcctatcaaatgagaggattattaaatgttattctgttactatttatttcactgttgtataatgtgtgtgtatgtgtgataacttgtatttttaattcaaatatctccaaaggagtcatacccaggcctgatataaagaccatcacatgatctggattttgtctatgatggggcattgcattggaatggaatttttgttatttctctaaggaaggaaaagtatataaaaggaataaaagtgaatatttgtgagcaaatatttttgataggttttttttttcttaagagacatgttgcccaggctggacttaaactcttgggctcaagcaatcctcctgactcagtcttctgagtagctgggactataggcagaggccaccatgcctggctgactgtattcctttccaaaacattttcttacactcttaggattacacttgctactccattgtaatcaagctgggcctggtgcc

SEQ ID NO: 20808 - DNA, 2026 bp, Homo sapiens
tttttttttttttttttgaccaagataaacaatattttaaaatcaaaattaatgcaaacatttctgatgaataaaatataaaaatgctaaatgaagagaggatccaactttgcatttgccgggccctgtgtcactcctctcatcctagtcacacctgttgggattacaggcatgagccaccataccctgcccattctgggttttaaactgtactttatttattactattctctttttttaaaactgatcaaccacaagcatacaaaagttctctgaatgaatggaactgtttccacacctgggtattaacaggcaaattttgaaggtcattcgatttggaattttcttttctatagcacttctaatcagtgtgtgtgacacacacctcagaggtaggaaagactgtttttagtaaattatcttcttaattgtagagaattcctgaaaataaaactgatgaaattataaattctgccttgatgagtttccaaaggacagattcatggtgtcctatttgaagaattaatcccctggaatgttccagcctttgttggacacttgataacaagatccaccaagggttagggcaagtgcactaagaaagccttctgctactctccgtctcttattctttagaccatccagtcttgctggcagagaggtcagtgattgctctgttgtacccacagggacatgcaacagttgtggaaggagtgattacattctcctcagatgacaacacagttctcttgttttcagcttgacacccaagaaaggcatccatcacctcgaccctgcagatggcagttgtatggcactccgtgtcgcagctctacatgcccactgtgtttcacacctgggcatggtggcatgagcctgtgttcccagctgctctgtaggctgaggcgggaggatcacttgggctcacgaggttgaggctgcagtgatctaggatgccacaactgcactctagcctgggcaacagagtgaaatctaatttctaaaaaaaattaaaaataaacatagctatcatatgatgcagcaatcctatttctgggtatatgtctgaaagatatgaaatcagtagatcaatgaagtatctacaatctcatgtttgttgtagtattattaataattgccaagatatggaattaaccaaaactgtccattgatgcatgtgtgattaaagaaagtaagacacacacacacacacacacacacacacacacacacacgggaatactattcagacttagaaaagaagaaaattctgtcatctgcaacaaggtggatgaacctggaggacattatgctaagtgaaataagccagccacagaaggacaactaccacatgattccacttatatgtggaatccaaaaaagtcgaactcatagaagcaaagaaagaatgccaggggctggatggtgggcagaggtcggaacatggggaaatgttggtcaaatggtaaaaagtttcagttagacaaaatgaataagttctggagatctattgtacagcatggcaactacaaggaataacaatgtattgtatatttaaaaattcccaagagagtagaactcaattgttcttatcacaaaacatacctatgtgaggtgacagatacattaattagctgagtttaatcattccacaatgtataaatgtatcaaaacatcatgttgtacactgtgaatatatacaattttatttgtcaatcatacctcagtaaggctagagtgaaatggaggaaaacaccatgggcaaccactgactagaatcagaaccacagggaatagtccccacccctgggtaacagtgcctcagagtgtctgcccaacagcatttcaaaatttctagggaccagggactattctgtgcctcccattcttccccttcccaaatgagaggtgatttttttttttttttgagacagggtctcactctgtcgcccaggctggattgccattgtgcaatagccatcccacctcagcctcccgagtagctgcgatcacaggcatacacaac

SEQ ID NO: 20809 - DNA, 555 bp, Homo sapiens
  misc_feature (1)...(555): n = A,T,C or G
ggcacgagcttaattataacattcatagccaaggtgtnntttaaccctcnncncaacacaccatacatccatcaaatcttctttcctcccattccctccctctcttctattacccacccctaaaacccccccccctctacatctatcttaatattcttccttaccaacccaatccaacattgtactcgccatgacatactcccctgtctctcctctcattgcttcgttactcaatgcatcggctctctctgcaatcactttccgcccatccccctcatacttatctccgattcccacgcggagaacgcggccgttaaataccccctattcctaattctaacaggtaactactcttttcgacgttaaaagagagctagcgaactgaggtttttgctataacaccatcattcgttaatagctaaatttcgatcgacctaactcctgttaaccgcgacccatccacttaacatcagacaagatcctgcacatcgtgcctgtcttccctttcctctggccgtattagtatcattctgatgaaatgatgtacaaccattc

SEQ ID NO: 20810 - DNA, 657 bp, Homo sapiens
tcatccttggagtcacattggaagagaagcacagatccacgaaggataagtggctcaggaaaaagtacatgggcatgtggagccaggcgttggcctggatgaggacaatcatgccaaggttccctgccaccgtgaccatgtaaatggccagaaacagcgtgaaggggagaatttgtaattcccggcgactggtcagtcccaggagaatgaactcagtcaccaacgtgcagtttcttctcataatttccttcggtggaagaaaggaactttacatatatattggattacaatacaatagcaacatgattattactattacagtaatgatcttttaccaaaaacgtcccctctttttggcagttttcctcatactatttctactgaactttgtttcaggtaaactaaattagggatattcaaagcagctctctaccttttatgatactgccctttatttttcttgttttctttccattttctttcttttcactcccttcaaattcagcttctgtttttctattcttcttctctcgtttctcctccccttattctgcctctccttttatttgagaaatgtactttataggtggacttgccccaaaacataacattcagaactaagcaatttccaccccccccgatctgattcacgcgcta

SEQ ID NO: 20811 - DNA, 946 bp, Homo sapiens
aggggggataggtgtatgaccatgagggggttttctcgtgtgaatgagggttttatgttgttaatgtggtgggtgagtgagccccattgtgttgtggtaaatatgtagagggagtatagggctgtgactagtatgttgagtcctgtaagtaggagagtgatatttgatcaggagaacgtggttactagcacagagagttctcccagtaggttaatagtggggggtaaggcgaggttagcgaggcttgctagaagtcatcaaaaagctattagtgggagtagagtttgaagtccttgagagaggattatgatgcgactgtgagtgcgttcgtagtttgagtttgctaggcagaatagtaatgaggatgtaagtccgtgggcgattatgagaatgactgcgccggtgaagcttcagggggtttggatgagaatggctgttactacgagggctatgtggctgattgaagagtatgcaatgagcgattttaggtctgtttgtcgtaggcagatggagcttgttataattatgcctcatagggatagtacaaggaaggggtaggctatgtgttttgtcagggggttgagaatgagtgtgaggcgtattataccatagccgcctagttttaagagtactgcggcaagtactattgacccagcgatgggggcttcgacatgggctttagggagtcataagtggagtccgtaaagaggtatctttactataaaagctattgtgtaagctagtcatattaagttgttggctcaggagtttgatagttcttgggcagtgagagtgagtagtagaatgtttagtgagcctagggtgttgtgagtgtaaattagtgcgatgagtaggggaagggagcctactagggtgtagaataggaagtatgtgcctgcgttcaggcgttctggctggttgcctcatcgggtgatgatagccaagg

SEQ ID NO: 20812 - DNA, 1533 bp, Homo sapiens
tagcgcgtgaatcagatcgggggggcggggttaaaagtagcagctagtctaaattagcatattctgtttgtcacataaagaatgagctaaaatgtatttttagttttttactacctatccttataacaggaacctaagggattttatctgacatggcatggaagaattaactgtaatcagaaaaagaatgtcaggtaccaggttctcaacttacagttaagttagataacttatagctaagttatctaaacaattaatttacaaaagtgctgagtattcatttgtttattagcactagtggcaaaatctgagcaataaagatgtgagataaaaaagcaaaatgtaaaaaaaaatagacacagtagaaatgaatatgagtaagaaattaagtgacataaaccgaaaagattagaccctgtttcaattaaatcactatctctagtgtctcctgacacaagacaaatttagaaaaactgcagaggagcaatgcaaaacaatgtttcaagaaaatataaaaatgtttgccctttagaaaatatctactaatccaacattctcatttcccactgaaggaaattatgagaagaaactgtacattggtgactgagttcattctcctgggactggccaatcaccgggaattacagattttcctcttcacgctgtttctcaccatttacatggtcacggtggcaggaaatcttggcatgattgccctcatccaggccaacgccccggctccacacgcccatgtactttttcctgagcaacttatcctttgtggatctgtgcttctcttccaatgtgactccaaggatgctggagattttcctttcagagaagaaaagcatttcctatcctgcccgtcttgtgcagtgttacctttttatcaccttggtccacgttgagctctacatcctggctgtgatggcctttgaccggtacatggccatctgcaaccctctgctttatggcagcagaatgtccaagagcgtgtgctctttcctcatcacagtgctttatgtgtatggagcactcactggcctgatggagactatgtggacctacaacctagccttctgtggccccagtgaaattaatcacttctactgtgtggacccaccactgattaagctggcttgttctgacacctacaacaaggaggtgtcaatgtttgttgtggctggtttcaacttcacttatcctctccttatcatcctcatttcctatctctacatatttcctgccaccctaaggatctgctctacagaaggcaggcacaaagctttttctacctagtggctcccatctgacagccgttactattttctattcagctcttttcttcatgtatctcagacgtccatcagaagagtccatggagcaggggaaaatggtagctgtattttataccactgtaatccccatgttgaatcccatgatctacagtctgaggaacaaagatgtgaaagaggcattatgcaaagaactgtacaaaagaaaattgttttctaaataaacatagatcggccg

SEQ ID NO: 20813 - DNA, 877 bp, Homo sapiens
catcctgtcggcaatgccagggtacatggtggtgccgccagacagcactgtgttggcgtacaggtctttgcggatgtccacgtcacacttcatgatggagttgaaggtagtttcgtggatgccacaggactccatgcccaggaaggaaggctggaagagtgcctcagggcagcggaaccgctcattgccaatggtgatgacctggccgtcaggcagctcgtagctcttctccagggaggagctggaagcagccgtggccatctcttgctcgaagtccagggcgacgtagcacagcttctccttaatgtcacgcacgatttcccgctcggccgtggtggtgaagctgtagccgcgctcggtgaggatcttcatgaggtagtcagtcaggtcccggccagccaggtccagacgcaggatggcatgggggagggcatacccctcgtagatgggcacagtgtgggtgaccccgtcaccggagtccatcacgatgccggtggtacggccagaggcgtacagggatagcacagcctggatagcaacgtacatggctggggtgttgaaggtctcaaacatgatctgggtcatcttctcgcggttggccttggggttcaggggggcctcggtcagcagcacggggtgctcctcgggagccacacgcagctcattgtagaaggtgtggtgccagattttctccatgtcgtcccagttggtgacgatgccgtgctcgatggggtacttcagggtgaggatgcctctcttgctctgggcctcgtcgcccacataggaatccttctgacccatgcccaccatcacgccctggtgcctggggcgccccacgatggaggggaagacggcccggggggcatcgtcgcccgcg

SEQ ID NO: 20814 - DNA, 2006 bp, Homo sapiens
ttccctcaagggtaaaatatcctaagggggaggttcttcccaaaatcctttcttggatcaaaaatgaatcacttttgaagtccttgcagccctttggcaaagtggcaataaatttaagcgtgaccttgcaatgtcaaacattaacattgatgatgattacgtcccgtgtctccaggggatcacacgagctagcttctgcaatgtttatctagaatggattcaacactgtgcacgggaaaagacaagagccttcaacgaccctgggacagtgacgaggactctcccttggtgactctgtccttcgccctgtggaaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgtttgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaa

SEQ ID NO: 20815 - DNA, 3216 bp, Homo sapiens
ttttttttttttttaaatgagggatatattactaacctctcacttcccgttgatgatactctttgtttttgagaatggggtgtgaaatccacatccagggatgatgcttgcggagctgagggagcacgtaatgtgttacaaaccccacggctccagccaaggcaaacagcacgatgctgagaaatggtcgcaatgacaggaatacagtgctggcgctgactgcaaatgagaggacagcaaccactgcgcagacgatgagatcccattttaagacatccgtcactgaatctttcatcttcttggggagagggtcagcagctgactctgccagattttgatgtaaaaatttaggaaacagcctgcattggatgaaggacatgagtacagatgggtcactgctctgacggctcagatggtaagaaagggcgaccaagaggccacagaaggccgaaaacagtgccgggatgtgttgcatgctccacggttcttgtagttttcctcccagaatttcactggcctgacatatgatgtgatgaaaatgacactcccaagaaatgggctcaatggggtagaaaagattgatgtggcaatcgtctgaaagaaaagcatggcagaatgaggaatggcaaagagctgagcaaacacgtgaaacgaagaaccccaagccatctgccaaggagccacatatgtcaggacgaactgtaacttgtgaagcaggtccccgagatgctaggcttgatgtcccaaatggggagaaaaagctgactcttactttgaaggctgaagggcagaggagttactagcgtgtatttcagcccctcccatgagatgaactgcagtaacttgcatggtttgagttaagggaaatcatcctctttgtgtgtgggtgccgtccttgctaaataaaatggacaccatgaagaaatccagtaagaagctctctgaaatatctttgtagtcaaagtggaaaaagatgacagtgaagctcaagttaataaactggtaaaccgggttgcagaatgatgtccgcaacagcttcatgccagcaatgatcatcagaaaaatgtcccagtgggtaccaagtctccggtgattgcttattaaaaatgcatcaatagtgagggcattcaaaattagcgctgggtacaagatgtatttttcaaaacactgaagccaaacatagagtctttcgaaccacattaaatgggcaacatctctcacttcccgttgatgatactctttgtttttgagaatggggtgtgaaatccacatccagggatgatgcttgcggagctgagggagcacgtaatgtgttacaaaccccacggctccagccaaggcaaacagcacgatgctgagaaatggtcgcaatgacaggaatacagtgctggcgctgactgcaaatgagaggacagcaaccactgcgcagacgatgagatcccattttaagacatccgtcactgaatctttcatcttcttggggagagggtcagcagctgactctgccagattttgatgtaaaaatttaggaaacagcctgcattggatgaaggacatgagtacagatgggtcactgctctgacggctcagatggtaagaaagggcgaccaagaggccacagaaggccgaaaacagtgccgggatgtgttgcatgctccacggttccttcactgcactgaagcagactgcgtggagcagggcggcagccaagacgctccgggccacactgtaaacagccgaggttatcccagacacagcagaaccaccaaaaaacagcatgtcaatttgctccaaaagataagtgcagaaagtgttgatttgcgggaagagcccaaggagggaaatagcagggaagcaatataaaaatactattaagtagtccctagctgattgtagaaacactggagagaagggcttcaggccatacacaacgtaactgggagggtgcctggctttggcccctgtatcaagaagcaaaataaggccacacagcacacaaaaatagattggtctgctatatgttatgatttggttgtgtccgtgtattggtgaggcggggtcaggctgaacactctttagcagggagtactggcagctggccatgacgaggcagaagaggagcacccacatatctttgcaaaagccttggctcaaggtcagaaatccaaggagggaaaccaggacaatgagtaaaatcgccagtacattctccttgatgtcttcagttcgatcaagtaatgccagcaaggtcagtcgatcataccagactttaatccacttgccagggaaaatgataaatttgtaaaactgctctcggttaaattttccttgtgttgaagaacatgacgaggcttccagatcctgactcacatgccgtggggtttccgactgggtcctgcgagccaccatcagtaacagctgttgctgaagggcactgacggcagggtccccagaagacggatcttgactctcagaagttgtggtactggaggagctgacctgcatctctcgagcctgagagagacagtcattatttgatggtagaggctgtaaagggccttctttctgatttccagattttaaataacaggatctaatttccccatgttcatcaatgaagacatgcatagcatccacagatatctcttcttgtacagatgtttcaggcccactgatgacttgcaagacagaactatcttgttgggaagttaccctgtagattatctgtctttgtctattgccctgaaaaaaggctgtggtcttggcaggctgagtgcatgcggggccggtgctagtatggtcttgactttgcaaatctggttttccttgcttagaactgtgtccactgggcttttcattttccaggatttcctcctttttttcctgggaacagttatctcggagaagcccactttcttcattctgctcagctgagccattcagttgactggatgccgtcatcttggaagtattaatggattctaacagggagacaaattccaggaagttggactcatttggcatttgtccttccttagcctctaggtcagatttggaagttggcattggtttctctgtatcgttaacaatttctgcagaacttttactcaagaagacatctgtcccactgtccacactgagcacccgggcatgcctctttttcatggctggacttacaagacgatgggtaaagggttagtctggcccttccttccc

SEQ ID NO: 20816 - DNA, 847 bp, Homo sapiens
ctaaaaccacgttttataggtattaacttttaggtacatcattttactcaatgacctctttgcaaaatcctaggccttcacttatcctgctcactacttttgggataggtcataggccatatgctgcccttacactgatgtattaaacccaaaattattaaacatgcgaggggccggaacaacgggcagaactgcattgaatttagggcgaactgaacaagagtttaaggtgatttttaaataccttaccacgttgaaaaaatccttctttcttaaataagttttcatataaagccaaggacttgcaacttaacgacggttttacagtcttaagcagatcttagcaaactgctcttgtgttcactgagagctggcgactagtccatttttcttgcggaagcccgcttaaacagcttctgtgcacaggttcctaatataacatgcatatactaaacaggaccctgctcgtgaggatgactaaggagacatagcgccctattgtcatgagctttgtacaaacttctaaaatacaaagccggccctggagatccggcggtgggatatagatgatcttatctaatcttccaggtcgtgacaaagcagtatctaacccatcaggtctatttgttgctggaataatcatgacacttcggttaaaaacttcttgaaactaccgttgacttgatttacttccctcttctctctattgccttaaagcccaacaccatcttaattcattcaggagaccacaaagaacccgctttttgagatgacaacctgtcttgctggcttggccagctcccaaaatgaattcaatttatcccaaaaacaacatggtggcaacgct

SEQ ID NO: 20817 - DNA, 375 bp, Homo sapiens; identical to SEQ ID NO: 2765

SEQ ID NO: 20818 - DNA, 1071 bp, Homo sapiens
  misc_feature (1)...(1071): n = A,T,C or G
tctggatggcttcgtgtggatgccaggggtgtttttccctcggggcagaagaagctctcctgcccaacggtgatctcttggccatcaggcagctgatatttctgttggcatgaaggtgaatcagttttcatcttttccttgtcaaagtccaaagccacatagcagcatttctccttcatgtcccggatgtactctcgatcccctgtgcccaccaataattgcacattgtctttcaacagttgcaggaggtacgaggttaggtcctggcccgctatgtccacctggaaggttgactggtgcaaaggacagccatcagcgatgggcacgaagtgtgtcattccttctccagattcaacagtcatgccggaggtctggccagaggcgtacagagaaaggactcctcggttagctaaatacagggcaggtatgttgaaaatctcaaacagcacctgtgtgactntctctntgctgggtgttgggttcaaaggcggctccgtcaccaacatggggtactgctctgaggcgacgtggagcacctggtatgaggagtggtgccatatcctctccatgttgtcccaattggttgttgattgccgcagaatgggtaatgcatgttgagtttcactcatctttctgaacatcctctcataaccagcctccttttcatcccaccaatcattctgtctcctagtgggggntaataaccttctctctgaatattgctgtgtccatccgtctcatgctgctgcgatcngagagaaccaaaatataccgccgcaattatacgcgctatcaactcatcgccgcatgttgacgcgattacgaatgaggccaccgcgctatatcacgttatagacacggctgagtcagatgccgacggcagatcgcgtacgaatatgtcttctatttctcctctccttgttgttagagctaccgcccatcaacctgtacttatgtagcatcttcgcgattccggtggtgcatcggcattattaccctaccatttgtttcacgtttcgtgttcgccctttagntctcgccggtgtatgttcgatcacgcagcactcgccg

SEQ ID NO: 20819 - DNA, 164 bp, Homo sapiens
aaaatccatgttcttttagggtatattaactttcctggaaaaaacagcttctattaggagctttggcaaaagctgggccttcaaaatgccttctcctacttttggtttacctcaaaggccggggcgggctaagatctctgcatatatggaaaaaaattccttct

SEQ ID NO: 20820 - DNA, 513 bp, Homo sapiens
cttcttcgttttttttttttttttgggacggagtctcactccagcctgggcaacacagagagaccctgtctctaaaaataaaaaaagaagtaggcatggaatgttcgacatctttaatggcaaatcacagattgtatttgccaggagggagagacaactgtccatgaagttctctgtccacacttcagagtagtattttgattttgctgtcttctcttttctcctgcccactccccacctccccttccctcctctgccctccactctcccaggtggccacctgtccgtattctgtctatggagcttgggtaggtggctccatcttgtgctcactctccacgttcaaggatatgtgggtcaccagcaaggagtcatcagtagaaaaagcttctgatgtgtggctttcaggaccatgttgcctgtgccttcgacaccaactgcaggatgagccttgttgtggctgaattgaacagagctcagacccggcagactttaataagaaggtcaattaag

SEQ ID NO: 20821 - DNA, 423 bp, Homo sapiens
tgaaatgctgacccttcttcacctgccaccatgagtggaaacagcatgaagccctcccgagaatccaataagatgaatgctgatgccatgctcttgtacagcctgcagaaccatgagacaaataaaagccaaattatacttttctgtataaattacccagcctcaggatcagaagaccacagcaaagtgagcccagagattccttacatttatatgcatactttataactccaagatatggcttggatttttgtgtctccacccaaatctcatgttgaattgtaatccccaatttggatgaggggcctgggggagagccatgtaagatgtgactgcttccctttcaatttccgccatgattgtaagtttcctgaggcctccgcagccatgcttcctgtagagcctgtggaaccgtaagccaat

SEQ ID NO: 20822 - DNA, 1037 bp, Homo sapiens
tagcgcgtgaatcagatcgggggggggggggagaagaggccacctgacacccagcatccctgctcaggaaggaagtgagaacatccccgagcaagaccaacaattgctgaataaacacaaacccccttgagaatcacgccgacaggtgctatctcttcacctggggattgcaaaggaagtgagaacatccccgagcaagaccaaaaattgctgaataaacacaaacccccttgagaatcacgccaagaggtgctgcctcttcacctggggattgcaaagcctgaccgccatggacagcgtgcccctcatctgtgactacggctctggcttcagcaaggtgggatttgcaggaatggaaagcccaatgggcatgttccccactgtcctcgggaaacttcggcacgataatgtattggtggggatggaagaggaagactggttcattggagaggaggttcagaaaaaatgagggaaactcaacctgcaataccccatttctcgggcaacaacaaccaactgggacaacatggagaagatttggcaccactccttctaccaggtgctccacgtcgccccagagcagtaccccatgttggtgacggagccgcctttgaacccaacacccagcaaagagaaagtcacacaggtgctgtttgagattttcaacatacctgccctgtatttagctaaccgaggagtcctttctctgtacgcctctggccagaccttcggcatgactgttgaatctggagaaggaatgacacacttcgtgcccatcgctgatggctgtcctttgcatcagtcaaccttccaggtggacatagcgggccaggacctaacctcgatacctcctgcaactgttgaaagacaatgtgcaattattggtgggcacagggggtcgagagtacatccgggacatgaaggagaaatgctgctatgtggctttggacttgacaaggaaaagatgaaaactgattcaccttcatgccaacagaaatatcagctgcctgatggccaatagatcaccgttgggcagg

SEQ ID NO: 20823 - DNA, 1105 bp, Homo sapiens
tagcgcgtgaatcagatcgggggggggaagaggaagactggttcattggagaggaggttcagaaaaaatgagggaaactcaacctgcaataccccatttcttgggcaataacaaccaactgggacaacatggagaagatttggcaccactccttctaccaggtgctccacgtcaccccagagcagtaccccatgttggtgacggagccgcctttgaacccaacacccagcaaagagaaagtcacacaggcatgactgttgaatctggagaaggaatgacacacttcgtgcccatcgctgatggctgtcctttgcatcagtcaaccttccaggtggacatagcgggccaggacctaacctcgtacctcctgcaactgttgaaagacaatgtgcaattattggtgggcacaggggatcgagagtacatccgggacatgaaggagaaatgctgctatgtggctttggactttgacaaggaaaagatgaaaactgattcaccttcatgccaacagaaatatcagctgcctgatggccaagagatcaccgttgggcaggagagcttcttctgccccgaggtgctcttctagtcaaaactcatagggaaaaacacccctggcatccacacgaaggccatccagagcatcacttcctgcaaccccgacctccagaaggttctctttggccacatgctactgtccggagggacgggctcctgccccggcttgcgattccggatgcagagagaaatatctgagctggtgtcccctacagtttatgtgaaggtggccacctgtccgtattctgtctatggagcttgggtaggtggctccatcttgtgctcactctccacgttcaaggatatgtgggtcaccagcaaggagtacaaggagatgggcccttccatcatcagtagaaaaagcttctgatgtgtggctttcaggaccatgttgcctgtgccttcgacaccaactgcaggatgagccttgttgtggctgaattgaacagagctcagaaccagctcaagggcaaaggcacttcctcccccagacttcaataaagaaggtcaataagaaaaaaaaaaaaaaaaaatggcctcgttggcctca

SEQ ID NO: 20824 - DNA, 2525 bp, Homo sapiens
ggcacgagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttgaaaaaaaaaaaaaaaaaac

SEQ ID NO: 20825 - DNA, 2647 bp, Homo sapiens
ggcaccaggttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggcctgggcgacggcctttcttttcatcatagagcccaccatattttactgctaagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctgtctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttttggcatggccggcagatgcccccgaggctgtcactgtggtcactattgccccagaattccacgggagttccaccatggacacataacgaacctgaaagaagtttaccgcctactttcacttccgttctggggcttcaccacccctgggagacgggccttccaacacacctttagtggtctggacttaggaagacaaccaggagctgtgggacatctggc

SEQ ID NO: 20826 - DNA, 1378 bp, Homo sapiens
  misc_feature (1)...(1378): n = A,T,C or G
ggcttgatgtgctcgaggccgagttttccaagacctgggagttcaagaaccacaacgtggcggtgtactccatccagggccggagagaccacatggaggaccgcttcgaagttctcacggatctggccaacaagacgcacccgtccatcttcgggatcttcgacgggcacgggggagagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtaccctatgatgaagcaggcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttntcccaaccctttcatccagtgtccaaaatatataagtaaatagctgtagagtcacatatatgaagtgaatagcatatgtgtcaattagtctccctgaagattcttttcaagatcctgttcagggtccttcaggcatcagcttgttgtgttctctctttgtaacaggggacaggaacaaccacccagggctgcaggaaacaggccactggggtacctgtgaagtggtcaagggctgatgtgggcaccccctctgccaagaaacagaactggcctgaaaatggcttgtccttctggagccatgg

SEQ ID NO: 20827 - DNA, 836 bp, Homo sapiens
ggcttgatgtgctcgaggccgagttttccaagacctggagttcaagaaccacaacgtggcggtgtactccatccagggccggagagaccacatggaggaccgcttcgaagttctcacggatctggccaacaagacgcacccgtccatcttcgggatcttcgacgggcacgggggagagcatgtaagaagtgcctttcatctcctgccatgattctgaggcctccccagccatgtggaactggaaatccaattaaacctctttttctccccagtctcagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcaggcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggag

SEQ ID NO: 20828 - DNA, 2383 bp, Homo sapiens
ggcacgagctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtggtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcaaaaaaaaaaaaa

SEQ ID NO: 20829 - DNA, 818 bp, Homo sapiens
gagtaagtacggtcttgaggtttccttaccaggacactaaaggtttcactgcctcttcctcccttctccctgcctttcttccttccttaccatcaaggtctcactgtctcttcctcccttctccctgcctttcttccttccttaccatcaaggtctcactgtctcttcctcccttctccctgcctttcttccttgcttaccatcaaggtttcactgtctcttcctcccttctccctgcctttcttccttccttccatcttttcttcttcccttcctttttttctttgcagaaattaagtttttcagtgagtaatctttggagtttatgaatcctttggaattttgtagaagggaatagataattcacctcatttggtaattacataatttgaatttcccacatttactttcaaaaaggggccaggggtcaagctttctgcaggctctgctgccctgaggtgccatgccggaggtggacagcactgggagagctctttctcctgctgttctgggttcctgcatggaatgccttcacacatcttgctgaagatattttcctacttgaatgctgtgagcccttctgtgtaccggatgcgcgagccagcgcttttatcatctaacccatgacaattttatttggcaccggaatctactcaactgcctttttcacctgcaagatcaaattggaaaattaattcagcaaaaaaaaaagctatggttatgaactttctggcacgtcagaataaaaaacctggttattgggagaaaggattatccccacacacattcccttctgtaacaaccccactaacttacct

SEQ ID NO: 20830 - DNA, 927 bp, Homo sapiens
  misc_feature (1)...(927): n = A,T,C or G
cgggggncgtgccctatctgaggcttcgcagatattcatacggacgtatgagcggtgaccatgctgacctcacaaagaaccattatatctaaggagtagatagcattatacggatagctgctgcacattcgacccatgcataaacggcttntgtaatgccttactactgttgcaatgcacacgttcatccactcactgagactcttgcaccaaactcgaaatcacccactaatacctatatcagcctatcattttggatggatacagtagtgagccgatttcgagctatcgtataaacttatgaacgagaatgtaactagaacacatcacccgcctagaatagtcatcanagatatatgataactgcctctaccacatatctcgcattctctaacatgtagagacgtgccgctcactgtctggaacacaacgctacgagacgaccctattggctattacggcgcccttgcactaggcgttatgcggccaggcgacaaagtagcccgcagcctaccgttgacagcatcgagatttgcaaacagacactccgagcccccattgtcacccgtctgccctgcttcgcagctaaagcttttaatgcttcctatcaccacagagtaatttcgtctacctttagggattactctctctataaaccccaacatggcttgtacagggcccgccctccccaaatatccgtcatgcgccgctttcctggacctccctataccaataaccaaggaccccttttccgatcctaacccattaaccgggcccccggggaaaacaatccccgcccacccccccccctttttctcccccctgcacgatccaggcccttccaaccccgttggggctgtcaggccccccttatcccagggccttagcgcctgtcctcttcccgtttccggacaacaagtctaaaat

SEQ ID NO: 20831 - DNA, 1614 bp, Homo sapiens
  misc_feature (1)...(1614): n = A,T,C or G
gatgataactgtgaaaggcccatctgctttccagccatctcctgagaccacccgttcttatgtcacttgaaatagcagtatctttgcttctgtgttgttttactcacttgactaggaatacacattgagagtctactttagattgtattgtgctggatttggagggaatagaacaggagacaatgctgccacttcatcactctcctggtccttnaanttcctcccggctggnacattgagtngacagtangagcaagacggaggggaagaaatacctagttggcttggaaataggaatgtatccattttgccttttattcatttgtgtcctcaccctgccaacatgccacttagtttgagcacatcattaacatgctcttctaacacatttgtgatacactaaagagaattgacaacactatggacaggaaagctcacttctctctctcccttccttggcataacgttcaaagactccgatggcattctttaattgcaaagtacaatctgagtcatttgaccatatctaccatgattggctgtgacagactcattcggatcttctgcctgcaccctggcctcctggtgggagtgtggaagaaggaggaagaactggcttttgttatggcaaatcttcattttcatcaccttgtggagaggagcacattaggctcggctactatcccctatgaactgcctccacatagcccctttttggatgatagccccgagtatggactgcacggctaccaactccatgttgatctgcacagcggtggggttttctacctatgtggtacatttcgcaatctcttcaccaagagaggtgaaattgattgagtttttatttcattatgaaattaaaggttgaggtgagggaaccaattttgatgtccgagttaagaattgccctcactggtcactttataatcttttggcaccagtatcctcccagacccgtgtgtcatcccagggcttgtgaaagtcctcactggaccgagtctcttcagaactggctctgtctccttcaccaccatcactctcaatgccaccttctgggggtagcccctactcatcttctctactgatgcttccttattatttttccatgctctctgctttccccagacttcttcccttctttcttaaaggaatgtggtaaatttgccagcagggcccgtgccgctccaggatgagagtaaagagaaaccagcctttctcctctacgtactgcatcactgtttgccacacctaccaaagccaggacagaggctggggcagacagaggaaaggagggagcttacgccaagcaggaaaaacgagggagtgaagaatgcccctttctcacttatctgattatttccttttggtttcattctactgtagcctgtaaacttggagtttcatgtaaggacttgcttagattcaagtttaacatttctggtaaaaatattttaaaagggaagttatgtactacattttgcattatattgagaggtatataatgtcaggttgtcccattattagtaatgcctggttttatcatctggttaagatggtgaccactagatatcttcattattaaaagtattcttttccaaaaaaaaaaaaaaa

SEQ ID NO: 20832 - DNA, 1148 bp, Homo sapiens
aagcagggcagccaggtgccagtgggtgatttgagtgcgtgctgcatatcatgatgctgtcttgcggtaggctccgggctacactgtcacctggccagctgatgcctagggcaagggctcctttttcaccacttgtgtcatctaataggttgtgctcagagttgagggccatcctctgttaagaccagttgtgtgtggatttcatacttcagctttcaggggggttggttcattactttttcttccaagttcttaaggcatctctttttttgctcccaattgttgccctcctttatgaatgttgtttcaactatatctggggaattggcctggtgtgaaaaactgagggtggttaaactgtcagtgcacaaagtacacattcaaagcaatgatgttggtgaactgagcgtatacataatgtactctctaggatttagccacttcttaaatagcacatcaggaaggaggtgcgccaatatccaatacctgtgtgttgtatgttgcttaaagcagaagcttccaaacctttcctagagaaatagtgtaaccattcatggctctccgggtgtgctgctgcctagacatggaggctgtgagctgtatgattttctggtgtttcagattccctcaaggtgctgctgagtactactggttttgaggactgatcttaataaaatttactttaggaacctctgaaaaagactcactgcataaaaatattatatgctatttcattgaatctaaaaaaccattcattctaagatgcactactgtttttctgtaccactaaaataaaaacatggcccagtgaaaatatatcgcattgaatgggagaggttaaaatgtaaaagtttggggatgagttatttggtagtttgcctatgactgcaaaagctagagttggaaccctcaaagatcagaaaagttgtagattgtgttttatgttgacagttctagtttactaatagtaagttttttaaaaaaaactttaatggtttctgttttatccaaattggctaatcagtacactaactgtatcctttttgtttccattaaatgtatttggtaacacctctttgacatgttgaaagcctacagtgagagtgtatatttctaaacctttgggtgaaagcacatcagagtaagta

SEQ ID NO: 20833 - DNA, 975 bp, Homo sapiens
ttgtatgtctgtcccaagaagctagagctgtcagagggtgtggcaggcgatctcaggcacaccggggaactgaaacaccaaaagggtttcccatgttcatccaaaagagttacgtccatcatggaacaactctttatacagccatcaaaaatatcagttttccacgagaggccaacttttccaataagaggtaggtgttctctgttattttttaaatgtataacaatgagcttcacatgtccattttcaatatttcctctcttggtgaagagattgcgaaatgtaccacataggtagaaaaccccaccgctgtgcagatcaacatggagttggtagccgtgcagtccatactcggggctatcatccaaaaaggggctatgtggaggcagttcataggggatagtagccgagcctaatgtgctcctctccacaaggtgatgaaaatgaagatttgccataacaaaagccagttcttcctccttcttccacactcccaccaggaggccagggtgcaggcagaagatccgaatgagtctgtcacagccaatcatggtagatatggtcaaatgactcagattgtactttgcaattaaagaatgccatcggagtctatgtttggtgggagttttataccagtcggtaaaaactggtgtcatgccacataaatctaaggttgacaatgatgctaggcatggccattttttgccataccatataacagtaactgatgtgtcatttatggaaagatcaacatgctccatgatatattcttttccacctttttctttcagtataattgcccaacctaaaccaaatattctgagggcctctttggtcttaactggaaggcctgtgtaagggttgacaggtttgagaatgtcagctagtgcggcttttacagatgctatttgttttgtgatatattctttcttccaataaccagcttccccgcgaataatggttgctacggtccca

SEQ ID NO: 20834 - DNA, 1782 bp, Homo sapiens
ggcacgagggtttttttttttttttcccccatgcagacaactctgagatggacattcttgagtgaactatctgtgcacatttctagaagtggaattcctggcttaaaagagcatatgtgctttttaaggatcctggattccaatatcagatttggctttccataacgtttgtaccactgtatcttgtcttacgggcagtaaatgaggatgcctgtttctttgtaacatagccagcatgaatcatcatcatttatttggtatttgccaattgctagattaaaattgatccatcagatgaatttacttttctttggttctcttggaaaggcctaaggtaacagtttttatttttctggcttcttattgaggaaataaacaatgacaaaaagctgttactgattcagtaaggtatttatttaatatcttaaataaaattatatttgatgaactacaataatatttatgtttaaagtatatatagaattattcatatgatgcttagggtattggtgtggactccgattctagggacagccaacccccacactcccataggcttaagggttacaggtttggagctcctgataggaattgttattgtttgatgaaggaatgatagaaattccctttatttgaagcttaagtgttagaatcctttatcaattgtagatattttatctttgaatatgtaatataagtcaatacagactttacaacaataataaccatttaaaaataagtcatgcttttaaataattttagaatgtattacaaatttgtttactgtgttgactattgacagtaaacaaagtgtattataccttctaaagttatttatgtccttctggaaacaccaggatgtgactttctttagatataggggtctgtgcaggtatacttagttaagattaggtcatcctggatgagggagggtcctaagtgcaatatgaatgatatccttataagaagaggcacagagacagatatgcctagagggaagattgctctgtgaagatgggggcagagattagagttatgctgacacaaactaagggacaccaaggatttctggcaaccaccagaaaaaggaatgatcctctctagagccttcagagggagcacggccctgttgacaacttgggttttggacatctggctactgagacataatacatttctgttgttctgagtcacccagtttgtgaaggtagtcttaggagacgaatgcaattaggaaatgatattttacttatgattactatgttaggaccatgttaatggagcctaagcttttctcctgtggaaatctgtgtttaaacaaaatttctaacagaagtacaaaaatatataacaggtagaattatctgattaaaggaggagagggtattgcaaaaatgtcccaattagcatttcttcctgtcctttctccctgtcttcctgccctgcagagcacagattgaaaaccattggctagaaagtcatataagaccaaaagtatattaagcaccttttactgaagctgggatggaaaggcatgtggagccagcattttttttttcctcggtgcatttttactcttacaggatctggaaaagtttaccttatgcaacttctttgttgagatgccagtggagcagctgatcactaatatttgtggagggcctaccctgtaccagctactgtgcttttttctagagagaaaaattcacaaagggaagaggaatttactctgtagctgcttggaagcatgtggagacttgtgcctgggaagcagggcagcca

SEQ ID NO: 20835 - DNA, 1513 bp, Homo sapiens
  misc_feature (1)...(1513): n = A,T,C or G
tagcgcgtgaatcagatcgggggggggggactctgcagaattccaaggcagtgcagggcatcacatcatgagggagctgagtgttctagctcaggtctttcttcctcttcttataaagccaccagtcccacttacatgataacccactaacccattaacccattagtctatgaatgggttaattcattcatgagagcagaaccttcatgacccaatcacctcttaaaggccccacctctcaatactgccacaatggggactaagtttcaatacgagttttggaggggaccaacattcagacatttcatagcaagatgaaatgatatgatgtctgtgatttgattcaaaataatctatggggcagaaaagtgggtaggagtatacatgcaacaagacttattctgagttgattattgttgaatcttctggcaagttaagtacaagtttcttataaactttctattatattatacaaataccttagacattagttgtctcaaaatcaatgtgcttttctttttctggtgaatagatcatttttataatagaatcccctaggttggaaaaataagttactacatttttaatgtttctgaatttagatggctatgtgcaataatttgagcatgagtaaagtgaactctcaaaggacatgtatctcttccagttaggatatatgtcaatccttgtatcacccctgaaaccaggagctaaattctcttactgtttggtcaggtcagtgaagggttgatattataccagcacatagactgtgagaacactggctggactgcggaagattcctttacattcacggcctcctccccatcagcagccctgggacccgaggaattctgtattactatttcatatgatatcaatgagcctggtcagcagagttgtctgcttgcaaatacagagcaagtccacccaagccagaagctgactttcttgaagagatatttaatatcatcatctctccaggtaatattattataatgaccaggcaccagaattaaagacaaaggggcttcagttgaaagtactgcagggcagtaggttggctgcgggacctgaacatctgaaaatggaagatctggacagtcctccagatgaaatcagatatatgatcatccgtaatcctaataatggctttttggcaatggcttaccttctggacacagctgttcaccattttacacaagctgacattgataactctcaggtgtggttcatacaggatggaagcccttcctctggaatgttctactttagtgtgacagatggtgcacaccacaccctctataaactcttccacctggatgtcattcccatctccatcagcattgtgaaccttactgacctacttctcccacaaggccagacaaccatccccatcaccaatgctcacctgtcagccatgaccaatgggaggaacccccanatcacttacatgataacatggcccctccacatgggcacctgctgattgaaaccaggtggtcccaacttt

SEQ ID NO: 20836 - DNA, 1131 bp, Homo sapiens
ggcaccagcagccttaaaaagtggccctagcttgagactcacagaatttgcatggttctgtgaagcccctttcatctcatgacctgaaagctgtgaccaatgatgtggacagtgcgggaaacagaactataacttttccagtcgtaagttcccctagactcaggaggttggtgagactgaactctgacagcagcacagaggaagtttctgtttttacccaatatctggtcagtgaagggttgatattataccagcacatagactgtgagaacactggctggactgcggaagattcctttacattcacggcctcctccccatcagcagccctgggacccgacgaattctgtattactatttcatatgatatcaatgagcctggtcagcagagttgtctgcttgcaaatacaggtctcttctattttatctcataagcttaaacagttgtactgggagaaggatgacaacttagctttaaagaattttatttgcacctccaagtggggacttcactgtgcccatgacagaaaactgtggatagaaaatgaaaatgacaaatagggagcttctgtcaaggagggagacaaggttctaattggccgatttaagttagatgcctccaacctcttatttaaattgcctgaatctcagtgctcgtcctgtgaaatttggttccaagtgacatctcttcctcatcacagaacaattatggttggaaaaagaaatattaccaaaggccagacaaccatccccatcaccaatgctcacctgtcagccatgaccaatgggaggaacccccaaatcacttacatgataacatggcccctccaacatgggcacctgctgatttgaaaccagggtggtccccaacctttgaacaggaagatttggattcaggaagactcttttattacatgacaaatttcactggcccacaggaccagcttcaatttttcactgttttccttcgaaaagcacctggccgggcaaacccctgaacattagaggggagccctttattgggggtttattgccaacctggaaaatggccgacagaggggcttttcaccttggtaaaaggggccctaaatcctccccggttgcaggaaggccggggcccccaaccaaagg

SEQ ID NO: 20837 - DNA, 2210 bp, Homo sapiens
  misc_feature (1)...(2210): n = A,T,C or G
ggcacgaggaaggactcatccggacccgtctcctgggggcatctatggccagaggagaagtcctgacattcctggactcccactgcgaggtcaatgtgaactggctgcccccactcctcaaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtctcctgttatggctggaggtctctttgctgtggatcggaaatggttttgggaattgggtggctatgatccaggtttagaaatctggggaggagaacagtatgaaatctcttttaaggtttggatgtgtggaggagaaatgtttgatgttccatgttctagagttggtcatatctacaggaagtacgttccatacaaagttccatctgggacaagcctggcaagaaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggagatccgaaatgtggcagcaaatctctgtgtggacagcaagcatggagccaccggaacagagctgaggctggacatctgtgtcaaggatggttctgaaagaacatggtctcatgaacagctttttacctttggatggagagaagatattcgacccggtgagccactgcatacccggaaattctgctttgatgcgatctcacacaacagccccgttacactctatgactgtcatggcatgaaggggaaccagctctggggataccggaaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctagaaagaagaaaggaagaaagagtgattacctacaggttataaattaaattttagccagcatctgggtcgaaggagtcaggaataacatttcctcgatccaggaaggctggtttaaaaatttgcaaatgccatgtcaaagtaggttgttttgaagaacttcctgcatctgaagaacttggctgagaatctcaccagctgcttctgagaactcgagactagcagttcccttgctggccaagggcaaagataatttagggacttttcaaaacaactgctgagctaataaatcctagcatttctcaggtcaaatcctgcagtagtgagtagctatgaatggatcctattaactgggtgggaggggggtgaaaatggagtgcatgactgctctgacaacctgaggatatcacaggtttagaactagccaagcttaaggggtgagctgtactctttggtgccattctctgactaagaatgggttcagcaggtttaacccttaaaagtgctgcagatgatttcagagtgctcacactattctgttttttttatttttatttttaaatgagggtgcaatatctaatgtaagacttaaattacataatgaaatggacatccagtgttcccattctttcgtttatatttgccatttttttttcagagcaaagtttcttttttatgaaagttcatgctccatgaatccactgaatttctaattcagtgcccttctatgaatccagttaaaaacaaaagcaaaagcaaaaatctatgctatcaagttactccaaagaaagatttcacagaagcagcaaaaccatataagatttaggagagggacttccctgggaaatctatttttacttttctattatttttaaaatcttaaaagtctgatatttgtccagtcataatttttattaagcaaggaaatggagtgagtttgatgtaatttgtttaggagattttttaacccaaataaatttaccctcccagtgatatgtggnaaaaaaaaaaaaaaaaaaaaaaaaaa

SEQ ID NO: 20838 - DNA, 687 bp, Homo sapiens; identical to SEQ ID NO: 4460
  misc_feature (1)...(687): n = A,T,C or G

SEQ ID NO: 20839 - DNA, 2988 bp, Homo sapiens
ttttttttttttttttttttttttctcaacgggtataggcaacgtcttttattgttccatctggcacttgcaaacaccattcttgaagaacctagaaatgaaggtcagttactctgtttatcaggaacagaaccaaataaaaacaaatttttgaaaaagcaaccaagaaactctggttcatcactattttccatatctaatggttccttcaagataaagcataactcttcctttcatgatactttccaacaaagggagattaaagaaaaacagaaaagaaagttccccaccctaccccccataaattgtcattcatactggtaaaagagccagtcttgttagcagctaaatattgcactgcctttcattctgtatacagtcagggtccaatgaaagtggcacactcatggtataagtgacggacgatgacaccgccagctcaagagtaaagactcagtatacagagggacaagaaacacgtcagcactagtcacacatccagttgtaaaagtctgatttccagaagttaaaattcatcactttcagctgcatgaagttgtgtgtcatccgcatctgtcatgctgctctcctgggattcatctgttcccatgatctgttcttcttgggttattggctcctcatcatctggaagataacgcttatcaattgcctctttaatctggttattggctcctttaggatctaaatccatagcccaagagaaattcatcagggcgaggtgcgtttgacctaacttcttgtaaacctaaaaataaacagcagcactttcctattaagaagtaaacgagggattctttgggaacaatttgtttcaattcttcaagttcttgtaaagcagacttatatttttcatttgcaaataaaactgaggctctgtgaaatttgcatagagggttcttgggatcaatgacaatggctttgtttagggtatccaaagccttctctgattttttcagtgcatgttgaactactccaatgtggcaaagtaaaactgaactttgtgggttgggtatcaacgcttttttggaaatgcatttctgcaaggctgaatttttcttgcttgtaataaatcattcttaaaccataccatgcattataatgtctaggattgactctgatagcatttcgaaaacaagctaatgctttgtccaattcttcagttaagacaaactcatgccctaatagagtataggcataagcgtaatttggatcaacttggatagctctctggaagaatttaattgcaatatcatgttcccgttgcagactgaaacagttccctgcagcacaccaggcctctggcgaatttttatccatgtctgttaagtcttttgacagaactgaaagagcaacatctttttgaagatgccaaagtgttgtagagtagatctccatgccttcaactctataattctcaatccttctaacctctgagaatattctttcagcttgcatgtactctgaaagttcaaaataggcccttccaatttggcacagtacccaaccagtattgtagtggtgagaaggtagatggctcaaaatatttatagcttctttgcagttgtatgaacacaaagctaaataacctttccccatttcacgaagaaggctcatcaaaccttctgctgctgctttttgtagattaaaggcctgaatctgaggtgtgattgtggatattttcccttctgaaatgatggaagagtccaattttgtaatttccaggctatcatttatgttaggttgagttattcctcctttattagttttactttttgtttttctgtttgggattttaggtggaaacttcatttttaattttttgctattctccttggttgtggagctgtcactagtaaagagtcgtgaacttcttcgaggcagtgcgtttgggggagatgtaatagtggggctcaatacctgaggtgttgtacttgtttgtggaccagaactttgtgtttgtgcaagaattggagttacctctcggctatttccactctgtgagaagacagactttgttccagtttggccgattctggcaacagactgtaaaacacgaaaagtcttttttgaaggggctccggtggatggcacatcaattacaggaggtgtattagtgtagttttgtaaataggatccatctccaggacttggggtttctaatggcaaaatcccaaaacttgtggttaatggactaagagctgctggtcctcctaataaacttcgaccagtttttggtttattttgaacctgtttagataatatggaagtttcctgttcccagtgggacagtatcaggtgaaattacagctgaatcaatataagacactgaggaatctgtattcaaggagtactttgaattggaagattctaaattcaatctgtttaattcaattgtgtcctggggtgtttccgtaagaactgtctcaggctgtctgtgagataaactatgattaggtacttgtgttgtgcaagagttgggcagacagttgctaaagttctgtaaagatgtgaatttaaatgtttggtcaggatctggcttttcacctatttcacataatgattcaaagggagaccagaggaaaggatttaaactaaggctcttttggtaacattctgatcctttggcaagccgatctgtcttgcaatatacatgtcccaacaatgaaagagtaaagcaagctgaatcaccaaactcagtaacaatatcatcatggcttttctgcttattaaacactccaccagataagatttgttccccttctgcaagccttctgcataaaggcgttctgcgaggaaaaccgcatctcggtaagcatagtggtttagtgcttgccatatagcagcctggacgggttcctgcagcaccgtcatcctcgaggctcaggcccactttctgcagtgcctcaggccccccctgtagcggctccggcccggccagcccctgctcatttaaactcacctcgtgcc

SEQ ID NO: 20840 - DNA, 598 bp, Homo sapiens
tccatgtcctgcttctcaaatttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaattttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttacttttaaaaaaaaaaaaa

SEQ ID NO: 20841 - DNA, 917 bp, Homo sapiens
  misc_feature (1)...(917): n = A,T,C or G
gcatacgccatctctgagaagcctggagggagccacacccctggtgacttcatggtgctggatgggagacgctagcggcatccttcagggccaagtttgataaataccaccgccatttggtgtttcatcctcctcctgttttttttttttgtcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttccncatgtcttnccatgtgccctgttt

SEQ ID NO: 20842 - DNA, 857 bp, Homo sapiens
ccactgtggccaccagcacaacgaggctgtctccgtaactggcagaaagatatgctccaatggccgggctgctgacaagactagccgcaaaggtggctgagacccatccataagctgtacttcgctcgtgctcctgagtgacatcagctacataggcaaatataacagaaaacgtgaccgagaagactccagacacagaaatcatcgcaaaataccaccatgggctgatcctcatcagtgggattgggaagcaggtaaagaatacagtgccgaggagaaagggcttcctcccccacacatcagacagggcaccaatgagtggggcactcaaaaaagagagcaggccctttacaccttgaatgagaccattcatgaggaatgtgtgttgagaaaatgtttcatgtagaacagtcaacattggagttgtcaacaggccccacgcaaagaattcaaggaagatgacaatagcagcatggtacacacttggtcggccaaagccttgtagccaggtgctccccgcggcctgcgcgcccgcgcgcttctccggcatggctcccgcctcgggctccgacgccgccttctcctccagctccggcggcggctccacgctcatgccgcggccatgcccgcgccagcccggggcgctccgggacgacggcgacgccgcggaggcggcggcggtgcccgcgccctcatgggctctgcggcccgcggcggcctgcgggtcaggcggcggcgccagcggcggcgccgagggctgaggaggcggcggaggctgaagctgcggatcaggctagcagaagaccgcagctccaggaaccgaccacttatcaaaccgcaccgaccccgctcgtgcc

SEQ ID NO: 20843 - DNA, 1037 bp, Homo sapiens
gttaaaagtttgttggtaaaccggtagttgccaaaattcttgacctctcaggtgtctggtaaactgggcattcaaaagcatagagttctgaatctgtctggttggaagcatttggtgttttggtagaaatctttgttggcaaaaagtatatgtcgggaaaatcacagcacatctccagaggcagcgagtcttccagtattttctgttcacgattccatcttgccccctcgatgaataaaccaaaaatgtaaactccagtgtgagaggaagctgagcccttaaacgctctcctaactatgttgagtttctttggcataaatacggagaacttctcatccttgtcagtggtgttggaaatcacatggtgggtgaaggtgagggcatccacagcgattcctcgggacctcccatagtcttgaagcacagcagcaagaaaggcttgtggaaagaagaaagctgggagccagtatcttgaaggaaacccttcaaagaaattgttctctgaatcctcagggtgtttgcatttttggctagttgatggaatagactgcttccaaactgtgacaaatctcatataccgacgctgtattgcagtataagccactttggcccaagtattgaagaaattcagtcgctggatgagatcatcaatccaggaactcagtggcttacaagatctgtaagcgtgtttctgccacaatgtaagcactctcatattaagaaaagagttacatatttcctacaattcttgggtcaggatgatctctccttttatagcaagctgaaagatcctttaaggatttatgtatgacaaataatatcctatcaaatcgtttaatttcttgcttcaaaaaggttagcaagacacaatggataagggggtcgtgatctttgagaaaattagaaagagactcccaaatggagcttgacatcatgctcttcaatgtgcttggagttccaacagcaatttcttctttctccactgtcagtggcagccgctttagcaagtcggatagaatttccatcaccagttcatc

SEQ ID NO: 20844 - DNA, 550 bp, Homo sapiens; identical to SEQ ID NO: 19294

SEQ ID NO: 20845 - DNA, 2521 bp, Homo sapiens
ggcacgagtagaaactttgaggacattgtagccgaaagatatgggtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatattccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagagtcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctaaaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaatttgtatgaaaaaaaaaaaaa

SEQ ID NO: 20846 - DNA, 1150 bp, Homo sapiens
ggtatatctccaaatgctatccctctcccctctccccaccccacaacaggccccggtgtgtgatgttccccttcctgtgtccatgtgttctcattgttcaattcccacctgtgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttacagcagcatgatttataatcctttgggtatatacccagtaatgggattgctgggtcaaatggtatttctagttctagatccccgaggaatcgccacactgacttccacaatggttgaactagtttacagtcccaccaacagtgtaaaagtgttcctatttctccacatcctctccagcacctgttgcttcctaactttttaatgattgccattctaacgggtgtgggatggtatctcattgttgttttgatttgcatttctctgatggccagtgatgatgagcattttttcatgtgttttttggctgcataaatgtcttcttttgagaagtgtccgttcatatcctttgcccactttttgatggggttctttgtttttttcttgtatatttgtttgagttcattgtagattctggatattagccctttgtcagatgagtagattgcaaaaattttctcccattctgtaggttgcctgttcactctgatggtagtttcttttgttgtacagaagctctttagtttaattagatcccatatttctaccatttttcattaaacattacaagttgttctcttgtgttcttattttttctgtaaacataattttaatggcagagatattctgctttatatctttccctattttatgtatatagaattataaagtttttaaaaatgtaatcatcattatttatagtttaataatcagtttcatcttgcagtgtatcattttacctcgtcattaaatatttttacgttcctttttaagaaaaaaaaaaaaaaaaaaaa

SEQ ID NO: 20847 - DNA, 1400 bp, Homo sapiens
  misc_feature (1)...(1400): n = A,T,C or G
ataaagcattcaacacttgattgtagaaactaggcaaaatgactatattataaccaaaatgaaaaatactgttcaatttaaaaaagtacttaaacaagaacctgaaaaatttatgatatgcataacattgttcaagcaaaattgcactagtattacataaatcaatagtttataaaggcctcaatatggcaaagtttagaaataggtagtatgcatgcacatagtacaacaaaaagtcttcttataaaacagcagtttttttaatgcttgtacaaagggataaagagcaaccacatatttaacatatttcatctgttaggttaatacattatgacagctaaaagtcagtcatgtctatcagaggaacaaaaagccctccaaaacttgtgaataaatcttttgtgcctttaaagatatttgtataaaaatgctatccttttatttttatatacaacttaaataaatcgcactcatttcaactcaaattttgaagattaaccaaccaaacgtgaatgggggccatgccgttttgtaatacccaaaaaaacctgaataccagagcaactgggcacagcatttcgactcttcacttttgattattggaagaacattgttcttcttaaacttggaagggccttgaatatattttggatagggcaaataatgggttgctcatattaaatcttgaaaatatttgccaatcactctgtatactaaaatgtctgctttgccctttgttttttgacctagcaaagaggatgcgttcacgtaattganattctgtcaccaatttgtgtgcttatatattattctttagtgttcagtgtagtgtaaggggttgggttaatcttccacaaaatggatgtgactgggaagaaatacctaagatgcaagtacccaatgccctgttgtgctctaggctggctatttatctcgagactgagggagaataaaaggtcttattccatagcaagtgcagtcggccaactttcggttatatttttgctatgttctaccacctaaatataactattgcttacaaggtgtatacatttagtacatcacatagagtccactaagttttggaaaatgtagtcatctgtgttcatgcaaattattaattttacatatttttaatttttttcctcaaaattctcatctattggttggcaatctaaggctaatttcaaagcaggtgatgctgaacttgtgagagctatatattttcagcagagtctgaatcgatctttatgggcacaaagaagagagttgaccattcaatcatttttccatcaatttaaacagaaaaataaaatgacactgtattacagcncctgtttcttatnacacatctcaacctgaagctgcagctgcggtcgatntagggtgcccgcccgaaa

SEQ ID NO: 20848 - DNA, 5209 bp, Homo sapiens
ggcacgaggctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcctttcctgccgagtggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtatccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttggctatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaagggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaaaagatagtattatgtgggagtttccagtttaatccaggcggaattttctacaaaaggatcccatggcagagaaaaaagggcaagcaaacaggggtttgatttgtctggaatttaaaagggcccagggccattgcagttgactggggggctggaaacatttactggactgatcattctagaatgcatgggttcagttactccactactcactggaccagtttgaggtactctatcaacgtagggcagctgaatgggcccccaattgcaccagactcttaacaaatatggctggagaacctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaaagaagccttgccatcattgtgcctctcgtccttttggtgactttgataaccaccttagtaatttggttaaggctttggtaaagaaaaagaaggacaaaaacacttaggaagacaacctattatcaatggaggaataaatggagaaaatggcaattcattttataacatggatgagggagaacatgatcaccaccatggagggcttttagaacctggctttatgatagaccccacaaagggcaggtacatagggggaggacccagtgctttcaagcttccacacacagcgccgcccatctacctaaactctgatttgaaaggaccactaactgctgggccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcccccatatgctgtataaatgtataaaatataaggattacttttgtatgttccaacagtattatacttgttttggcatcagcattacctctttctttatctttttcctggttaattgttttctgagttttttgggttttattttttgctgatccctattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaat

SEQ ID NO: 20849 - DNA, 308 bp, Homo sapiens
ggcaccaggtaaagccttctccaaagaggcgggggtctcagcctggttcttccttgttcctcgtcctctgaggtagcaactgcctcatcttttccatctatggagtgtggaatatgtgccctacttcattcaggaatgttggacaaaccagctatttagagagtgaaggagaggaacttccgagagcaaccggcccccaagagaaacccagggactcctgcccttcggcagctttgtccatgtgctgctcacaccaaaaagcactcgagggtgacctgcaccaaaaatgcattgccgtagtctgggca

SEQ ID NO: 20850 - DNA, 308 bp, Homo sapiens; identical to SEQ ID NO: 20849

SEQ ID NO: 20851 - DNA, 828 bp, Homo sapiens
  misc_feature (1)...(828): n = A,T,C or G
ttttggtggcggggcaccttgagtcgaccgcagctgcagcttcaggttgagagtgtataagaagacggatttagagctaccattgtaccaaggtaattttccacgaggcgcatgaatagagacaganacctcaaagacttctggtcttctctttttatttaggccaatgagcccactctctatcctaagctcatctaggctctaaatctcttctcatagctcactattcccaatctgcaacatgctgaacttgtctgtgtctctacaagacaaaaacatatgagattgagaaagtgtattgtagctgcaaaaacaaagttgcgtatctctatgtattgcctgtactatatgtgagccaaacctcaataaaataatcttgatgaaatagtgcaaaggtctggtctttagccaccaaaatgggaattcatgagaaataaacagagcaacattattagctatgtaaaagacataaaaaatgatccattgatgggatgcacaactgtgtgatcttgtcaaattagtaatagatgaaaacagacgcatatgaaggaaaaaatgactccctcaacaatacttgggtgaataaacggaccaacttagtgacaatgtttcaacagaagctatgactagcaaatggatatttctgtctaagggttcttcattataaatagaggcaaggtgtctgcacaatctatgaaagtgtgattgccaatgccatctgttaatgagactaagaggaccggttttaaaatacaaggataggggctttagcaaacaattcagattggaaagaaggggttaagaggcctcggctcacttctgagaaat

SEQ ID NO: 20852 - DNA, 118 bp, Homo sapiens
ttagtgttttgaattgtgatagtgttgatatatatgattttttccgttctgtggcggggctaccatgagatcaaccgcgagctgcagcttcaggttgtaaagtgtataagagaattgt

SEQ ID NO: 20853 - DNA, 663 bp, Homo sapiens
ctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccctcgttccttccccagccctttagagaagggaccatgatttggaaacgcagcgccgttctccgcttctacagtgtctgcgggctcctgctacaagcggctgcttcaaagaattaagttaaaggcagccaagggcagtttccactaacacagaatgtaaccgttgttgaaggtggaactgcaactttgacctgcagggttgatcaaaatgataacacctccctccagtggtcaaatccagctcaacagactctgtactttgacgacaagaaagctttaagggacaataggatcgagctggtttgcacttcctggcatgaattgagtattagtgtcagtgatgtgtctctctctgatgaaggacagtacacctgttcttta

SEQ ID NO: 20854 - DNA, 800 bp, Homo sapiens
aaaatcctagctacactcacctttctgggaatatacagaaaaagcacgtggcaaggcgtggttcttagccaaacatatttataatgaaataaccatggggcaataaaacgggccaaacattaccggggtgctgggcaggaacactggttattggggcgggtttatgggtgaggaccaacagtgaagtatgctgggccaccccaccactgttgaacatgcaggggagggcacgcaccttgttaaaaaaaacaactggggcttgcttagcgggaagccacccatggtgttcccaggggacaacaacacaacctgatctaatgaagctgcctcaaataagctacccaattccgctattgcacctgcttacccggaaaggagccttcgcgggcagggacgctgttctttgagcccctaacaagggcaaagtttggggcgggggctatcggaaaattctgtgtctgggcattctaccccccgggatggtctcttaaaatagggggtgtcgtggtatgcgatattcgcagacgcccagggtcccccacaaatctgtgggggctcattgggaacttccaccggtttatatgcccaaggaggaccagccgtggcccaatggcgagaaaacgggggggctggcctaaaaaccctatggcggggggggacccccggggcacccctgggatggggaggcactaacgttatggagagggatgatggctaagaaaaaaactggagtaagtcagcaacacacggactggaaggacaggcaacacaggcattgtgcgcgagacgacacgacagcg

SEQ ID NO: 20855 - DNA, 556 bp, Homo sapiens
  misc_feature (1)...(556): n = A,T,C or G
tttttctttttttttcttcaatgtttattattttcgtattttttcacttaatactacataaaatctaagatctcagctcttggaatacagaaaaatagtttcaaagtgtattttagcaaaacaatttataatgaaattagcatttgtgaattaagcatgtcaacattactgtgttgcttgttaggcacactgcttatttgtacagctttatcagtcagttccatcatttcaatattttggcccaccacaccactttgaaacatgtaatgaagggcaagttttataataaaaaaaacaacttggcattactcaacgggaagtcagtacatgttttttgcaaggagaacaacataactgtttaatgatgctgtcttcaatatactacctaattctgtttatgcaacttctcaccaggtaattgttttttatggtcagttttgcttttctttgtccccctagtcaagggagagtttgttagtgttgttatctggaaatttccttcatgtcgaataaaaccaactagattgactcataatataggtgttttntctagtac

SEQ ID NO: 20856 - DNA, 401 bp, Homo sapiens
ctccttcactcccagaccctctccaagcatctcatattctccagattcatatcctgtcctcttggtttttccaatacgatctgagaaatcaagtccctttgtccccactctcttgtccttgaacttgtcataggcagcattaggattgacaatgatgtgttccacacttgtgcttgtcagctcctccagcgcatcgaactccgcttgatcatcctcaggtaggtcgctagtttcataaacatctggctcattcctggcaatgccgggaaggtcggcgtatttagggtccgccatggcggcggcgagacgggctgggggacccgggcctcggtggagccggggccggtgttcgggtaggggagaggctgggttcgggtcccgggcttaagcggcctcgtgcc

SEQ ID NO: 20857 - DNA, 1333 bp, Homo sapiens
gtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgccggtctacaggggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgaaaaaaaaaaaaaaaaaaaaaaaaaaaaac

SEQ ID NO: 20858 - DNA, 2418 bp, Homo sapiens
ctttttattttgtttttggttacatgataccatggaaatatcccaaataaattttttcttcacagtgtcaaggtaactgaattcattaaaaaatctttaagggagtagggagtgggggaagcatgggagtggggcaaagttgaatttagagaatttttataacccatgttacaaggaagttaaacaatttgtaataatgaaatgagctttctctatagccatatttaattaaataagtgtcgaatgtcttctttattgtattttcagaagtgaggcgatggcattttaagacattttttacaatctgaattgtttctaatagccctattcttctattttaaaacctgtccttttagtctcatttaagagatggcatttggaatttacactttcatatgattgtgcagaaaacttgcctctatttataatgaagataacttaaacagaaatatccattttgtagttatagcttctgttgaaacattgtcactaagttggaccgtttatttacacaagtattgttgagggagtgattttttcttgatatgcgtctgttttcatttattattaatttgaaagataaacagttgtgatccataatggatcatttcttatgtcttttacatagctaataatgttctctgtttatttctcatgaattcccattttgtggctaaagaccagacctttgcactatttcatcaagattattttattgaggtttggcttacatatagtagaggcaatacatagagatacgcaactttgtttttgcagctacaatacactttctcaatctcatatgtttttgtcttgtagagacagagacaagttcagcatgttgcagattgggaatagtgagctatgagaagagatttagagcctagatgagcttaggatagagagtgggctcattggcctaaataaaaagagaagaccagaagtctttgaggtctctgtctctattcatgcgcctcgtggaaaattaccttggtacaatggtagcctctaaatagactgcctcgcaagctattccagaggtcatggaacagaaagccttataaaccaaataaaaattctcaaaatacattggtttattgaaccaatttgcaatacacagtgaggaacaaggagaaagcaatgatagattaacactgttagtgtaacgtgccagtggagtggaaagaccgcaacacctgaatcctgggttttgtaatgtttttatgtcctgactcacattctgtcacatacgctttcccctaatagtcgggttacaaaaaggaccagagtggccgcttgagccagatgactcaatcagatgaaatgtgcctgaggccaacgatgtacacttgctctatagaagggtgtcaggggcaagtacacttcaccacagcaatagcttgcctattagtctgctgagcagtcatgaattttattgtatttcttgggtaaggacaggccagaatgagtgtcaccagtgggtaattgaatcaacttctcacacatactgaaggctttatatgtctcatgcatacttagtgtatcatgaatatttggtatctttgtggcttttcatatttttagtgcttcatgaatatttggtatctcttgctcctttctatctgtggtcacacatacacgctctattaactttgcctaataagtctcctaggttactaacttacttacctaaatgtaacacaatgaattccagctttctcatttgttctataccagaatgggaaatttccccaaatcagaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgggcctgcctgagccctaaaaatttcccaccaacgaattattcccaggaaatcctaaggtgctggatcctagttgatatttaaaacatatctagttgatatttcttcatttcagttggatccaaaaaccagtatctctaaaaacaacctctcataccttgtggacctaattttgtgtgcgtgtgtgtgtgcccccatatttatatagacaggcacattttttttactttggtaa

SEQ ID NO: 20859 - DNA, 2533 bp, Homo sapiens
caacccagtaaaccaaaaaaaaagggggggaggaaaccggggttttttttcttcctttatataaaaacgggccctttttttttccgggtggattgccataaaatttttttttttaccatatttttgggccaaatttccccttaaaaaaagagggggtttttattcaaacctcccgaaataaccctttttcatttccgggatatgccctgtatattgctcaattattttccggttataacagttttttttcctttttcccctgggctttggctaaagggcagaagctgtagtggcttttttcctttgcaaggacaccgtgtttgcatacactgcccatccagaattgatactcagtgattgggcttcctgtggcaacgcatgttggcagtttcccttctccaccttccataaggctgtccaattcaggttttctgttatcttttgaagtatgtttggtgaagatttctaaagcaaggtcttcatactgctgtttctgttctgaactgagggtctctaaagatttaagtttaatgaaagcttttgaacaagtcccaaaggctctgctggcgcatgcgcagagtgctagcagagagtagatctccacaggagggatgatgtcttcatagtctttcaggtgaagagctgtcttcagtgcagtgtccacacatccctcatagagctgcctctgtgcaagtataaagaagtggtaagcctctgcccctctccatgcattatctgtgaaacgatctgttgtagacagaacttcttcttccagcaaaccagccaaggcagaagtggcctctgaactttttcctttaacttttccctcgctgggcattcttcatctgttcatggtattgctctataagtaaggctgacagtacatagagcttcttgacacgtaaaggtttacttcctttctttgcctcttcatctgcaatcttaaacatcagtttagctgcatcaaaaaataattggctttccgatagagttctatggcatcaagagttttattcttttccagtaaatgagatgcatacctagctaacagagatccaatttctttcatactatgatttttagccaattcaacagctttgttccattggttgagatgtacgcaggtatctactgctgcctttggttgactacatttcaaaaatgcagtcactgcttgttcacacattccaactctgacaaacatttgtgctatttctggaagtaacttgtggttttctggaagtgaaatggcaaggttctctaacccctcataatcctctaacatatagtaacattcagctaagcgttcctggttccgtccttgtacataatattgtacagcattcaaccacttttgtcgatcagcaaagtagtctccaatggcattgttggcttgttccaggagactgtcatctgcatcaccagatccagttttcaggagctggagtactctaaaccaatcccccaatttcagccggaggccaatagcaagatcccttctgtccatctcgagatacgttctttcagcctcttcaaacctgccgaagtagccaacaacttcagcctgtttcattgactcactcagtagtttgcccaagcgcttcacaaacttaatgccttggtaatctttgcagcgcacaaatgcttgctctgcagtgtatagatccagtttctgaagagctgcttcagccagtaggcgccaaagtcgggggtgtggattgtcctctatgaactgagatgcatctttaattccaaccttctcaatcagtgctcggctatctcgcagagaccgaatctcaaagttaattaggtaatccttgtttggatgttctggatcctttaatatctcatccaaaagaacagatttaatttctaaatcctcaaaattacaaatatatccagaggtctgaatgggttcctcaggatccaagtttctgaaaacatacattcttgtcttctccatcattgcaaacaaatcaggattatctttggcccacttcatatcccagacatctcttcgttccaattttaacaactctccaactacttgctgtcccgtactgtccgttactcgagcatccaagtcaaagaaagtcagaactcctgagatgtctatgatagcaagacggctagagttgcaattcaaggataactggtaggctcgacaattaagggaatatttttgaatcaaaccaacattaggtagactgtatctctgaatggtgccagattcacgacccacaatcaatatcttatctgatgcagttatggcacaaattggatcccttgtgccttgaatggttttactataatcaagcacaccatccattgatccagaaggggtatcatcaacatgataaattctttctctcccttcttttcgagaccgtgtgatctgattaatttccaatgctgtgagcttctttgccacacgatattgccaggtataaaatgcttctttcgaggctgctatcacatgggttttggtcattgcaacaaacaatggtacaatatcaatgtatttcctcgtgcc

SEQ ID NO: 20860 - DNA, 669 bp, Homo sapiens
gcttaggggaaatatttctgtttgtgacacagtaatataccctgttgctagcactccctgcatggttgatggttgagatgcgcatcacagacagatggatgctgtggtgtgggtggaccctttggggattgtgtgcttttgctcagacaccccacggtgtgtgtaggcgggaagattctagaactctacctttaacagaaccaatgttaggtctattaaacaaacccttcggccctggggtgcataaatgcgctctgccaagtgacgacaccctttccggttgtgttatgaaagactcccatggcgtcagaggctacgtgagcttgttcatatcccgcttgtgcttgccgtgtttaggcacttaccgatgtggagcatgaaggataattctcaccccagcagttttatatgccggggacatcccggaattgatactgcgatggactactcgccaaataacaattcaggctatgaattctggcgcgtgaggagcctagatatacaccttgaaatgaccagtgagagaggactgatctcggtgagaacggccaaagaatgagcgctactttcaagacttgacaagcaagccatgcgctgcgggctgtatatacagcactcgcatgctcgcacccggcattgatgaaaatgttgcacgctatcgaaagcata

SEQ ID NO: 20861 - DNA, 2847 bp, Homo sapiens
agaagtttcgagaattgaatactatcatataggcggccgcgcaattcgcaccaggttttctcaccatctccagactagaggaattgtacaatacgagacatgggccctcaaatacattgtaccacttggtcagggatgtcaaaaaagggaacctgcccccagactacagaatcagcctgattgacatcggcctggtgatcgagtacctgatgggcggggcttatcgctgcaactacacgcgcaagcgcttccggaccctctaccacaacctcttcggccccaagagggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagcttgggggtcgccaggcaagccatcctttttcccaatgaggagccatcatggaaactggccaagaacatcttctacatgccctattggatgatttatggggaagtgtttgcggaccagatagaccgtaagcaagtttatgattctcatacaccaaagtcaggtatttaaattcaattcggttatgtcttttccaagttcatttgtttgttctcaataaatggctcaagatagaggactgattcctagcttgctatcttggaggaaacaaaaattacagaaggtgaatacacaattttagcaaagtagttcttgggtatttctttaggtatgtcatgttctgtgacacgaatcgacatctggtataccaaatttgatcaaacaatgaaccacttagaaagatctaaattactttatgattcaaactcccagggccatgtgttgaatatttcagtatcaggaatattttatgtcactacctccctacctctaccccagcctttagaaaataaatttcttgagttggacttcagaacaaataaacaatgctcgatttcaccatcagaattcaagagtaagggcaaacatctgcatggtatttttcttgcactggaaactattctccaactccctttcccactgtcttaaattatgtgctattgagactcataggaagctggtattcattgcctggaagtatggaaaatgccttaggtcataaactgagttgcttgctataaatgccaaaaagaaaatagtatctatattatgaaacgattcagtgtggggagtgaatgccagcaagcccccaaggtttcatgccctaatagatgccgattctctgtaataaacactccttttgtatggagtttgaagatagttgtatcctaggagtctgttccaggattttactgggaccaaatgtcaggacacaccaggcattgggaaattttttgggaagaaagcatcattaaagaaacatctttcagtgtggaggagttgaatcccaggagcaatgattgacacattgcccctgaggagtttagtgctggaaattacatccctccaacatgtgttgaaataacattttttcagacctttcttttgctgaccggccatcgcgacctggagccctgaactgtgggaaatgggatcagggtttgcataaacccaggaagtaatagccttattgaagcagccaggaacccggacactatgttatctttccctctctttccccctgtcccattccccggtgaggacccgataaccaagtaaaatcggggtacaaggtctccttata

SEQ ID NO: 20862 - DNA, 2285 bp, Homo sapiens
ctaatttagacctttacttatgcatcaagagcatattcatttccttcctgcctggtacagcctggggaatctgaatatacagccagcagcacatggatgccctgtaataaatgaaagtcgcattcattcaggggctggagaaagccaagagacacccccgttttccctgccaacaaaggtgcacttctaggcacctcacacaccagaatgcagaaccagatttctaagctggcaagagtccatctaattttagctttgctccggccttggcatgaaatgctgctggggtggaaatgaattctgctgctcctcttttctaagtggcttttctcctcaagctccagtgggatcctgaccagctctcagaggccatgccacatgggtcacactgatgagactacccaaaagggtgtcatcatttggtagccatgcatttaacaacccagggcctaagttgtttcatggtagcccttagattggttcttggagagctaggattctatatagcaaacacgtgaagacaattttgggctatttgaaagaaaccagacaaaccaaaaaggaaccaaccacacaacaacagcaagttgcattcccacgaattaaatcaaggtggtaggcaaagtttccgggtagagcggacagtcactgtcccttccccaggttccttatcttctgcttccaatcacattctctcactctcctctgcttccaaacaaaacaaacatttcagtctccacagagaacttagattaaggctgaactatcatttgtgtttagttcaacatggcttagaggtgaaaagcacctaaattatgttgtgactttacagcgactccattttctttcctttgggtttagttttaagcacatttggaaagtaaccttagaagtttcattccagtatcttaggctttattgatcttatcgatctttgatctctgtgtttagaacaaataacagaagaaaaggtggaaggcatatcaaagatctgtagcaaggtaacattgcctcccagaagtgagggcatcaaagccgccctctcttctgaggtgtatgattgatgttaaaaacccaccccaagggccctattgtacatccatatacgtccaacccaattaagaaagagtattttcccaaacatgaaatgggcttagcaattctgaagtaaaaaaaaaaaaagagttagctatggagcacacgcattccgttagaaatgagtcactctgcgaaggtgtgtttgaatgagcagcatttcagaaggcccgcacggggtacacccacaggatgggactggagaccctgggaagggctgtgggtccaggcggatatgagatccgatcagcctgaaaacatgcttcacaaaccaacctgggcacgacacagaaaagaggcaagacatcgtagggcagcataaaagatttgtacctttctcaaatagcttggtacttgggactccagagcagttctgaatgaccagctagggcagtcacccaatccccactgggcccatccagggccataacatgaatattaaatcatttggaggacaggaatgttcaatgaccttggccaaatgtcatgacagattttgggggcagccttctatatccatttgagaaaggacaaatactcactagcactagacagaaaactggctgatttagcttagaacagtggctaccattgtagctctttcagaacatcgaaaaggaaggtaagtggttggggaagggcatcacgaaggctgcatctatccaaggctgggtcagttatacattgaggtttggagtcgaaatttattctcacacacgtagagctccacagatctaattaacagtgtgggaaatctattttcatgtttcactcacacagaacacatcttctctgtctccagggggttttcaagttctaaactacaatcagcccttcttttaaaataacaataataaatcctcttattcagccagatggtgggtgtttgttgcacttagctgggttcatagtacaacatcaataaatgggccacctgtagagggacagacagaatcccatttataaaacacacctacaccttcctccttcttccatcccaaaagtgggcatttgtcaaaacttccctggggggcttaatctcattttggagcagaaaggaaaactaaaaaaggcaaattatgtaacctagtggaaaaaccattttcttggggggaaatagcacatttaaattcctgaagaaaaaaggtcttagggggggttttttaaaaaggggctggtttgcccttaag

SEQ ID NO: 20863 - DNA, 800 bp, Homo sapiens
cgaggccgattttttttttttcactttataaagagtttaatgtaaatcacaatggaaaataaaataagaggaggtaaatatcaagatgttaaatagtaccagaattttgtaggactctcccagccacagttaagggctacttttcctaacttctcattagaagatttgcaagagttttgctcttccttctcgtgtctgagaattgaatttatcaatcacccaaagaacaacaaaatgatttgtaacattttcatgaaatataagcctcttctttatcaaaagtagaaaagctgtggtatattagatgctccttagggattagttgattgaacaattaattaattaatgctaatttaaaaactttgaagtaaatagaaccatttcctatttggatgaaacactgtccttctcctaagaaaatgtattgtgaaaaaaatagaagttccacctttgccccatcatttaggcttcagagccaatttttccaggacctttactctaatctgccgagtttttacacaatacgcaatgggattcatcaaggggtggtaccagcaagaatgcatttgctatcagaatcatagctaaagggggatttatgccttagcaaagcgacgcatggtagccaaggtgatgatgggcacatagaggacgagtacagcacagatttgagacacaccaggtgtcaagagccttcgaggcactccccatgggatgcaatacccaacacagtcttcagggtgaacacatattggaattagcaataaaaacactgtctgacatcatgcagagtgcaacgg

SEQ ID NO: 20864 - DNA, 936 bp, Homo sapiens
cttagagttacttacaaaatcgtcctacccagcatgcacttttggatactctttcaactcagaagtcaacataaagggggactaggtgcctattaattctcaggagggtgttcctcggctaaaggagagtatgaagatataaacaaaggtgcagattcccaacagagtgctggaacagagaagctgcagaagctggaggatctgaaggctttccattcttggtctggaataaggtagccataagcctgacccatgagtggataagctagtgacctatctgtgatgtttctgctcaatacctcagaagttgaagtctccacattcctattgattgggataccaggacttgagcatgcacacatttggatctctatccccatctgccttatgtacctcatggacatcctgggcaactgcaccatcctatttgttatcagaacagagcattccctgcaagagcccatgtactatttcctctccatgctggccctgtccgacctgggcctgtctttctcctccctactcacgatgctgagaatcttcttgttcaacaacatggggatttctgctgatacatgcattgcccaggaattcttcatccatggattcacagacatggagtcttcggttctcctaatcatgtcctttgatcacttagtagccatttgcaaccccctaagatatagctctattctcacagcttcagggttttgcaaattggactggcttttgccattaaaagcattctcctagtgctaccccttttactttaaagagactcagatactgtaataaacgccttttatcccactcctactgccttcaccaggatgaattgaagctggcctgctctgacaacagggttaacttttactatgggtttggtctgtgcactctggttgaatgtagacagtgtttttattggtatttccttag

SEQ ID NO: 20865 - DNA, 767 bp, Homo sapiens
  misc_feature (1)...(767): n = A,T,C or G
gctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattccaagttgtacttgttataactgttttcttatacactatacaaccatcancgatgaatgtgttntncaaatntnctgnagttnacatgcacaaaaaaagatatatattntctaaaccgccnnntaaaaaccggtgcgcgccggcccgggctccccgccggtc

SEQ ID NO: 20866 - DNA, 103 bp, Homo sapiens
ggggggggggaaggggaggaaggagaaaaaaaaaaccttttgtgtaaacccctttgatcgactgcagcctgcaacttcaggttgagagtgtataagagaagga

SEQ ID NO: 20867 - DNA, 3161 bp, Homo sapiens
ggcaccaggatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaaccaaaattatctctgaaagctgacaacaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcccgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacttgtatataaaagaatgaaattgaaaaaataaatttataaacataaattaattacggtactgtttttttgagttggcatcagatctcactcatttttgggggccccggtgttctcaaaagccacatggtgtcagagcagcacgcagttgtatgcagttatggttggggggaatgtttgtcagggtcttga

SEQ ID NO: 20868 - DNA, 470 bp, Homo sapiens
aactggagctatgcagaattatgccagaaatataccacccctattgatttgctaggatatgaatttgaggttatcccatctgatacatctgacacatcaccagaagatggtgtttatatccacggactgtatctcgatggcgcacgctgggaccgagaaagtggattgcttgctgaacaatatcccaaacttctgtttgacctgatgcccatcatatggataaaaccaactcaaaaatctcggattataaagtcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaaattggacaaatttataaaacatccaaaagtttaaaaaaaaaaaaaaaaaa

SEQ ID NO: 20869 - DNA, 617 bp, Homo sapiens
ggcacgagatggagcttgttgaattacagcccaaattggaggaagctaaaattgaaaatgcaaatatgatgcaggttattgagatagagtctgtacaagtggaagcgaaaagacaatttgtgaaattggatgaagagatagccagtgggaaagctgaagaagcccaagctctgaaaaatgagtgtgaaagtgacctagctgaagcgattccagccttggaagcagctctgtctgcactggatacacttaagccagccgacattacgattgtgaaatcaatgaagaatcctccatctggtgttaaactagttatggctgctggtttgtgtcatgaaagatataaaaccagaaaaaatttcagatcctttcaggactggaggcaagaaattaaattactggggaccctagcaaaaaacttctggggagatttgaaatttcttatagagatttggaaagaatttgtcaggggaccacctttccagtggacttgttttgcaaaaaaaaattcgtagtggaattacttaatggaaccccctgaatttgatcccccctaaaggttggttaaagagttttttttgtacacttgaggggttctgttgtaagagaggataactggg

SEQ ID NO: 20870 - DNA, 2624 bp, Homo sapiens
ctctgaaaaagaaaatcagcttagtgttattaagctatcagattcagactatatgagaacattggaaaactgtattcagtttggaactccacttctattagaaaatgttggtgaagaactggatccatctttggagcctttactactcagacaaacttttaaacaaggtggcattgattgcatcagacttggtgaggtcattattgagtattcctttgatttcaaattttatatcaccacaaaactgagaaacccgcactatatgccagaactggctacaaaagtgtctttgctcaatttcatgataactccagaaggacttgaagatcaattactaggtattgttgttgcaaaggagagaccagaattagaagaggaacgaaatgccctgattcttcagtctgcagctaacaagaaacagctgaaagacatagagaaaaaaattttagaaacattatcatcatcagaaggaaacattttagaagatgaaagtgcaattaaagtcttagactctgccaaaatgatgtccaatgaaataacaaagaaacagcagattgcagaaaaaacagaactcaaaatagcagagtctcgagaaggctatagacccatcgccaaacactcgtcagtgttattctttagcattgcagacctggctaatattgatcccatgtatcagtactctctcacgtggtttgtgaacctttatatcaactctattcatgacagtaacaaatccaagattttggaaaagcgcctacgatatttaaatgaccacttcacatacaacttatattgtaatatatgccgatcactatttgagaaggacaagctcttattttcctttttattatgtgccaatcttcttctggcaaggaaagagattgaataccaggaactgatgtttcttttaactggaggagtaagtcttaaaagtgctgagaaaaatcctgatccaacttggctacaggacaaaagctgggaggaaatctgtcgggcaagtgaatttcctgccttcagaggactcaggcaacatttttgtgaacatatatatgaatggcgagaaatctatgacagtaaagagccacataatgctaaatttccagcaccaatgggaaagaaacctaaatgaactacagaaaataataattctttgggggtttaagacctgataagataaccccagctataacaaactatgtaactgacaaactaggagaaaaagtttgtagagcctccaccatttgatttgacaaagagttacttggattcaaattgcaccattcccttaatttttgttctatctccaggagcagatcctatggccagcctgctgaaatttgcaaatgataaatctatgtctggaaataagtttcaagctatttcactgggacagggacaaggaccgattgcagcaaaaatgattaaagcagcaattgaagaaggaacttgggtgtgcctacagaattgccatcttgcagtgtcctggatgcccatgttggaaaaaatatgtgaagattttacctctgaaacctgtaactcatcctttaggctttggctgacaagctatccatcttcaaaattcccagtaacaattctacagaatggagtaaaaatgactaatgaacctcccacgggtcttcggctgaatctccttcaatcatatctcactgatccagtttctgatcctgagtttttcaagggatgccgtggaaaggaactggcctgggagaagttactgtttggagtttgtttttttcatgcccttgtgcaagagagaaagaaatttggtcctcttggttggaatattccatatggatttaatgaatctgacttgcgcatcagtatccgacaactgcagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagaaacttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaatttaattataactatacgtaacactctacgggaccttgaaaaagctattaagggtgtggttgtgatggattctgcattggaggcactctccagtagcttacttgttggaaaggttccagaaatatgggccaaacgttcatacccaagccttaagccctgggaagttacatcacagatttcctagcccggttgaactttttacaggactggtataattcaggaaaacctgtgtgttttggcgtcaggtttcttttcactcaggccttttaactggag

SEQ ID NO: 20871 - DNA, 940 bp, Homo sapiens
  misc_feature (1)...(940): n = A,T,C or G
gggcagtgtttcttctgaaattctcaggcagtcagactgtcttaggcaaatcttgataaaatagcccttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatggccttataatgggactaattttacgatatgctacagcaccaactgatattgaaaggtggaactgtctatgacctgtgtaaaactacctttcagtccatcaactctgctggttaatatcactgaccaagtttatgaatataaatacaaaagagaaataagtcagcacaacatcaatcctcatcaaggaaatgctatacttgaaaagatgacatttgatccagaaatcttcttcaatgttttactgccaccaattatatttcatgcaggatatagtctaaagaagagacacttttttccaaacttaggatctnatttaacgtatgccttcttgggaactgccatctcctgcatcgtcatagggttaattatgtatggttttgtgaaggctatgatacatgctggccagctgaaaaatggagactttcatttcactgactgtttattttttggttcactgatgtctgctacagatccagtgacagtgctggccattttccatgaactgcacgtcgaccctgacctgtacacactcttgtttggagagagtgtgttgaatgatgcagtggccatagtccctacatattactccttgtggacattcttcaacatctctctacaatatcaataaaatacagggcttaggaaaaaaaaaaaaa

SEQ ID NO: 20872 - DNA, 2386 bp, Homo sapiens
ggcaccaggcgccacggacgcccccgggccgagcggcggtgcgctcccgtgcagacccgtggacagacgcccctggccggtggactctcgagtctcgcttctgcaccctgcgtccccagacatgaatgtgaggagggtggaaagcatttcggctcagctggaggaggccagctctacaggcggtttcctgtacgctcagaacagcaccaagcgcagcattaaagagcggctcatgaagctcttgccctgctcagctgccaaaacgtcgtctcctgctattcaaaacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtgggaaagttggaagaagggcatccaaacacaaacacagggatgtctttacagaaccatatggcaaaaggggtcagggatatcctattccttcccagtatataggtaatgccttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcaacaactaatccagattacagtatgatttagctcatcataattcagattatttttaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtttataactctacaaaaaaaaaaaaa

SEQ ID NO: 20873 - DNA, 613 bp, Homo sapiens; identical to SEQ ID NO: 5658

SEQ ID NO: 20874 - DNA, 1517 bp, Homo sapiens
ggcacgaggggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgccgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgaaaaaaaaaaaaaaaaaaaaac

SEQ ID NO: 20875 - DNA, 824 bp, Homo sapiens
gtatgctgcaacgactctcttaatcctccacggctacacgttgaaatttatcactttccctgatggttgtcaggatatctctacttctttgattcataacaagaatctgatgcatcttgacctaaaagggagtgatataggggataatggagtaaagtcattgtgtgaagccttgaaacaccagagtgtaaactacagactctcagcttagaaagctgtggtctcacagaggtcgtccgtgagtatctttctttggctctcatcagcaataaaagactgacacatttgtgcttggcagacaatgtcttgggtgatggtggagtaaagcttatgagtgatgccctgcaacatgcacaatgtactctgaagagccttgtgctgaggcgttgccatttcacttcacttagcagtgaatatctgtcaacttctcttctacacaacaagagcctgacgcatttggatctaggatcaaactggctacaagacaatggagtgaagcttttgtgtgatgtctttcgggatccaagcttgtatcttcaagacttggaatttgtgggctgggttctccctaatgcattttgccgggatctggcttctgttattttgaataacccgaacctgtaggagcctggacctcgggaactacaatttgcaagacgatggagtaaaactctgtgggatgctttcgaatatccaactttgccgtttcgaagctccgttttggaaaaccgggtgttgccaattttttttttgaaagaactctccttgatcttatcgggtaaaaataatgcttaaagtaattggcaccgattcctaggtgtggt

SEQ ID NO: 20876 - DNA, 417 bp, Homo sapiens
  misc_feature (1)...(417): n = A,T,C or G
aaaaaaaacctatagggcgaatgggcccgtcgtcgcatgctcccggccgcctggcggccgcgggaattcgatttactcacaatccagcctctgtgggaccacagctttctaagcgatcccaaggtaggaagtttcctaatctttggaatcttgncctgaaaaatccaacttctctacacagtaaaaaaagttatttaactaaagcataaggctctgacagagttaaggagggaagggaaggagattgtttatcacattcccatccccttaattccctatgaaaatacatttgagagcattcaaaaatatctttaaatgataatattttttagtctgggaggaatttccgctaactacaacttggaagatatggcgtgaaggatgactgtattctacactctgacctctganacagaa

SEQ ID NO: 20877 - DNA, 1175 bp, Homo sapiens
  misc_feature (1)...(1175): n = A,T,C or G
cttggctcaaaacattccagcagtgtcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactntgttttggtcctaggcattaggtaatataactgataatatactgaaacatataatggaagatgcagatgataaaactaattttgaacttttaattatataaat

SEQ ID NO: 20878 - DNA, 408 bp, Homo sapiens
cccgacgtcgcatgctcccggccgccatggcggccgcgggaattcgattgggggaaaagagagctcgttcatgataagagacaggtttggttccttggtaggagacagttagtcctgccacatcagaattttcacagcccagtgcaaacagggaaagaaataggaggtaaccaaagacagatgatcccaagtagagttttgcagctccacacacactgattctgaattttttcataactatccccccagagaatattccaagggccactgctggaatgttgatgagcccgatcacaaagttggccctggaggatgactgtccatactgctgctcaatgtactttggtttgtacgtcacatgccgaacagagaactgaactgaacagtgcttgtacataaatacccccg

SEQ ID NO: 20879 - DNA, 559 bp, Homo sapiens
ccccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtgggtgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatcttctccccatacaaaaaaaaaaaaaaaaaaaa

SEQ ID NO: 20880 - DNA, 754 bp, Homo sapiens
tggggggggttttaaggcagctctgccttgagttaaatggacttgctgtcaaacttcagagtgaatgccatccagatacttgcactcaaatgacagcaactgaacaatggatttttctttgtgcagctcataaaactccaaaagagtgtcctgctatagactatactggacacacacttgatggtgctgcatgtcttccgaatagcaataaatattttcccagcagggttagcataaaggaatcatctgtagcgaaactaggatcagtatgccgtaggatttacagaatattttcacatgcttattttcatcatcggcagatatttgatgaatatgaaaatgagacatttttgtgtcatcggtttactaaatttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccaaattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaaaaaaaaaaaaaaaaaaa

SEQ ID NO: 20881 - DNA, 245 bp, Homo sapiens
cggatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagaaatcgaattcccgcggccgccatggcggccgggagcatgcgacgtcggg

SEQ ID NO: 20882 - DNA, 679 bp, Homo sapiens
tcgttctgtgactactctctaaatccgtccaccgctacaactacaattataacattcatttcctggctggcgagaagaaaactatgaactcagagacattgtgcttgactgtcctgatggcagtacaatccctcacgacctgctcttgtttagacatatgccaactatatacgaccttaatgtacagagaatgctgacttcctcgtcccagggtattttataagagaggaaaaataatcatttaaaaagtgagaataaactaagcaaatgggagaataactcaaaacaatggagtctgactgtggttgactggatctgaaaaataaacacaagtaccgggcgctaacctttaaggaagggtaatagatgatcctcgggcagtgactgcggtgacgagcgaggtgaaagtattgaaggcaagagagggagatggctaggtgcgggggtggcggcgcgaggacctggggagccaggcacaggaaagcccggagccacagggaggaatagggccgaggccccgagaagagagggcgcgcgggcggtcagaagggaggagggcccagggtggaggcgcagggcgcgggtgaccggcgggtaagcacgcagcaggaggagacgagggcgggggggaaccggtagaaagaggaggagggtaaggcagggggagaaagagaggaaa

SEQ ID NO: 20883 - DNA, 388 bp, Homo sapiens
tgtatctttcattactattaagaatttactgtgcttattattattattattgttgataaagtaagtgaaatagactatttcagtagcagtgtatgctatttaaatcatcttcttgcttgaattgctgaattgacttcagaaaacgatcccagctaaacaacatctacatctcacagtagcttcatcttaatttatacaagaagcactttctgaagtcctcacattaagatttaattcagtaacactttcatcttgaaaaagtaaatggctgggtggccttaatcagaagcggacctggtaattcagtattagagatgagactggaacctgcattaattgcacccattagttttcttggcaggttcatccaatgactttcgtgtggttt

SEQ ID NO: 20884 - DNA, 1147 bp, Homo sapiens
atgcatccaacgcgttgggagctctcccatatggtcgacctgcaggcggccgcgaattcactagtgattggtgatgtcagcattaactgtacatgaaggtcgtatatagttggcatatgtctaaacaagagcaggtcgtgatatgcttgtattggtaagggattgtactgccatcaggacagtcaagtacaatgtctctgagttcatagttttcttctcggcagcaaaggcatgaatgttccaagagtaagatatcataattgtacttggcagtcttctcacattcccctgtgcattttgccatctgaactcttttcttgcaaccactgtagataacagtcacatttacaagggaagatctgcaattattcttacatgtatagcaacatttttttgaatcatagattctgtcttcctcaggtgatccgcccgcctcggcctcccacagtgctgggattacaggcctgagccaccgcgcccggccagggtttgtttaatatgagaactgaatctcggcgttcattagttaagatgacttgcttctgcacaccaggtttgctttgggcagtccctggactactgcaggcaaagcccgtgtctttgcaggagtatgagaccaggggttgctggggtcatcgaatgaagcaccaatctcatagtcagtattgttaaataaacatgttcttggttcacagtatccgatttcacagcaggtgtcattagattggaacttcacaagcttctcgccggttttgcatgtgggtggagaagggcactcctcaggtttacagtctatagtctttgcatcagtacaggtacctctgtggcaattggcagtccatatgtctccaggctacataaacaaaccaagtttagacttctattcaaatacaggaatgagagcaaatttggattaaagtagagcaaaactgtgtacttacagatttcccttctcccaatggaccgtgacaaaccgttgacataaatgataaatggtaattaaatttggcaaaatataaccatctgttatttatagataaccaccaggtggccagtactgtaattggcattaggatttcagagtgactgaattatagaagattttatgttgccttaaggtgaataaaatcacgtccacctgcccgcg

SEQ ID NO: 20885 - DNA, 357 bp, Homo sapiens; identical to SEQ ID NO: 306

SEQ ID NO: 20886 - DNA, 661 bp, Homo sapiens
  misc_feature (1)...(661): n = A,T,C or G
catagctgagacactctcttaanatccaccgctacaggtctcctaaaaattaagagagtgattgctgttgaaggagatattgtcagaaccataggacacaaaaaccggtatgtcaaagtcccccgtggtcagatcatgatggacacagttttgacagtaattcttttgggccggtttccctaggacttctgcatgcccatgcaacacaggggcttggcagaaattggaatctgttcttcctccagagcgcttaccagtacagaaagaagaggaatgactgcatgaatctacctgagttgctactggaaaggatggaaaaaagaagcctgaaaggggaaaactgttgacaattgatgctggggcagaaatattagcaggacattgaacatgatttggagatgtgggacagagtaaatggagcgctatttgaggtagaattaggggcgctggggggtgatggccgggaagatgagcagaccttaacgatgatataattgcaatgagagagaggatttagaggctaagtggtaggtgggggcggggaggcagggtgagggtgcgagagaaacggtgagggcctagagaaagagaaagagggacgaggacgagagagaagagatcgagtcgactagcgaggcagggggagatgaggaaggctcta

SEQ ID NO: 20887 - DNA, 646 bp, Homo sapiens
cgcgggggcgagggcacaaaataaccacttaccccttcccaccgaggaagagcgggagaaagggtatggcacagtcacaagggtgggtgaaaagatacatcaaggccttttataaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggcgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttccgcatgcccatgccacacatatcctgtggcccccggagcgctggcagaaattggaatctgttcttcctccacagcgcttaccagtacaaatcactagtgaattcgcggccgcctgcaggtcgaccatatgggagagctcccaacgcgttggatgcat

SEQ ID NO: 20888 - DNA, 506 bp, Homo sapiens
  misc_feature (1)...(506): n = A,T,C or G
tagtggtgtgtgtgtagcacttaattgcaggcaggaaggaaaagatacttttgataaccgacaggcagcttttctctgcttttgtgtcaaaagggaggaagggagtttggagagggaaatgaattctctgtaacactaagctctcttcctcaaaaccagaggtagatagaatgtgtaataatttacagaatttctagacttcaacgatctgattttttaaatttatttttattttttcaggttgagactgagctaaagttaatctgtggcgacgtcctggatgtaatggacaaacacctcattccagcagctacaactggcaagtccaaggttttctatcatgaaatgtaggttctatactaacaattaacaagtgtacaatcactagtgaattcgcggccgcctgcaggtcgaccatagggagagctcccaacgcgttggatgcatagcttgagtataggatagtgtncacctccncgaggctnagcttanataatcgaaagtcc

SEQ ID NO: 20889 - DNA, 578 bp, Homo sapiens
  misc_feature (1)...(578): n = A,T,C or G
tttctctcaggcctctccagcacgcccttggctcagccaaagaagagactcaggctgtgcttctgtgctgtggggataacgctggtcttgaactcctgaactcaggcaatcttctggccttaacctctcaaagtgctgggattacagagacggggttttgctatgttgccccggctggtcttgaactcctgagctcaagagatccacccaccgcaacctcccatagtgttgggattacaggcgtgagccactgcactcagcttcttttctaatttgtttttattctgagatcagatgagatcggcatgttcaggttgagactgagctaaagttaatctgtggcgacgttctggatgtactggacaaacacctcattccagcagctacaactgggcaagtccaaggttttctatcatgaaatgtaggttctatactaacaattaacaagtgtacaatcactagtgaattcgcggccgcctgcaggtcgaccatagggagagctcccaacgcgttggatgcatagcttgagtatngtatagtgtcacctccccaagngctgggctatntaacggaagtcc

SEQ ID NO: 20890 - DNA, 724 bp, Homo sapiens
atgcatccaacgcgttgggagctctcccatatggtcgacctgcaggcggccgcgaattcactagtgattgagaccataacccagaactgtcactttactggtcaacattctcctaacatcagttttattctgaataacattgatttcttctggacttagctctgggatccatttttcaaattcttctgtccaagggtacctcagagacgaagggaccattattaacagaggccattcctctttatagaagtaaataattccaattgcctggattgtctttcctagacccatctgccatttcttttgagggcaaaaatgatgccatctttctggaatggaagtagctttgctcttagtctgtcaggcaaaaaatccagcagattatcagattgatttgtcacactagaaatgtgaggtgtaagagacttttttatgttatgaaccctaggcatgatgatctaataatgttaaaacccctatggcattttgaggaaactcttgcggatacccttcttccatcattagtctccggccaataatcgatgctacacggacccacccgtgaacgatctttgttacacggcgcaatcccagaataacttgtgctaccctgacccaaaccaatgatccgcgaacgacatggctgttcagaagtctgccacgaccgacccagtcgcgtctatggtgagctccatgaccatgtactgcaccctgtttacccgtt

SEQ ID NO: 20891 - DNA, 1383 bp, Homo sapiens
cgcgggtgggaccgtggagcaacgattattcgcgggtgggaccgtggagcaacgattattcgcgggtgggaccgtggagcaacgattattcgcggggcgccagctatcctgagggaaactctggtggaggtccgtagcggtcctactggtagtcattgcggtcctactggtagtcattatgggaccgtggagcaacgattattcgcgggtgggaccgtggagcaacgattattcgcgggtgggaccgtggagcaacgattattcgcggatgggaccgtggagcaacgattattcgcgggagttggagattctgcggcgaatacgccaggatcatcatgcctagggttcataacataaaaaagtctcttacacctcacatttcttgtgtgacaaatgaatctgataatctgctggattttttgcctgacagactaagagcaaagctacttccattccagaaaggtggcatcatttttgccctcaaaagaaatggcaggtgtatggtggctgatgaaatgggtctaggaaagacaatccaggcaattggaattcttacttctataaagaggaatggcttctgttaatagtggtcccttcgtctctgaggtacccttggacagaagaaattgaaaaatggatcccagagctaagtccagaagaaatcaatgttattcagaataaaactgatgttaggagaatgtcgaccagtaaagtgacagttctgggttatggtctcttaaccgcagatgcaaagactttgatagatgcactgaataatcagaacttcaaagtagttatagtggatgaatcacactacatgaaatccagaaatgcaactcgcagcaggattttattgccaatagtacagaaagccagacgagccattcttcttacaggaacaccagctttaggaaggcctgaagagctttttatgcagattgaagctctctttccacaaaaatttggaagatggaccgactatgcaaaaagatactgtaatgcacacatcagagtctcactcccatcgcccaggctggactgcagtggcaccatcatggctcactacaatctctgcctcctgggttcaatcgattcttctgccttagcctcctgagtagctgggattacaggcatgcgccaccatgcccggctaatttttttgtatttttaatagagatggggtttcaccatgttggtcaggctggtcttgaactcctgacctcaggttattaatcattctttattccagtgttttacaaatttgtggtagctatgaaataattggtggactattatacatataggtggatgacgtatatgtaaaaaaataaagagtagagtcgcccgaaaacttcgttttgttgttgtgaatttagctattct

SEQ ID NO: 20892 - DNA, 273 bp, Homo sapiens
cccgacgtcgcatgctcccggccgccatggcggccgcgggaattcgattcttttggcctatgcccaccatcacgccctggtgtctggggcgcccgacgatggaaggaaacacggctcggggagcgtcgtccccagcaaaaccagctttgcacatgccggagccattgtcaatgaccagcgcggcgatctcttcttccattgcgaccggcagagaaacgcgacggcggagcggcggaagaacagagtgcgagagttggcagcggcgactgagca

SEQ ID NO: 20893 - DNA, 1064 bp, Homo sapiens
agctggggagggaacttgacccgttagcagccgcagccatggctggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaaggcctttgaagacaatttaattgaagcaaggaaagaagttgaagtatcacagagtaaatacaatgctctaccattacagttgagtaataaacagactgaacttatccagaaagatatggatattaccctggtcaggaaggaactggagtgagctgcaaaatctttacaaacagaacagttcacatacaggcccagcaagcagagctgatccagcagcttcaggttctcaatatggacacacaaaaaagttctgagaaattaggaagattgttcacacaagtgaaagatttcatattcaaaagtacctcatcggccatccttataaagctaaaaacgttattggtttacaaaagtctgaaatgagat

SEQ ID NO: 20894 - DNA, 712 bp, Homo sapiens
  misc_feature (1)...(712): n = A,T,C or G
taggtaggtagctacagaagtcttgctaaccctttgaaaatgtcacggatgagggtcagctcttgctgccaataaaaccatatgattttaatgactgcacgtcaagatgcttcagtgccgcagattaaatttagtcagggggaaaaaacagcctagttgaaattatatgcagcaaggcctcaaagggttaaatgtaataatacgcagagaaatcaggcaatgttatcagtattatctaccttccatacaaatgattatagcaagagttaaaagagacagtatccccttcagagttaagttagggcttctaaacaggattaaggtccgcagatagcaatctaccaggttttattctctcttcatcagctcacttcttatttctccaacaagaagtacctttaaccctcagactaagagagcaagaagatactgtggtgaacatgaggataaaataaaactacattactttgaataagtccttgccatttaccctctacaatacattgatgcagcaattttgcacaacagcaatatagcgcattggtcagacatcaaccccttttaacaaccgccctaaagggatactgctcctttctgaccgggaggtttacaggatcaatggggagggaaacaatctgctttttaagatatcctncactgaagagtagcttgacattacggctccagcggaggatgtccaacatacataaaa

SEQ ID NO: 20895 - DNA, 447 bp, Homo sapiens
  misc_feature (1)...(447): n = A,T,C or G
acactatagaaanactcaagctatgcatccaacgcgttgggagctctcccatatggtcgacctgcaggcggccgcgaattcactagtgattgctcagaacttcttaatggacgaccatttttaaaccaactaaatgttagctcctcagaaggaacagcttctacttggcaagatattttcacctcacggtcaatctggatgttgtcatctttgtgataaggatctggtgtgatccaaaatcgtcctttttttaatgctctcacaatgatgttggtggacttttttgcagggtttcccacattattattggcaatgcagctgtaagtaccagcatcatctgaggtgatggcaggtatggtcaaagttcctccattcaaaacagtcttctcaggcagagtcccaaaggacctgacccaggtgagagaaggtgcaggctctcctcctgtt

SEQ ID NO: 20896 - DNA, 137 bp, Homo sapiens
cccgacgtcgcatgctcccggccgccatggcggccgcgggaattcgattctttgagactaagcaacacggaaggtgtttttatatttttgttaaatcttggagtggtgatcctttccttaaagatggttctttcatg

SEQ ID NO: 20897 - DNA, 477 bp, Homo sapiens
aaatagagagaacttgagggaaaagacacagacctggtgaaatagatgggaaacagagagaacttgaggaaaagacacagacctggtgaaatagatgggaacaaaccacccatgccaggaaacatggtgggattagcaaaggtaaataagcctttttcatgagacaggaaataaatgtcagcaagctttagaaacggattgtagacatttatttcctgtctcatgaaaaaggcttatttgcctttgctttctttgatgccatccagaatccataccctgagcatgttacacatggttcatggaactatcctttcctacatctgtttcagtgccgcagacttgaagtcatcgtccaggcacgcacctagcttcatgtgtataaagcgctattttgcacagctccttcattttcaaagactttcacaaacgtagaagcaaatacaaatgtgcaaatctgggaactctagacatcggcaa

SEQ ID NO: 20898 - DNA, 712 bp, Homo sapiens
tttttttttttttttttttttttttgtaagattattagtataaaaggggagataggtaggagtagcgtggtaagggcgatgagtgtggggaggaatggggtgggttttgtatcttcaaactgccactttacttttacgttgttagatatggacgccctggagcttgagaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgttaatcactagtgaattcgcggccgcctgcaggtcgaccatatgggagagctcccaacgcgttggatgcat

SEQ ID NO: 20899 - DNA, 991 bp, Homo sapiens
ttaaggtcttagagccgatgacttgcagaatggtcacctcacccacttgcaatttcatggtgggaacaggtggaccccctggaatcagaacctctctgaggacatctgtttttgtgtagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcctatctctgccctgatttttgtatttgtttacaatactgagttattggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctg

SEQ ID NO: 20900 - DNA, 762 bp, Homo sapiens
cccgacgtcgcatgctcccggccgccatggcggccgcgggaattcgattctcaaaaatctgatgacaggcttctgctacatcccgccagtaaggaagcagcaaaggtagagaagagacctttttctctatcaaaggccagagatgcgagagcaaaaactcattcccctttggagacaaatgtagtccatctgataaataagatgaggagtcccggctgtcctgcatcagggtccacaggtcaagtacgtcagtcccacagtcttgggccacttgtaaacacgcattggcatattcaccaacaacagagttcaggcgatttagtttgcaaccttgtatgatgcactgttcttcccaggctgtttcacaaagtggggtcggcgtgatgagaatgactcgattctcagggatgtccacggacttcaggtactgcaccatgctctttaggttcgcagcgtactcctccaggggaatgcgctgcttgggattctcatcttttagtgcactgtcattggccccaaagaaaattgtaactgctactgggatgtccaaactgtttcctttcctgattaatcttggaaggataattttggcccacctggtattgtaacctgaaaatccacgattcagaacatcacacttactgaccagcctgtcagccagcgatgctccccatccacccccccgatctggattacgcgctaatcactagtgaattcgcggccgcctgcaggtcgaccatattgggagagctcccaacgcgt

SEQ ID NO: 20901 - DNA, 645 bp, Homo sapiens
cccgacgtcgcatgctcccggccgccatggcggccgcgggaattcgatttgtctgcgatgcttggtgagggcgtggcgggtcccgccggcaaagccgcagaggtcacacagaaacgacttctcgcctgtgtgcgtcctgtagtggtctttcattgcggaggctgtgaggaatgagtaatggcacgtgggccaggtacatttaaacggcttttctcccgtgtggagtttcatgtggttgttcagggcccacttctctgtgaaacttctatcacataagtggcatgtaaatttcctttcttttggggtgccaactccatgcttgcctagtagatgagtatttaagtgcttcttcattataaaagcaaccccacagacatgacacttgtattccctcatcccaaggtaccttttcacatggtttctggcatctccaagctgagctgttgcaaaatggcatatcttgcacttgaatggttttgatcctgtgtgagtgcgaatgtgtgccaggaaggccatcgagttgctgcttcgacacatcttcccacaatacttgcagacgtttccctggttttcctccctcccgcgaataatcgttgctccacggtcccatccgcgaataatcgttgctccacggtcccacccgcg

SEQ ID NO: 20902 - DNA, 325 bp, Homo sapiens
cgcgggagggaggaaaaccagggaaacgtctgcaagtattgtgggaagatgtgtcgaagcagcaactcgatggccttcctggcacacactcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatcaatcactagtgaattcgcggccgcctgcaggtcgaccatatgggagagctcccaacgcgttggatgcat

SEQ ID NO: 20903 - DNA, 1027 bp, Homo sapiens
  misc_feature (1)...(1027): n = A,T,C or G
aaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcagctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacagtgcctatgattgggtctgaaaggctggccttgctcccagtngtttagaaaagcagctagatgtgcacaggtttcctgcgggtgacagagaggccagcgcagcgcctgctgttcaggagcgtctcagaggcacacgagagcctgttggctgctcgcgcagagagcgcatgtggacacctggacagccgcgtgacttggaagcatgggagtttatcctctcaagggtggtggatgagaccaagaatgcgtcagtgttcatccacttctgtgctaacttacaagtttctttctcttatgaggcactgtgctgttttagaatcactttttatcgcataataaacatgaacagaaatataactgagaaatggagagaaaaattcaatgtgcatcaatttgtcctaggaactagtttcaaagaatttagatttatgaaaagcaaaaagtaatgagtaaatgatctaatggaaattatcccattcaataaatagctaccagttataataaaggaaaataaaattcataaggtttagagcaaggtgatccagaaactctccaactaaaatttcctcttgctgaaaatgtccaaaggattgtattttgtgattacctcagattgctgtaaactcttttttgctgaataaaactgtatcggcaagc

SEQ ID NO: 20904 - DNA, 2137 bp, Homo sapiens
  misc_feature (1)...(2137): n = A,T,C or G
cgcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaaagcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatagtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgtaacngtccacccctgtcgctcagaggcaccaacatttcggcagatgcagtgcagtgaatttgacactgttccctacaagaatgaactctaccactggtttcccatttttaacccagcacatccctgtgagctctactgccgacccatagatggccagttttctgagaaaatgctggatgctgtcattgatggtaccccttgctttgaaggcggcaacagcagaaatgtctgtattaatggcatatgtaagatggttggctgtgactatgagatcgattccaatgccaccgaggatcgctgcggtgtgtgcctgggagatggctcttcctgccagactgtgagaaagatgtttaagcagaaggaaggatctggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcaccagatgtacttctggcagtacggccactggacagagtgcagtgtgacctgcgggacagatcagagatccatgtgaaaaaactggcaagacattagtctaaactgagctcactggtatgagagccagccgactttccacagtttagtgctcagagtaaaagggcctctcagagaccaccagtgaacagtttgtctccaaaccagtgtttgttttttcttccctaacggcatttgttttacttttgccttacatggaaaggaccctctgactttaggaaattaagactgacttctcctagggaacttgaaaaaaattccatgctttacggaaggtt

SEQ ID NO: 20905 - DNA, 1126 bp, Homo sapiens
atattcagaccaatgcgtctcatatgagatgaagaaatgtccagaagaaactatactgaactgacagaatttgttctcttgggtctaacaagccgtccagagctgcgagttgctttcttggcactgttcctttttgtctacatagccactgtggtaggaaacttggggatgattattttaatcaaagttgattctcgacttcacgctcccatgtaattttttctctccagtttgtccattctagatctgtgtttctccacaaatttcactcccaaaatgctagaaaatttcttatcagagaagaagaccatttcctatgcaggttgtttgatgcagtgctatgttgtcattgctgtggtccttgcagagcactgcatgttggcagtcatggcatatgactgctatatggccatctgtaatccattgctctacagtagcaaaatgtcccaaggtgtttgtgtccacctggtcattgtcccttatgtctatggctttcttctcggtgtgatggaaaccttaaggacctacaacctctccttctgtggaacaaatgaaatcaaccatttctactgtgctgatcctcctcttatcaaactggcatgctctgacacgtacagcaaggagctgtccacgtacatagtagccggctacagcaacgtccagtctcttctgatcattctcacatcatacatgttcatccttgtcgctatcctcagaagccattctgcagagggaaggaaaaaaactttttccacatgtggttcccacctgacagttgtcacaatcttctatggaaccctcttctgcatgcatttgagacgtcccacagacgagtccgtggagcaggggaaaatggtggctgtgttttacaccacagtgatactcacgctgaactccatgatctatggcctcaggaacaaggatgtgaaagaggcgttgaaaaaagcaataggaaaacaaacattgggaaaataaaaatgctaagctatcattaaaaatttgtgaagtaatgagatataatatcattgggttagatgtcacattttaggctacatttgcacaattcatttctaattttctgttaggtagctgactgagttaagcttcctgaaactagcggcccgcg

SEQ ID NO: 20906 - DNA, 864 bp, Homo sapiens
ataagatcccagcctagtagggcccgatccttaaccctacattcaagcaatagtgaaccatttgtagtattggaaaacatcatgttattctatacccagacttccatttcactgggtgggcaatccattgcaacccacatcataagtcctggaattgtttgctagaaatcatcctagttgccttcatccaagtatcctgagtaacacaaggcttggcacatagtagatcccaatagtttttgttgagtagataattcagtataaccaggcagttctgaagaataaaatatggcaggcacactgtcacagatctttgcctgggagagatgaagacatgttcaatgtattctaagatcacaggatcaaaaatgaacagaggttaaaaacaaaaagactgaccacttccaggagtggtgaagacgaggagtcattagaactctcataccctgctggcaggaatgtaaagtggcacaaccacatggaaaacaatttgggcagctccttaaaaaagctaaacatatacttaccataccattcagccttcctagtcctaggtattcactcaagaaaaagagaaagtttttgtccacaaagatttgggtcacaaatgttcattgaagttttatttgcaatagcctaaaatatggaaacaatttacatggttccacgtaaaacacctggtgaatggttaaacaaaatgtggtccatccatacacgttaaacatttttcaacagaaaaaaagcaatgtaccttttgatccaagcctcacaaagggataattttccaagtattgaacgctccttaaaggaaccccaccaagaaagatttaacccgccccattcacttttttcatattttaaaaa

SEQ ID NO: 20907 - DNA, 846 bp, Homo sapiens
cggccgatcttcttttattcttgaggaaaattcctaatggttgttttcatgagcatcggtgacagggagtttgctaccagcaaatattccctgccagtgtcttcttggtgaacaagtaagtatcagaggttaaaagaatcttagggctcatagaaaataattggccaaccagggcgagaatccatttcaagggctatttaatggtcatcaaattaaatacttccagggactaggaactcactacctccaaggccagtttattttatcattggacagtcttgactgttagacatttttcttatatttttccttttctgaaatgccacccttaatctctaacttacacttccaaagtcaaagtgttcccattaccttcttagtgtctcattgtgatttccccaaaccacaatgactgttttctcgtaaagcatatgccttgctcagttattatttacttttatatatctttatcaaggtataattgaaattcaacaaatagcacatacagtatagagttagctgcatcttcacttacctatacaccctcaaaaccatcataattaaaatagttgaatatgctcctcatttccaaaattttgcacatgccccttttataatatctcccttattacccctagctcttccattctcaggaagccctagcttggcttttatccttagtttgcattttctagaattatgaataaatggaatcgtacagttcatactctttctttgtctggttaccttcacgtagcatcattactttgaaattcatcctttttgtagcatgtatcaatagttcattgctttttattgctgagaagtgtttaactgtatggatgt

SEQ ID NO: 20908 - DNA, 997 bp, Homo sapiens
  misc_feature (1)...(997): n = A,T,C or G
cggccgcatctccttttattgctagttcaaggatgcgtgtttttgaagataatttggtaatttttaaagtgtaatacttcatgtattttgtatatttaaaaattctcatgcttttatgtcaaacagaagacgaattatttatatttttaagaaatttcgtgaagtctaaagactgaatgatttagcactttcatcagttattgaatggccaatgaatgaggaagttaattaaacaatttaacaactttcagtgggacatgcatttcttatcaacccagagaaatgtacaaatcctgctgtatgattggtaaagttttcttttagtttacctgctattgggctccaggtttttatcagtgaaattctgctcctcactgccacccaggaaaagcaagtttccattacgactcaattgatattgagaaacgaggccattgggcttttctggcagactccaatataattccactgttgtagaattgatgataatgtgtcgaggtgtcacccaaactccctcaggagctgcctgcagtgtctgacctagaaaaggctcgcttgaagtgcacccagcagatgtacaagctgtaagagtgaagctgtagttggtgtatggctggagacctgtgaccgtatgctgtctactgtcagtggtgtcagtgtggatgagacctttccctgcctgcctgatctggtactgtttaatgactccttctgatttctcaaggactctccaactcacatgcatatccactgcacttatggctgagatgcctggaggcatgatgctctacggaactccttggttagtagttgtatctaccttgctactggngccacatcctagctccgagctggcattcaactgatatcactatcctctgaaacggaggaatctccccgaataatcgttgcttcacgtcccacaatccctattgattacctggccgccttcattccaccatatgccagagctctttcccgctgtaagcctatntgt

SEQ ID NO: 20909 - DNA, 503 bp, Homo sapiens; identical to SEQ ID NO: 1326

SEQ ID NO: 20910 - DNA, 840 bp, Homo sapiens
gcatccggttttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactttcaaaacatatgattagttgaagttaccaaaactatttttttaaataacatttatcttaagagctataaataaagaggaaattttgcactagagatgaagttgtgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctaacgtcatttctccaccgcaaggaggatttgcggggtggacgatgctccctatttagtcttctgcattttgttgcttacagttcaattaacatgtcagttagagatgacttttggctgcagttaataaaatatctgaccaatttgtccttaaacacagaggaggtgatattttttgtagaacaagagtctggaagcaggtagttgaaactatggaagaggtcctgatgtctt

SEQ ID NO: 20911 - DNA, 349 bp, Homo sapiens
ggcgggcgggaccgtggagcaacgattattcgcgggagggcaataaatgatggtgctcaataaatgtatttggaataaaattagattctgaaaggaacttccttgcttttaccaggtttaagctgtcgatgacattgattttacatctaatttttcttcaaatcatataattttccacttctatggctgaaccactggaattattatttttgcttactccttacaacctgagctggagcttcttttttgaaacacacctcacaaagatatcaagactttcaatcactagtgaattcgcggccgcctgcaggtcgaccatatgggagagctcccaacgcgttggatgcat

SEQ ID NO: 20912 - DNA, 385 bp, Homo sapiens
cgcgggaaaaaagatgagaaaaatgcagacttctgaagaggtcatgttgtgttcacttatccttggcatctagggcaataaatgatggtgctcaataaatgtatttggaataaaattagattctggaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttccaatcactagtgaattcgcggccgcctgcaggtcgaccatatgggagagctcccaacgcgttggatgcat

SEQ ID NO: 20913 - DNA, 625 bp, Homo sapiens
cccgacgtcgcatgctcccggccgccatggcggccgcgggaattcgattagcccccaacttcacactgttttcaaaggtagtcccaatggagtggaagaggcctttttttaaatcctttttgctattcatcaggtagaagcagtggtgctcatgcatgctcttttcttttgttgtttcaccaggaatcgttacatgggacgaaatagatttcatgacaaaaatgaatatgcaaaatgtccactgacattgcaaaggaagcaaagaacttccaggtcttggaggtggagccaagatggccgaataggaacagctccagtctacagctcccagctgtgagccaggcagaagacgggtgattcctgcatttccaactgaggtaccgggttcatctcactggtgggtgttggaaagtgggtacaggacagtgggtgcagcgcaccgagcatgagccgaagcagggcgaggcctcgcctcacccgggaagcgcaaggggtaagggaattccctttcctagtcaaagaaaggggtgacagaaggcacctgaaaaatcgggtcactcccaccctaatactgcgcttttccaatggtcttagcaaacggcacaccagaagattatatcccgcg

SEQ ID NO: 20914 - DNA, 909 bp, Homo sapiens
cgcgggtgggaccgtggagcaacgattattcgcgggtgggaccgtggagcaacgattattcgcgggatataatcttctggtgtgccgtttgctaagaccattggaaaagcgcagtattagggtgggagtgacccgatttttcaggtgccttctgtcacccctttctttgactaggagggggaattcccttaccccttgcgcttcccgggtgaggcgaggcctcgccctgcttcggctcatgctcggtgggctgcacccactgtcctgcacccactttccaacactcaccagtgagatgaacccggtacctcagttggaaatgcaggaatcacccgtcttctgcctggctcacagctgggagctgtagactggagctgttcctattcggccatcttggctccacctccaagacctggaagttctttgcttcctttgcaatgtcagtggacattttgcatattcatttttgtcatgaaatctatttcgtcccatgtaacgattcctggtgaaacaacaaaagaaaagagcatgcatgagcaccactgcttctacctgatgaatagcaaaaaggatttaaaaaaaggcctcttccactccattgggactacctttgaaaacagtgtgaagttgggggctgacatttctttgttagcacacaggagtacaatatctccagaaagccttggccacacaagtaggaaggaaatttgccattctatgcaagtccttaaaagttaaaagtacttggttatgacttgtttatacgtgggacatttgcctttttgtgcctggatcttgcaactcaaataggctatatttcacaatagccctgttaattttacaaagatagtttccttatacttacttgaagtgataaattgcttcatcatgaacacaaaaaaaaaaaaa

SEQ ID NO: 20915 - DNA, 1650 bp, Homo sapiens
cgcgggggtggaagtgttggtaggagagactgcagaatttcttgaaatgtgggtctattcagcagataggaaacttgtagttcagaaacagagtaacttctctttctactctagatttactgaatttattaaaactatgcaagcgcactctacaaatttaaattcagtcctgccctatcctaggaaataaaattgtcagtgttcattttgctttaatcattaaccctctcctctgcaatactcctgattcccaccaagagtgtgataattctagtacctatgacccactttggaattattcatacttggaaaaaaataccaaggctccttccccagtaaagagccaccaacgctaattatttcttttgggaaaaccagagttgttgaaaagtgtcatgatgtatccaaggaatagcatgctaccagaaaatacccatatttgcaaaacttgacatcgaacacctattttctcttgtgctacctaaagttttcaaactaccattttatagtttttatagcatttcaaagcatgacaaaagctcctgtttcttttgaatgtttatatccacggtattaacttgtgtcatttaaaaaaaatcaaaattttggtaataagacaaaggccaaagaaaaatcacaattggcaatttctgccccagtatgactacaaatgatagactatgacgttaagaatttctgctgaatagaacccattcttcataatgaaaataggtgatcaaacaacagatgcacacataaagtctatagattcttaccaccaatggtatagcagattgtgatcctgaacaagtgtaaaggcagaattagggtaaggattataatccatgaagagggaaggagcagtttttaaatggatggcagatggaaataagaaagctttagtcagttctcagaaaattaaaaaaccctaaggcataaaaagcaagctttaaaaaatcccaaaagcacagatgtctttaacaaaagcagtacatttagttgtttttaaagctaatcaactgaaatcagacactcatgtacaaagcagatgaaatgagactgcaacagtaaatgtaaattcttcagcttttctactactgacagtcgaaaatcaaaatcattaaatgttttcattaaacatttaatttaaaactactcataaggaacaactacaatattgtacagctgaagaaaaattacatgaaaaagctacaaatgtcatctttcttaagatgcaccaagaaaaacaaaagatgggaggagaggagacaaagtttctgacgggctgtacaatcatttgtatacaaccagccactaccaacagaaaaagagacacaattttgtcataaatatagatctagtgctctctccattgagtccccatttatttatttattttggttagccatcagaacacacctgctttgatctgagagactttttttttctaagtagtgatacaaagatatggtaagaccatgcaagccctaatgaattactttatgacaaagtaaggatgatgatcacagtaatatttctgtgcaaatatattgtaaagaaacttgcatacaaattacataataccttttttacaaaagaattcggaatggaacatatagtcattcgaaataaataaaccccgatcggcag

SEQ ID NO: 20916 - DNA, 1224 bp, Homo sapiens
atgctattagatgtgtttacaggaggaaatagacaggaagagaggtttagctttatcttattttctttatttatgaaaaaaaaaagaaaaagaaaaccttaaggagacatggcaaaatgttaagatgtgttaaatctgggtagtgggtacctgagtgttttttttttttaattttgtatatatttgtaattgttcataattacatgtttttgaagaaataaaaatatgatcaccactttcattatttttaatacactattgtagttctttttcctggtgattaaaatgcatgggctttctcctttctgcatattattttttttaggtatcctttctacacattttttataaaatcctagaataggaaggagatgtagagaacatttgttcaaatctactgcttgacaaaggcacttctgaattcaagttggtgttccaggtaaaaacccttgctagaattttcctttatgcttaataatctggaagatatggttttggttaactattttgtttcaactaagtcaatgtccatggataatgagttttttttttaatgcagaccataatcagttacacctaacattgatactatgctgaaaacacagttttatctgtaatgacacagtgactgcgaagaatctcagtgttatcatcatagtcttcagttattattttggttatatgtgaaagcaccaattgaaagagagctgattggcaaaatgtcagataacctggagtaaggagaatacaggaagaggtgagaattaccctttattgaggtattgtaggtgtgaaagttgtcagaatcagaatggagtcagtcatgttaaaaaaccaacacacaaacaaaaaaccctaacatatatagctggagaaggctatgaagagagggttctcatgctcgtatgcccaaaaataaaaccaccacaaaagactctgcaaaaaccacaactttgtgcaaaagccaccataaccttacacaaaaaatacttctgcaaggacatctgcccagcaactgcctgtcaacctcagacaggcgccaccttgttattgatttttgtagccaaggataattgcctcaaaacaattctgtaatagtcctcctcatttcttctttaaaaacccttgtctccctttacttcccttaatacgcatataatttactatggcacgtgtattcccattgcaatactcgattccacaaataaacatcgttcggccaag

SEQ ID NO: 20917 - DNA, 788 bp, Homo sapiens
taaatgatggcattgaaaaaaagggcttgtgaggactcagcatctacaggaatgaaagtttggattgtccttcaggtaaagaatcccgacaacctgaggtctgcctgagagcaaagccaacatggaatggttatggaagaaggtagtttcaaacaccaacagtgctctgtggccagcttcagttccagggggcctgcagtagggaggcatatttgcctatctttcttcttgctcagtgtgcgtgtatacacacatacatgtacgttcatacatgcatacatgcatatatatgcatgtgtgtaggtgggtcaagacacataaggacttgctcattccttttgcttccagtttctctcaatgttgtcttagcaacagctcttcacttgctagctgcagtttgtttcaatttcattcttccccccacaggaaagaagtggccaaatcacagcctctactgagacaccggcaacccctccctggtgatctgagcctagcactgcgagcctccccctctggcttcctgaggcacaggcaccagctgggaagagctcccttttcaaaggtctgacctcaacgcggtggagccctgccctatctgcctgtggattttaacaacatgctctctttgctttgcccctgaccctgtgaggaagctgcttcctgtatgttctctccgtgggacgtgtatgtctcctttttgtgttttttaggcttccaatacctgcttgactagttccctatattaaattctctgtcaaaaaaaaaaaaaaaaaaaaaaaaaaaaaaaa

SEQ ID NO: 20918 - DNA, 1166 bp, Homo sapiens
  misc_feature (1)...(1166): n = A,T,C or G
cgcgggtgggaccgtggagcaaccgattattctgcgggtaatgaagtataccaaccttgtcacctgggtggcagtgcaggttttttgttttaaacaatgaagctgggctgttggagtactttgtgaatgaacagtctanaaatcanaaacctagaggaactttgcagcttgcaggagctgtaatatcacccagtgatgaggattctcacaccttcactgtaaacgctgccagtggggaacaatataaactcagagctacagatgcaaaagagcgacagcactgggttagcagacttcagatatgtacacagcatcatactgaagctattggaaagaataatcctcctctgaagtcacggagcttctcacttgcatctagtagtaattctcctatatcgcagaggagaccaagtcaaaatgccatttctttttttaatgttggacattccaaactgcaatcactgagcaaaagaactaatttacctccagaccatcttgtggaagtcagagaaatgatgtctcatgctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtggtgcttcctacatttatcctagagaagcgttccttgctggaaatgtatgcagactttatgtctcatccagacctatttatagccatcactaataatcactagtgaattcgcggccgcctgcaggtcgaccatatgggagagctcccaacgcgttggatgcat

SEQ ID NO: 20919 - DNA, 1278 bp, Homo sapiens
tttttttttttttttttctttgacagtaaatgtttttaatatttttgctccatttacaatgtttggtttttactaaaatgtgactgtatatcaaagaatctcacagctggcaaggggtttaacaacagatcagactaatgctttcaatttacaaagctgatgcaacctgtgaagtgacttggccaaggtcaccagttagtgaaaaggcttagattaagatgcagagcatctgactctttcctggatagatgcaaggatgacatacctggattcaaatggatcctgcttctccagaggtctcactcttttcttcgtcactgccaatttagtcaagtccacatactttgtctctccattgctatatgtgaactcaagaacactattccattccccttgcactctgcataccacagtgttggtgatgttgtgctttacttcagctgtaacccgatgcagtttgccaccataaaatggcttggtatgaaaagtgatgctggctgaatatccagtgtttgcacagttgacactgactttgccacccagttctacccaaggaacagtcaaaattgaccgagcatatgcacagggtagagaaaatgtgtactcttctccatgctccaacagactaaggataccttctccaaccattgtcacgcctattgacatgcctaagaacttgctcttaatccaaacatgcgcatttacacacatcttcctctctgtacattctgcataaaatcctgagactggaggatgatgagaaacctgctcagcaacaaatctgactgtgtaacagtctgatcccacctgggtcaaagactcccccgataaaggagcatgatttgtgactccccgggtggaagaactgctaaaaacactggatgctacctcgctttttggcatcttccaggaacagtgaaatgtttctccaatgataggattgtatggttttttagcaatggctcccttacggccttcatgaaatgaggtaaggtagtactcaacaaagcgaatcattctgtcctcagctgtggctccattagtgatggctataaataggtctggatgagacataaagtctgcatacatttccagcaaggaacgcttctctaggataaatgtaggaagcaccactcttgttaaatccatgcccagcttaagctgtgacaagagatgtaggatgacactacgttgttcttctacagctcccaggtcatcctctttgtggccacatgtatcctctatctcatcatctgcatttatttcttcaggctccag

SEQ ID NO: 20920 - DNA, 1388 bp, Homo sapiens
  misc_feature (1)...(1388): n = A,T,C or G
taagccgagtagcattctatggtttaaaaggcaggtattccaaagcaatcttgaattgtaacaaggctattaaaatttaccctgaaagcgtacgtgcctatctctacagaggagttctgaaatactacaacaagctattttatatgaaatattttgcaaataataccttaaagcaaagacttataagctagcaattacagatttaactacagctatcagcatggacaaaaatagttatacagcattttataacagagcattatgttacaccaagataagggaacttcaaatggcattaacagattatggaattgtgctgcttcttgatgctacagaaactgtaaaactaaataccttccttaatcgtggactcatctacgtagaactaggccagtatggctttgcactagaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagatttagttttggctataatttgcaggcccaaggaaaattccagaaagcttggaaccactttaccattgccatagatactgatccaaagaactacctagcctatgaaggaagagctgnggcnctgtcttcacatggggaatcatgnangctgaantgcangatatgaatgctgacatgaaggccataaccatgttacatgatatgatcatcaacatacatgagcactgtgtttgattaggtcgcgcgttcgatattgaactttcgatttttatttaatttttgtatatttgttgattgcaccagcaagtacatgtcatagatggctaagaaatagcacgaatatgacctgatattatatgatagatgtaaccaaaaaataaagttaacaaaaataatatatatttttttgtattattatattgaagtatttttttgatcttaaattttataattatatataatttatatttgtagaaataattagaatgcctgtgtagcgtgagaatattcgagttctgtatacaaaccttcttattattataccaaatcgacggtcctgttcctaaaaatagactacctaaatgacaatttgattcgtcttcgatcgctatttctatatattcataaagtattatttttatcaattatagattatattgtttcgttcgacagatagaattgtatgagatatgtaaattacaaataacagaacgatg

SEQ ID NO: 20921 - DNA, 688 bp, Homo sapiens
  misc_feature (1)...(688): n = A,T,C or G
tttttttttttttttttttttcttgaggctgaaattgaagctttttattttggatatacataccactattactgttttaaagacatttttatgtagtgatactttgtattatggactctataaagttctatactgtaatcaagacatttatataaagtgacactttgggattatttggcctcataagctagatgccagtgaaattggcacacacatcaatagacatgtttacacttccagtgttagggtttttgtttattccagttgtacttcctttggcagacggctattatgttttactttagtgccgtattgtggatgccagagaacttgcatttgccagggaataatctcctgagatgctatattatgaagtagaatggtgtagtctaattcaataaagtcatcatttctttgcacttgcttgacagtttgaatttttaccattttataccatgtgtcttcagtagaattttgccatattatataaccacaggcaacccaggctaaatgtagaacgagcgtcatttctggagatacatttccaaaattgtctggaaaattttgtgcttctagcgggttccttcatggnacttaggtctttgataaaatggggtggncttcttcatctgaattctttcccagttcttcttcaaatggagaagttgacttctgggggccattcctg

SEQ ID NO: 20922 - DNA, 706 bp, Homo sapiens
  misc_feature (1)...(706): n = A,T,C or G
tggcactagtttcgagttttttttttcttttttttttagtaacatttatttatgcattcagtatcaagtacataagtgcaaatatccagagtccgtaattgaatccattaggaactacagagaaagtaatacaaattgtaataaagttaacatgctggtactttttagtaaccatacatgtaaatcagcccaccaatcccatacaacaaaagtactgcatgtttgttttggatttattcatttatttaattattttaagttatacaaaactgattaccataagtgcggtcgactgcttttatttttacgttgtgtgtgttggaaaaatgctaaaacatcagtctacaattctatatattgttattaaagattaatccaaccagcaacccaaggacatataagcgatttccactattgcatcagagcactcggcaggaaaggcctagccacggggaacattagaagctacagaagcattgcagagaagagaagaagaacaccgaagagggaaagataacttgggctctcaccatcatgcactttttttagcaacacaaaattaaaaaccacatctaatacacttttccctatactttaanngggttgacacaagtgactcaaatatcctaagagtacaagaaacagcctaaaacagctgttttaaagggttggctctagaaaatgggactggagggaggggggaaag

SEQ ID NO: 20923 - DNA, 738 bp, Homo sapiens
  misc_feature (1)...(738): n = A,T,C or G
tcaagtacagtcctgattgcatcataattgtggtttccaacccagtggacattcttacgtatgttacctggaaactaagtggattacccaaacaccgcatgattggaagtggatgtaatctggattctgctggatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcctaagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccgggggattaaccagcgttatcaaccagaagctaaaggatgatgaggttgctcagcttccagaaaagtgcagataccctgtgggacatccagaaaggacctaaaagacctgggactagtgagctcttaggctggtaaaaaatttaaaaactaccaatggggattaaactccgaggcctttagttttcattcccatgtacatggaancncagttggntttg

SEQ ID NO: 20924 - DNA, 700 bp, Homo sapiens
gcgggtcattgtggaattccagaactgattgtgaatggtcaagtcattggagaaaattatggatatagagacacagttgtatatcaatgtaatcctggttttcgattgattggttcttcagtgaggataagtcaacaggatcacaattggtctggtcagctcccatcctgtgtgcctgttagctgtgggcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaaccttttaccagaatgtatcatgattgactgtggacaccctggcgttcctcctaatgcagtcctgtctggcgagaagtatacttttgggtctactgttcactattcctgcacaggaagagcgttcccttttaggccagtcatcaagaacctgccaataatcgttgctccacggtcccaaccgcga

SEQ ID NO: 20925 - DNA, 575 bp, Homo sapiens
cccgacgtcgcatgctcccggccgccatggcggccgcgggaattcgatttcgagttttttttttttttttttttttctttttttttttttttttttttataactgaagctttatctggagtgggggaatgggggtgtggtcagttggggcacccaaatacaaccatgctctcggtgaaggcgccgaggtcctggcattgtttctggttctcttcgtcttggcattcgtcctcctcaggccagtgctccacccaagtgtccttcccgatgatgtagctgaggttgggcttctctccccagaaatcggaggagagaccccacatgaggtagtgtttcttctcctccagcttcagggcttctctgcacttgatggggctgatgaacgtgcgctgctgtccaacctgcacctcatccgagcctgacttgatggtctgctcaatggccatgatgtactcgtcaaagtcattggacagctgaaccttgaccagtcgggtcttgtacacatagtccactcctggctcacaggccttgtccagccgttcttccagggtgaccttgtcatccgacttttgtgtt

SEQ ID NO: 20926 - DNA, 545 bp, Homo sapiens
catggaaatagaagaatttttccagcgctctgataaggatggtgttgttgtgttttctctggagtcagttgtgaaaaaccttacagaagaaaaggtttatcttatcacttccgccctggctcagattccacaaaaagtcagtagaacctccaatccttataagaagctattcacacaatagagaaagttttatagagattcaaaggaaagaaaccagctacactgggaaccaatactcagctctacgtttggatatgccagagcgatcttcatgataagattatgacgtagtaaaaatgaggaatttcataagggaaaaattgaataactgtttaacacccaataaatttaacaaaaatttaaaatttatagtttgttattttacctttaattttaaagtgtatataattgagtaattggtggtcattatattgtttgattcttacttttatttttaaaggaagtttcatgcaatgcagaaataaattaatgcctcttttccttaagagaagaaaaaaaaaaatggcctcgttggcctcaagcgg

SEQ ID NO: 20927 - DNA, 1460 bp, Homo sapiens
cgctgggatcttagattaaatgttagctctagaaaggtttttgctttaaacaaattaagtatattaaaatctgtatttaaacaaaaagataaatgagcaggcagttattcattttactttagaaatatctgatgtaggaaatgcattttaaaagctaacttccataaccatcttttatattagttaaattaatacagattaatcaatatcatattcatatcatattcatgaaaatgtgaatgtgtagaccctgcccttaaaaacgagcatacaggtgtaaagagatatgctctgaattatttgttttatgaagacatatgtatcatttccccaaaactaaagctgccacaggatggtgtgttataaaccattatggagcattttatttcacaaaggattaaaccatggaaaaatcccaaggctgtaaaaagatttatgctaattaggcactgaatttattagtatagtctctgtttttccctttatgagccgatttcaaagtcactgataggctttctcatgacttacatggtaagcagccacttctctatttttcatacacctattttctctttcttgcagtagacagtagagcagtgaaaaggacactgaaccagaactcatataacaacgatcctctaccttactatccatgaaggaggcaggtgactgatctcggaatcatgaccagaagcaactgtgccttgctctctttgttgcaatgtaaagataataataccacaatgttggtgggacataactgttattatgttgttcagcctgcaaagaaacaatcaatccccaaaagtcctaaagattaaatgttagctctagaaaggcttttgctttaaacaaatgaagtatattaaaatctgtatttaaacaaaaagataaatgagcaggtagttattcactttactttagaaatatctgatgtaggaaatgcattttaaaagctaacttccataaaatgttcagagtacaatttaattggcaaatattgaattcaaatgcacctatagcaaggtctgacatacaactgcattttaaaacccactgaggggctttgcatgcaatttaggctaatttgataaaggaatagtacatcaaattggacttgattgttctgaatcaactgtcggtcagtgtcatttacatgaagttggtcaaataaaaaccaaaactatctttggcttggaaagagtgagaacttcccactgctgcttaaattggaaattaaccagttggtcagcaaaatggtctcattcttgagcttgacttccatgatgagaatgaaatgtgtctcttggttctgaacccttgctttggtagctagctacacagcgaaatatgccaagtgcacactggagtgtttctgtctcttagcaccatgaatcaaagccctttctgtaaaatgctcttggaaaataaacggtggagcttcaaaaaaaaaaaaaaaa

SEQ ID NO: 20928 - DNA, 1257 bp, Homo sapiens
  misc_feature (1)...(1257): n = A,T,C or G
ttactgggttctagtttgaacgccagatttttgccagacaaggaggacgtagactttatcaacgagtacgtgaacctccacaatgagctgcggggcgacgtcattcccgagggtctaacttgcgcttcatgacttgggatgtagctttatcacggactgctagagcacggggaaaaaaatgtttgtttacgcataatatttatttacaagatgtacaaatggtccatcctaaatttcatggtattggtgaaaatatgtgggtcggacctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaagattggacatattatacatgcagcaattttcatatgcaactatgcgccaggaggaacactgacgagaagaccttatgaaccaggaatattttgtactcgatgtggcagacgtgacaaatgcacagattttctatgcagtaatgcagatcgtgaccaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatttacccctgaggaatctgaagcagggaatgaagaggaggaaaaagaggaagagaagaaagagaaagaggaaatggaaatggaaataatggaaatggaggaggaaaaagaagagagagaggaagaggaggaggaaacacaaaaagaaaagatggaggaagaggaaaaataagagtagaaagaggaggaaaaagatgtatcaccaatataaaccaaaagtgtaatacaaaaaaaagacagaaaaaaaaaaaagtaaaacactgagttttaacaagaaagaaaatatgcaaaccaccattggaatgttttttattcccttctctcctatacttattcaatcaatttaaattttgtaaaacaaagaaacaaaaaaacttgtaagggtgggctctttgacnctaagaacagattaaagacnttgacngggaaaaacactgaaaaaccatttgaccagtctaattaatcttaagatttcnaccatgttattctaataaagt

SEQ ID NO: 20929 - DNA, 891 bp, Homo sapiens
cccgacgtcgcatgctcccggccgccatggcggccgcgggaattcgattggagaaagccattgtctgttcaaatccagtggccacagtgaaagcgggagaacgacaatggtgtgatgtgggaatttttaaaaataatacagctttggtgagccagttttatttgctgccaaaagggaagcaaagcatctcaaaggtaggaaatgcagatgtacctgactacagcttgcttaagaaacaagatcttgttccaggcacaggatacagattcagggttgctgcaatcaatggttgtgggataggtcctttcagcaaaatcagtgaatttaaaacttgtattcctggttttcctggagctccttctgcagtcagaatttcaaagaatgttgaaggtatccacctttcctgggaacctccaacctcaccttctggaaatattttggaatattcagcctacggctatccgcacagcacagatacaagataatccaagtcaacttgtgttcatgaggaattatttgtggtcttaagacatcatgtatagtaactgctgggcaacttgcaaatgcacatattgattatacatccaggcctgccattgtgttcaggatatcagcaaagaatgaaaagggatatggaccagctacacaagttcggtggcttcaaggtaacaataagaaagcacctttaaattgaattggtttttttactgaagctattgtgatgatgattatttattagtaactggttatgaagatttgtcatttaaaagagtattctctggctgtatttccagcagttatgaacttgagtttgtaaattgttcttaaaatgtatttgctgaattatagatccaaataaaagaaaagaagcaaaaaaaaaaaaaaaaaaaa

SEQ ID NO: 20930 - DNA, 1213 bp, Homo sapiens
tccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcccagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaggagaaagtttttagagcgaaatagagcagcagctcaaagatgcgacaaaaaaaaggaaagtctgggttcagtctttagagaagaaagctgaagacctgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcggtcctcacccagatggcggaccagagtacagagcctgctctttcacagatcgttatggctccttcctcccagtcacagccctcaggaagttgattaaaaacctgcagtacaacagtcttagatactcattagtgacttcaaagggaaatcaaggaaagaccagtttccatttatgcgaaatctgtggttgtaaatttttttttttttacttgaaattaaatttggctctaaagttggtgtagcagaaataaaaaaaaaaaaa

SEQ ID NO: 20931 - DNA, 1080 bp, Homo sapiens
  misc_feature (1)...(1080): n = A,T,C or G
tacagctgttgcaggcagagcatctgggaagcgctactataccctcacctttgctgtcaccttcccacacagtgaggatgtctgctacctggcctaccactatccctatacctacacagccctcatgactcatcttgatatcctggaaaagagtgtcaacctcaaagaggtctacttccggcaagatgttctctgccagacgctgggagggaatccgtgtcccttggtgaccatcacggccatgcctgagtccaacagtgatgagcatctagagcagttccgacatcgtccatatcaggtgatcaccgctcgagttcatccaggagagagcaatgccagttgggtgatgaagggtaccttggagttcctggtcagcagtgaccctgtggctaggctcttgagggaaaacttcatcttcaagatcatacccatgctcaacccagatggtgtcatcaacggcaaccacagatgctcactgagcggggaagatttgaacagacaatggctttctcccagtgctcatctgcagccaaccatttaccatgccaaaggcctcctctaccacctgagcagcattggccgaagtcccgtggttttctgtgacttccatggccactcccaaaagaagaatgtgttcctttatggctgtagcatcaaggaaaccttgtggcaagcagcatgcactgtgggcacatctactatcctagaggaggtcaactacaggactcttcccaaaatccttgataggctagcaccagcattcacaatgagcagctgcagctttctcgtggagaaatctcgagcttccaccgccccggttggtggtggtggagagagatggggcgcgttcataagctaccccttggaaagganttattgtggctgcaaccagggcccttatnnnggctacagtttgggtccacaaactgggggaaatggggccatgttcttgtggcctcctctcctggactcaatttggcattgtaaccataagttctggttcagctgaactttctgagtgtgagagaggctctgggccacgctccacggtaaatgtcccaggcttatgaaatcggactt

SEQ ID NO: 20932 - DNA, 1299 bp, Homo sapiens
ctaaaaatatgaaactccaaacatgccattattggaaatgagggatatttagaagtaatcttagaaatttgactactcacaatacttactaccagtgtatttcagccactaaactttgtttacggttatataatagggactgtctacatttattcattgtggagcctattatataacagtagctgagaaaagatttgctgaaaataataatgtcaaagtgtgatcatagatattatataaaaggagcacagataaaggtgtaaattaataaatgaaaaatactaattttttattttattttagttattatgaagatttgtaactcatattgacgtagaattgagaaaatgctcaatttcaccgatgtgacagagttcattcttttggggctaacgagccgtcgggaatggcaagttctcttcttcatcgtttttcttgtggtctacattatcaccgtggtgggcaatatcggcatgatgttgttaatcaaggtcagtcctcagcttaacagccccatgtactttttcctcagtcacttgtcatttgttgatgtgtggttttcttccaatgtcacccctaaaatgttggaaaatctgttatcagataaaaaaaaacaatttcttatgctggctgtttagcacagtgtttcttcttcattgctcttgtccatgtggaaatttttattcttgctgcgattgcctttgatagatacacagtgattggaaatcctttgctttatggcagcaaaatgtcaagggatgtctgtattcgactgattactttcccttacatttatggttttctgacgagtctgacagcaacattatggacttatggcttgtacttctgtggaaaaattgagatcaaccatttctactgtgcagatccacctctcatcaaaatggcctgtgccgggacctttgtaaaagaatatacaatgctcatacttgccggcatcaacttcacatattccctgactgtaattatcatctcttacttattcatcctcattgccattctgcgaatgcgctcagcagaaggaaggcagaaggccttttccacatgtgggtcccatctgacagctgtcatcatattctatggtactctgatcttcatgtatctcagacgtcccacagaggagtctgtggagcaggggaagatggtggctgtgttctataccacagtgatccccatgttgaatcccatgatctacagtctgaggaacaaggatgtgaaaaaggccatgatgaaagtgatcagcagatcatgttaaacaaaataaaatccgatgctggccag

SEQ ID NO: 20933 - DNA, 724 bp, Homo sapiens
cgcgggtgggaccgtggagcaacgattattcgcgggcggagcagcgggcggcggcgccgtacctcgggctgcgggagcgcgggcgccctggggtcctcggaccctgcctgaggctcacagtacaagtcagtcaaattgttcagggcagcagtggtgtctggagacctggtttgagttcctaggttcatacctagcgtccttctgagcctcaagtttcttcatctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaaggttcagctaaaaaga

SEQ ID NO: 20934 - DNA, 757 bp, Homo sapiens
cgcggggggcgtacatgtggtacagccagggagatcagaacgctcacagaacaggcagtgcaattccatgttcctcttaagtatgttagccctaccgggagctgagctggccagtctacttggagaggaaaagtagatctggggaaggtggaagggtcagttcctaagtgacttcctcctcggggatggtaagggcatttgctgatctccagtgactgcctggtgcctcatggtcagactcggctgtctcactcccagatatctgattttgcaaaaagggacacacctatctgcagcaaagaagacactgaccagattgcgagcggtgcttttggatgctctgtagccacccggggcccaggaggactgactcggcagcaggattcgtgcatgggaatcggagaccatggcagtgcagctggtgcccgactcagctctcggcctgctgatgatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttaatcactagtgaattcgcggccgcctgcaggtcgaccatatgggagagctcccaacgcgttggatgcat

SEQ ID NO: 20935 - DNA, 567 bp, Homo sapiens
atgcatccaacgcgttgggagctctcccatatggtcgacctgcaggcggccgcgaattcactagtgattaaccacgggtcctgactttttagggaagtcatgttccaatactcttcgatctagctgaagccagtttaagtgtcccgtttcatctgtgaatgctattccaaagtactccttttccttcagattgaagtgagaagccacaaggccaagaagctccttggccaacagcttgggctgtactaggagttccagcttcctgtcatcaagaagatgtacttgacatcggcggccctccgtcatcttcgtcctcatcggagacaggagcccttccatggtggcagaatcctcatgccagtttctgtctcctgcaagttactctctctgtgtgccgtgcttaagcatcccacgtgaaaagagccatgtcgggagccgtggtggctcccctctcccggccccgcgaataatcgttgcccacggtcccacccgcgaataatcgttgctccacgttcccaaatcgaattcccgcggccgccatggcggccgggagcatgcgacgtcggg

SEQ ID NO: 20936 - DNA, 1117 bp, Homo sapiens
cgcgggagagggagaaagagagaggggaccagggcgaggagaggagcaggcttctccaggaacggcgctttgcaggcgctggggattcaagttagaccgggtggcggtgcagaggcgccacccgggagaggggagccaccacggctcccgacatggctcttttcatgtgggatgcttaagcacggcacacagagagagtaacttgcaggagacagaaactggcatgaggattctgccaccatggaagggctcctgtctccgatgaggacgaagggtttctacttcccattagtggcagccctgccttgtgatcaagtttgacgccgacggtgtttcctgagctggggagtttgcagatctgatctgtcagcggggactgagagcaaatcgggacattcatcatgactttggctgccaagctggaagactttgagctgacactggagcacctgctcatggatgtgtttatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaagatggagtctcactctgtagcccaggctgtagtgtaatggcataatctcggctcactgcaacctctgcctcctgggttcaagcgattctctgcctcggcctgggtgagcaggtggaattacaggcaccagccaccacacctggctaatttttgtatttttagtagagatggggtttcaccgtgttagtcaggccggtctcgaacgcctgacctcatgatccacccaccttggcctcccaaagggctgagattacaggcatgagccaccacacccagccaattctttttttaaataaataaataaagagcggg

SEQ ID NO: 20937 - DNA, 593 bp, Homo sapiens
attgagaacaaggcccgcgactctgctgagggttaaagaggaatcggaaagggcccggggtagacgtgggcaccacaggatcttatgcccaagagaaggacatactcttgggtgtctggacaaggaaaacatgcttgaaaaatcaacgattcttcttagatccctcaggcaagtgaagtcatggagcaaaccacgaccccataattggagagacagagtaatactaaaaatcacaagttacagcctcagaaacccacaggatatgcattgaggactcttcatctaatagccctgacccacgcagaacctgctcccaagaatcaagctcaggctttttggccactcaggttccaagaaaagcagccttatggactctctcaagtgtgggctgctaaggagctttctcaaaagcctttggtgacaagctgaagaacccactccaagttgtcctgctggcttccatgcggacatcatgaatgttcctgaaccagctggaggcgagtttggatatgacagagatacataatcactagtgaattcgcggccgcctgcaggtcgaccatatgggagagctcccaacgcgttggatgcat

SEQ ID NO: 20938 - DNA, 517 bp, Homo sapiens
cgcggggacaactttgagtccgtgacctggctttccgatagcgaggtggtgcgggcgcccagccccggctggagggccagacagttccgggtacaggcggtgcagcccaccctcatcctgcaggatggggatgtgatcaaccttgtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgttgaaaggctttttcgattggcttctaactatatttcaaatgctgggatatgtcacaaagtttctacaatcactagtgaattcgcggccgcctgcaggtcgaccatatgggagagctcccaacgcgttggatgcat

SEQ ID NO: 20939 - DNA, 563 bp, Homo sapiens
cctggggatgcgatcaaccttggtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgctgaaaggctttttcgattggcttctaactatatttcaaaagctgggatatgtcacaaagtttctacttttgccatgcgatctcttgcaagtttagctctacgtgtaacaaattctaggacctcgccctagtatctatactgataatatattttgattaattatatacattaattcattctgtgctatttaactgattaatagtgagcatttcatgaagtgcttttataccactattatatatcagagaaagattgagaatgaataagccaaaaagaaaaaaaaaaatggcctcgttggcctca

SEQ ID NO: 20940 - DNA, 480 bp, Homo sapiens
ctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcggcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaaaggggcctgggtttgattcatctgttttctacagggtttaagtctcaggaggtctcaataaacttggtatataaatgtcaaaaaaaaaaaaaaaaaaaaa

SEQ ID NO: 20941 - DNA, 1831 bp, Homo sapiens
  misc_feature (1)...(1831): n = A,T,C or G
accacaggcgcccatcaccacgcctggctaattttttgtatttttagtacagacggggtttcatcatgttagccaggatggtctcgatctcctgaccttgtgatccatccgcctcggccttctaaagtgttgggatcacaggcatgagccactgcgcccggccaagtttgggaaattagaagcctgaccatgtggtagaaaagaaaagcccattttctggggaggaatccaaacaggctgcataaattgcataactaaaaggaagataaatgctaatatccaagacaatagggagaaagcctcaaagacattttaaagaccttccctgtaacccctcccatcacaggcccagaagtctaggaaaattaaacggtttcctgggccagacccaggggcccagctgccatcctttgagacactgctttccacatcccagtcactccagctccacttgtgactcaaaggaacccaagtacagcttagggctactgcttcaaagggtgtaaaccataagccttggtggctttcatctggggttacgcctgctggtgcacaaaatgaaaaagttgaagcttggaaaccttccccttagtttcagagaagcatggaaatagcctggatgcccagacagaaacttgctgcttttcttgggaatcctttcctcagtgcagagagaaaatgtgagggtagaaaccccccccagagtccccactggggcactatctagtggagcttcagatcagtaccatcatcctccagaccccagattggtagatccaccaataacttgcaccctcagtctagaagagccacagacacacaacaccagaccttgagagcaactctggagcctgaaccctgcaaagccacaggggtggagctgcccaaggccttgggagcctaccttttgcaccaatatgccctggatgtgagaaatggagtcaaaggagtttctcctgagacgtattttttaaattcaagaagacagaagttcacagcttctatgaatgtggaagtgggtcctcaccagacactgtatctgctggcatcttgatcttggacctcccagcctgcagaatgacttgttcagtctgttaggaatcgactatatgtaatatgtgagaaacagcttgcagaaacactagattcacagatggaggagaaatgccaactcactaacaagtttagtgctgccaaaaaggagttagatgcttacaaaaaggtgaagatagagcccaacgcaaagctgatggaggcgttccctgccctggttcaagaattgaaagaagagaggttcaaactgtcccaacaacaagggaggctggcagagatgctaacaatgctgtagtccttagaagaggccatgagagtcacacctgcacaaagagctctgccaaacctgccaggaagacaagatccaagccctctgctcacttccccaggagtgggcctgggtcttaaagcagcactgttccctcccctccattcaagcctcccaagctgcccagctgcattctcccacctggactccatcagagggtcgctgaggcaagtggatccagggaagcctctctctgagctggagtttctctgccctacatgctgacccgtggtcaactccttcatggttgattcctcaaatgtaaagatacaggagatcctggacacactanggaatgtgagactttctctctcttatagaaagattagattctctctcattagcagtgaaagaatgctgtattgagagcctattttttactcaattggatatcatcacactgattcttagaacatggcctataatgttttattttttataagggacagt

SEQ ID NO: 20942 - DNA, 503 bp, Homo sapiens
cgcgggttgggaccgtggagcaacgattattcgcgggtggcgaccgtggagcaacgattattcgcgggtgggacctggagcaacgattattcgcggggccctgaagtgaaaggagaaccaaggcaactattccagcagatccaccctatgaactggaagagctcctgttggctgaatacatttgcacaccccatgttcaccagctccaatctttcccactgctcaatgccaatcaatgcctacttagaaaaagctactttcccactcctcatggtctgccaaggaaagaaactgttactggatcaaggagcttcagagaattggaaaaggtgaggacacagcgttcctcccctctggaggatgaagaaataaggtgccatcttggaagcagagaacagcccttgccagacaacagaagctgccagtgccttgttttttgacctcccaggatccagaactgtgagaaataaagatctattctttataaattaaaaaaaaaaaaa

SEQ ID NO: 20943 - DNA, 560 bp, Homo sapiens
cccgacgtcgcatgctcccggccgccatggcggccgcgggaattcgattcacttactaggatcctggagcagctgggctgcgatggagacccggcgccgctcacccgtggaaatgccccccaagctgtagttgccaatcagtcggtctgccacatggctcagactcagctctgccatgacggcctccacctgcaggagacacaaattacaggaaggctgggagtctctgtggctgctatttcaattcatgggctggggaggacatgaaagaggcagcacaccgcccaagaatccaagggccacttccagactcaccacaccctggggaaagcatgtctttgataataatatgatccaattcggcttaaatcgtaatacatatgtcagatttaaataaataatatgaattttttaaaacgtccccagaggctgggtgcagtggctcatgcctgtaatcccaacactttggaaggctgaggaaggaaaattgcttgaggcccggaaggttgagaccagcttgggcaacaaagaaagaccctgtctctacaaaaaaaaaaaaa

SEQ ID NO: 20944 - DNA, 1809 bp, Homo sapiens
ccggggacactccaaagttcaaaagtctgttctgtagcactgagacacatgcagcaagagaagtagaagcaaaccagacaggtatgacaacctgaaaaccaagtaaagattttccagcagagaaggagtgagaaactatgacaaacgctgcaggtagatctaatcagaagagaacttcatcattcggtttaatcatgtgagatcgttgcaacttgaatgaagtagaggtagcaagagctcaagtggaacaatcttatattgttctatatttactcagaaataacactgtttactaacattgatgtttattaatgctaatattgagagttgagtgtgaactgagtgtttttcctaggtcccaagaggaagatcatacaaatacaaatcatgtacacttgaattttaacttatttacctacaaaatgacttaggttaatgagaagtcagtcggtcaagaattgtctttacagtgtaagacagatgtatgctagatatattttgctctacccatttcaatagaacatttgtagttctatgtgaagagaatcctgaagagagtaggtagattttcaagtcatcataagaaatactgtagtatacataaattacatttaaaactggtgtttcaattattgttattattgtgtttattatagaatatgtgtaaaatatagtaaatactgtgtacttcgtaatttcatcattgtatatcattcttctgtacacattttccccaaaacattgtatctattctcttttccctttatacttttcttagtattttcttaggcctatatataatattatgagatatgaatttataatgctttcataatgtttcaatgcatagaaactagaggaaaaatactttattctttttaaactatatttaaaagagggatgcccagtattttaaagacaaacaagtgatacttaaaaatagaaatgtacacatttagcaaaagagaaaattgacaaaaggaagaggatcaaagtatgagaaaaatagcaattataagtacatcttttcttcacttgaacagtcattcctaaaggaaaaacataattaaacaacttaagaaatttagaattgaatacataattgcaaagcctgattgttgcaaaatgaagactttctaaaacaaacaattagattgttggttctagacttcacgaaacactgcaaatgtgatcttatgtaacataattctacatattcatgacagtaatgcaaactgagctcattttctttccccataggtgagattccttacagccatgcagaggagcaatcatacagtgactgagtttatactgctgggcttcaccacagacccaggaatgcagctgggcctcttcgtggtgttcctgggcgtgtactctctcactgtggtaggaaatagcaccctcatcgtgttgatctgtaatgactcctgcctccacacacccatgtattttgtcgttggaaatctgtcgtttctggatctctggtattcttctgtctacaccccaaagatcctagtgacctgcatctctgaagacaaaagcatctcctttgctggctgcctgtgtcagttcttcttctctgcagggctggcctatagtgagtgctacctgctggctgccgtggcttatgaccgctacgtggccatctccaagcccctgctttatgctcaggccatgtccataaagctgtgtgcattgctggtaccagtctcatattgtggtggctttattaactcttcaatcatcaccaagaaaacgttttcctttaacttctgccgtgaaaacatcattgatgacttgttt

SEQ ID NO: 20945 - DNA, 439 bp, Homo sapiens; identical to SEQ ID NO: 3735

SEQ ID NO: 20946 - DNA, 561 bp, Homo sapiens
cccgacgtcgcatgctcccggccgccatggcggccgcgggaattcgattgcagaagagggttgttatccagagatgaggaagctgcctgtgggctagaacccaggagcctccatgcacagatgagctgctgctgctgctgctgctgctgctgctgctgctgttggagctgtattgctgcagttcaccaggaacccagaagccaaaactgcgctgatgtgctggaacctgcggtgtgtgtagttgcctgcattcttccatagttgttcactgctcctgctgctgctgctccccaagacagagcagtaacaggaaaaaagtggtgttatccttccacttgccaaccaatctccagcctttgaaaacctaactgtggaagccagctggcaaaggagtctgggaaatgtagtgcgcaggctttcagttctgctgatacggaggagaatgtagaagggcgcgtttgaccaaatgaatgctgtaattgcttgggtgatgcatttctcataacggagatgggcagagaaggcattattttacactgataacattcagagaggcccgcg

SEQ ID NO: 20947 - DNA, 1658 bp, Homo sapiens
cgcgggtgggtgatgctgtaattatacccatgtgatttcagtgacaagactcaggtacaattagaatgggaggattctgagagcacagaatagaaatggacttattgaaggaggaagacagttacagcctaactcacaatttgttatcagaatgtagtacagtataagagttgtgctggggagaggtgtggtaagtgaggatagttaatcaaagtttgcaatggcacattgagtagtggtaagactgtactgcttagtgactttggacactgtagttcaaagtctttcttgctatagttggaagaaggaatttctggttatcaatgaatggagaatgtacatggcacttgaggttcactttgtgcaaaccagtacctattatctcgtctctaactctccctctccctctcctaggcagaaagcaatggctgctaaagagtataaaatgctctcctcctgtcagccatcatgtctggggacaacagctccagcctgaccccaggattctttatcttgaatggcgttcctgggctggaagccacacacatctggatctccctgccattctgctttatgtacatcattgctgtcgtggggaactgtgggctcatctgcctcatcagccatgaggaggccctgcaccggcccatgtactacttcctggccctgctctccttcactgatgtcaccttgtgcaccaccatggtacctaatatgctgtgcatattctggttcaacctcaaggagattgactttaatgcctgcctggcccagatgttttttgtccatatgctgacagggatggagtctggggtgctcatgctcatggccctggaccgctatgtggccatctgctaccccttacgctatgccaccatccttaccaaccctgtcatcgccaaggctggtcttgccaccttcttgaggaatgtgatgctcatcatcccattcactctcctcaccaagcggccggccctattggcggggggaaccttcatcccccacacctactttggaccatatcgtcctgtggccaaggtatcctgtgggaatttcaaggtcaatgctatctatggtctgatggtggctctcctgattggggtgtttgataatctgcctgatctctgcatcctaccactatgattttgcaggctgttttgagccctgcgcatcaacaaaagctcgtcacaaaggccttcagcacctgcacatctcacatgtgtgccattgtgatcacctatgttgctgcttttttcacttttttcactcgtcgttttgtaggacacaatatcccaaaccacatacacataatcgtggccaacctttatctgctactgcctcctaccatgaacccaattgtttatggagtcaagaccaagcagattcaggaaggtgtaattaaatttttacttggagacaaggttagttttacctatgacaaatgaaacatagaatagacatattgtttcaggtggtgagaaaataatggagacaaaatttcataaaagatgtgaataaaatggtattaaaatcatgacatgcaatttacccatgtaacaaacttgcacgtgtacctaaaataaaaatagaaataaaaaatcaaaataaagacataaatttgtaagtcaccataatatgtcaaaaaaaaaaaaaaaaaa

SEQ ID NO: 20948 - DNA, 1278 bp, Homo sapiens
attgtgttagagtaatatccacagtgaaaggtgcctatgagctagcattaatctacagataaattaaccatcttctgagggcagaaaagctttttaattgcaatcttcatgtccttatttctaaagctatagatgatagggttgaaaaagggagcaagaactgcaaacatcagtgcaacagctgtgtccaaaatcggtgggaaagtggcagagaaacgcaggtacatgagggatacactgccatagaacatcagaaagacactaagatgggcggcacaggtagaaaaggccttctggcggccttcaacagagggaatcctcaggattacagtgatgattctgatataagaaagggcaataatcaggacagagaatacaatggccacagcatggatcacatcctcaatcagaatcatggacgtgtctgtacaggccaagcgcagcacaggttcaaaatcacagaagatctggtggatttggttgggtccacagaagggcagtgtggaaatccatgcaatctctatcaatggccatggtggtcaacaaaatcccctctgaatttcccagtgaatggaagaagtacatctgcaagaggcagccaaccatggagatggtcctctgcctgctgatgaggatggagagcatcttgggaattgtggcagttgtgtaccagatctccagaaatgagaaaatgctgataaaattatacatggggttgtggagacgggtatccaccctgactgcaaaaaatacaataagattcccaatgacaatgaatatgtagataacaaacaatggaatgaagaagaggaggctaccatctttaaactgtgggaatccagagaagagaaactctgttacttactgtagcagtttggttaatactcaccatggtctcagcaaccttaacagctatggatagaaagacacagctcatttcctagaagaaattgacaaagtcagatgtgttagcttatataaaagtcaaatgaaaaatatgctttaggtggatcatgtacttctctttatttatgaattaaacagatattcatttagtgcctaatatgtaccaaacacagctgtgggtttgttgaattcagcagtaaggaaaaaaatctctacattcatgaagcttacattcaaaagaaggataccaacaataagaaaataagatattaagaatgtcatatttataaactatataaactaaagtaaatgtataagggtgttaataatcttttataataattccgcaaattgttttgaatcatataccag

SEQ ID NO: 20949 - DNA, 229 bp, Homo sapiens
aggggggggtgcagttcttggcccctgccaacatggtgctgcacatggacgacagccactgcctccactgctgcaacacctctgatccccccagtgcccaggagtgctgtgactgccaggacaccacggacgaatgcatccttcgaacaagcaaggttagaatcactagtgaattcgcggccgcctgcaggtcgaccatatgggagagctcccaacgcgttggatgcat

SEQ ID NO: 20950 - DNA, 1446 bp, Homo sapiens
agggggggggttttttttttttttttttttctttctcctcctcagccatccttgtgaggtcactcagcgcgtgaatcaaatcggggggggggatgttaagtgcttccactgcatggggccggcggaggaccagtgtcaaacatgccccatgaacagccttcttctcaacacaacctgtgtgaaggactgcccagagggctattatgccgatgaggacagcaaccggtgagcacactgccacagctcttgcaggacatgtgaagggagacacagcaggcagtgccactcctgccgaccgggctggttccagctaggaaaagagtgcctgctccagtgcagggaaggatattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgtgatcaatgcaaaggaaaaggagcgttgaattgtttatcctgtgtgtggggttaccacctcatgggagggatctgcacctcggactgtcttgtgggggaatacagagtgggagagggagagaagtttaactgtgaaagatgccacgagagctgcatggaatgcaagggaccaggggccaagaactgcaccttgtgccctgccaacctggtgctgcacatggacgacagccactgcctccactgctgcaacacctctgatccccccagtgcccaggagtgctgtgactgccaggacaccacggacgaatgcatccttcgaacaagcaaggttaggcctgtttctgagcatgggggggacagctctgttcatcacctcctccatgatgctggtgcttctgctcggggcagctgtggtagtgtggaagaaatctcgtggccgagtccagccagcagcaaaggccggctatgaaaaactggccgaccccaacaagtcttactcctcctataagagcagctatagagagagcaccagctttgaagaggatcaggtgattgagtacagggatcgggactatgatgaggatgatgatgatgacatcgtctacatgggccaggatggcacagtctaccggaaatttaaatatgggctgctggatgacgatgacatagatgagctggaatatgatgacgagagttactcctactaccaggaaacaggcacttccccaccaacaccaccatgcactttcagggctgcctgtgagcatcaactgtttttgggtttatccccaccccagggtgatgtgggagttgtctatttggctctttacccttgagtcccaccagagatggaagaatgatgaatactttgtctttcttggggggtaaacctaataa

SEQ ID NO: 20951 - DNA, 440 bp, Homo sapiens
  misc_feature (1)...(440): n = A,T,C or G
agggccggccgcttcgttttggccngnctaacattttnctagccgcaattagttgacacaaaaaacactcaagctatgcatccacgcgttgggagctctccctatggtcgacctgcaggcggccgcgaattcactagtgattatccgaacattttattcattccttttccccccgtctttcactgttgaaaaaaagtcttgtgttgtacttttccacaatccttgtgaatcctgaacttccataaaaactgtagcgccctcttccttatgtcactcgttaaaatcccatcgctaatagatctctgggaataggccaggatcaggtgagaatggaggatgcagcgtgtaataaactgtaacagctgacaagtcatagcaacacagtattttcttgaatcgcacctgaaaaaaaaaaaaaaaaaaaactcaaacccccccca

SEQ ID NO: 20952 - DNA, 448 bp, Homo sapiens
  misc_feature (1)...(448): n = A,T,C or G
caggtacagaggagctttgtccttctgcccngcctcaccnttnannctatgctgcgcttnngnnncacnnaaanccttcagtcttgcatccacgctttgggagctctccctatggtcgacctgcaggcggccgcgaattcactagtgattatccgaacattttattcattccttttccccccgtctttcactgttgaaaaaaagtcttgtgttgtacttttccacaatcctcgtgaatcctgaactttcttaaaaactgtagcgccctttttcttatgtcactcgttaaaatcccatcgctaatagatctctgggaataggccaggatcaggtgagaaaggaggatgcagcgtgtaataaactgtaacagccgacaagtcatagtaacacaatattttcttgaatcgcacctgaaaaaaaaaaaaaaaaaaaactcaaacccccccca

SEQ ID NO: 20953 - DNA, 440 bp, Homo sapiens; identical to SEQ ID NO: 4195

SEQ ID NO: 20954 - DNA, 480 bp, Homo sapiens
cccgacgtcgcatgctcccggccgccatggcggccgcgggaattcgattaccgtggagcaacgattattcgcggggtattattttctatgccttttttctacttagttacttatgtatgagttatattcattgaaatgttttcttttttcaggtgcgattcaagaaaatattgtgttactatgacttgtcagctgttacagtttatttcacgctgcatcctccattctcacctgatcctggcctattccagagatctattagcgatgggattttaacgagtgacataaggaagagggcgctacagtttttatggaagttcaggattcacgaggattgtggaaaagtacaacacaagactttttttcaacagtgaaagacggggggaaaaggaatgaataaaatgttcggataatcactagtgaattcgcggccgcctgcaggtcgaccatatgggagagctcccaacgcgttggatgcat

SEQ ID NO: 20955 - DNA, 1940 bp, Homo sapiens
  misc_feature (1)...(1940): n = A,T,C or G
ctgactaccctgtgacttggtaaagtttaaataccattctggtattgaactaccattctggtattgaactatgctcaactctgaaatttcacttttaaaatccattgcagcttcaaaagctatagaggccactctagtcagtctaataggtcgcattaaattctgaaaagccaaggtaaattactaattattgttttacatttaatgtagaggaaacaggttttgaataggcaatgtgtgaatccaaaattacatcttgtaagtgcattggtggtatcgtggtgcacacggctgccttccaaaattacatcttgtagactatatgcataacccatattaaatcactaaatgaccccatttaaagtcatcatgtacagcaaacacttgcttcctttttataggattcacagcatgatttcagagttatttacttttcctacattgttggtcagagtttgtttactttattataggatagggaaaaataaaactgagtttaggaaagattactaatgcaagccaaggaagagtagattgtagataattttgtgttttaattttcactttttctgaataaattagtggaaaatggtcattaaaaatctttgaaaactgtagatgaattaccaagaaaaatggaaagcacccatagaaatccattgtaaatgtctggcattggggtggatgtagatatagacgtaccagttatatgtgaatagagacttaaaatatgtgagtctttctatgggaaatttgggattatgaaaganattcccttagtgtatcnntagtccataacgcagttgnaagttatcaatcaaaatagcgttagaganagtcaaaagtgccatggtgcaagcatcttgattgtcacggaaagagtccacagacaggagagtgaagttagcagatccttaataatactgtagtacttcaaggtgcccaactcaagtaagctaagttgtttagatgttaggatacttgctgattctctttggtgtttaattacattgaggcaatggttacaatgcgatccaggcaaaattctgtaatttttctaatcctctttgaaatgaatgtttttcctcacctttcacccctcctttttgacttcacagagatgatgtcatccaccactaataaagatgcagggaccttagatatgacgttgggattcattcctaatttgtcacaggagctgaaggcaattctgtctgaggggtagctgtcactgagaaaggtactactttcctgacaaaagagaagtgaagctgatgatgccggtaaactatgctgtgaagaatgttgtgacaaagggacttttctgaaagtatgcacaaagtaaagtaagggggagcttctcacctaacctcctatgtattctccatgaaacattcagtgatgtccaattcagtgaccactgattgttagaatgtgagaaatcattattaatgcttacatgtttcacttgctctgtaacaccatagtcttttcactattggacttctatgaaattgatcttttttctgccgaaaaaggctctttctcttttttattgagagtatatggaaatcaattgcttttgaatctcattgactatataatgattttaaaagcttttttactttaacaacctaaatcctcactcccaatacattcctcgttcccgccgaccaccatacactgcgaacgcaccgggccgggagcgcccggcgagcaccttttttggttatgtgtctcccgccatggtgcgttggccgcgagtgtagagcgtttggtgccgatagagggtcagcgaccgcctagcgtcttgagtgccgccactgccacgtcggtagctctcccatcgagaaggctttatggggctgcagtgtagtacatatccagtagaatacgagtttaggcggtgtgagggtcgtaggggtgggtgtgtaggggtg

SEQ ID NO: 20956 - DNA, 451 bp, Homo sapiens
agccggcgtaaagagtgttttagatcaccccctccccaataaagctaaaactcacctgagttgtaaaaaaactccagttgacacaaaatagactacgaaagtggctttaacatatctgaacacacaatagctgagacccaaactgggattagataccccactatgcttatccctaaacctgatcagttaaatcaacaaaactgcgcaccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggaaacaaagtaagcgcaagtacccacccgcgaataatggttgctccacggtcccacccgcgaataatcgttgctccacggtcccaccgcg

SEQ ID NO: 20957 - DNA, 259 bp, Homo sapiens
ggaatatactgccggagcatgatataaaagatacatttaaaaaagtaaatctgagaaaatatggaagctttgacctcaatagtttatattaaacaaagactactaaagtgtggataattgcaaagggcagaaaagcagttataatggccttcatcaatgtttgtcaacaacccatggcaaaacctgttgatgtaataaatgtggcaaagattttgaaaaaaaaaaatttttaaaaaaaaaaatggcctcgttggcctca

SEQ ID NO: 20958 - DNA, 619 bp, Homo sapiens
ctatgcatccacgctttgggagctctcccatatggtcgacctgcaggcggccgcgaattcactagtgattgatcctgggatctagaatattagcaacctgacatgcatctcgtagaacattgctgggtcctcctggtctcttggtgccctgggaaggaaacgcttcttcaaaatctgccaggatttgctgtcctaactcagtctgtgcagccttcactctttcggaaagctgccggatctgcggaatccccatatacttgtggaagtgctccaggacattcatcacaccctgaaggagattagcaacttctccgtattgtcttcgcctggtcatggcttcgagggagtcgacacctcctgccagcatgtgcaggtggttcagtgtggtgattgaggtggtcaggtggcgtttggcgtgatctaattgcttaatatcacgggtgatttctttcaccatttgctctgatttttcagctttgtctttgatatctttgattttgccagagagttgttggatagctttctgagcctcttcaagcgcttgccgtccatcatgccccacgttcgtctgacctcttacaacagttcgaatattgtcatccagtctccttattttcag

SEQ ID NO: 20959 - DNA, 1038 bp, Homo sapiens
ttggcctagaagaattttggggatatagaagattcaccctgagaatatcttggatgcctgggtcctgctcatcaacctgtcacttaactagtatgtgacctctcacctcatggacgtctctgtacccttcctggcctttctcgaaagacttcagcccttccgaccctgtggatcggtgtgtagttacataaggatatgatgccaggtgatgatatgttctctcttcctcacagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttcctcgtgagtggtgcatggctgagaggattgcggtggaattttgccatgcgacaagggcagaacttgccaagattatgcgtaccagagcgaaggaaattgaagtgaaattgcttccttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaacaccaccaaaagggaggctggctgggaggaccagctctgagaaacctgtaaccatgtactttgcagctagccctgcattcattctttcccagcaccacgagggcaggagccaagagagcagagcttccaggagcagttctgaaatgatgcaatcaaatgtgtctggtcccttgattaaatgattgtaatagaaa

SEQ ID NO: 20960 - DNA, 372 bp, Homo sapiens
  misc_feature (1)...(372): n = A,T,C or G
tctgcctctgtactggggagtcacggagtggccgggctccagggacatggcggcggcctctgcggtgacgatgccaccggttcctctccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggaatcactagtgaattcgcggccgcctgcaggtcgaccatagggagagctcccaacgcgttggatgcatagcttgagtatggttttgtgtcnnccccccaggagtggcgtantaacggagtcc

SEQ ID NO: 20961 - DNA, 776 bp, Homo sapiens
acagccacaggaagaaacattaccaaggccctcattgcaggcggaggagaaattgcctgcagggcgatgcgcacagccaaaaaactgggtgtacagactgtggcggtttatagtgaggctgacagaaattccatgcatgtagatatggcagatgaagcatattccatcggccccgctccctcccagcagagctaccggggtatggagaaaatcattcaagtggccaagacctctgctgcacaggcttataggcggaagggacttgccttgtctcagacgagatgttggactgtggacttttgagttaatgctaaaataagttaagactttgagggactgttgggaaggcatgattgggttcaaaatgtgaggacatgagatttaggagggatgaggagcggaatgatatggtttggttctgtggccccacccaaatctcatcttcaattgtactctcacaattctcatgtatccggggaggaacccagtgggaggtgattgaattatgggggcaggtctttcctgcggctgtctcatggccatgaatgagtctcatgagagctgatggtttaaaaatgagtgtttcctgcacaagctctcttttgcctgccaccatcatgaaagacatgaattctcctccctggcttccgcctggatgcgaggcctccccagcctgtggaactgggagtccaataaactctttctttcgaaaaaaaaaatcgcctcgttggcctcacggggaactctgcgccgtttccttagtgagggtaattatg

SEQ ID NO: 20962 - DNA, 1286 bp, Homo sapiens
ggggagggaaaggttatgatttatcaatccattccactttccccgtctactccttctcattcttgaagtcacaggaactctgtgagaatgaccacaatgttgcaaacactgacctgatgttgccatagttcgtaaaagacagctgctttgccttgtccagctcccgtaaatgcagtatgggaactcgtattgataacaacagcacaatggacagatttctgagaaggttttctcactcattggacaaagagtttggaagagaatttctgtgtttgtgtttgtctttttcttctgtgaaagttttttcttttcctccctcaaaagtggtttagttcctctatatatgtaatgacacagtattaaaactgcttatttgaaaaagttttttggatatcgattggcattgatctatgtaattaagaataggattctttgtgattgtgtatatttccattttatttattttattctaacttatttatttttattctcagccttggccaagcatttcccacttggcgaaggacttcatagacaaactactgattttggaggctggtcatcgcatgtcagctggccaggccctggaccatccctgggtgatcaccatggctgcagggtcttccatgaagaatctccagagggccatatcccgaaacctcatgcagagggcctctccccactctcagagtcctggatctgcacagtcctctaagtcacattattctcacaaatccaggcatatgtggagcaagagaaacttaaggatagtagaatcgccactgtctgcgcttttgtaagcagatgacctctaaactatttttgcctattttaggaccatttcatcatgattagggcaccctcaagctccaaagacacgggactccatggtattgttggatactattgatcttgacttttaacattttcttgttctataatttttcctatacctgtattcattttcccaaaatatactgctgcaaatgattaacagtttagtaaatactagctatgtttagataactggaaacaataaatagataagaaaatctttacagcatgtaatggattaaataaaatacaatactatagaaataagggatgtatatgtgaagggatggggaaccagagactagcaggaatagatagatctggggaatctatgtattgatcctgcaattactgatttttatttaagcccccagctaccgtggttactacggaacactccgacgcctcccaactgcctgcccaccccacacttactccggagatattcaggg

SEQ ID NO: 20963 - DNA, 814 bp, Homo sapiens
  misc_feature (1)...(814): n = A,T,C or G
ggggnnnnnnnaaaannnnnnnaaaggaaggaaagnnaannnnaaaaggaannannnnggnnnattcaggtactgcttgtgtgcatcttttcatttcaatggctacgtcacgaatacctgcaagaaactatcacattatttccctgccaaatggacaatctcacaaaagtgacagaattcctgctgatggagttttctggtatctgggagctgcatgtgctgcacgccgggctgtttctgctgatttatctggcagcgctggtggggaacctgctcatcattgcggtcatcactctcaatcagcatcttcacacacccatgtacttcttcctgaagaacctctctgttttggatctgtgctacatctcagtcactgtgcctaaatccatccgtaactccctgactcgcagaagcttcatgtcttatcttggctgtgcggctcacgtctatcctttctctcgccttagcatccgctgagctggccttccttactgacatgtcttatgaccgctatgatgccattttgccacccccttcaatacagagtctcgatgacatcacgagggcgctatcagatgggagtcaccacncggataanctgattttcctacacacaccagcacactgacaacacgcttaccgaccacataggcacactcactgagagacaccagaagttcccagacagcccaaatgatacgaacctacctatcctgatatgattacctcccaccgcatcagcccctctcttcgacctcatgctctctatttcactcccctcctctaaacactcttttcatcttataaatttaca

SEQ ID NO: 20964 - DNA, 758 bp, Homo sapiens
caaagtacagaattcctgctgatggagttttctggtatctgggagctgcaggtgctgcacgccgggctgtttctgctgatttatctggcagcgctggtggggaacctgctcatcattgcggtcatcactctcaatcagcatcttcacacacccatgtacttcttcctgaagaacctctctgttttggatctgtgctacatctcagtcactgtgcctaaatccatccgtaactccctgactcgcagaagctccatctcttatcttggctgtgtggctcaagtctattttttccctgcctttgcatccgctgagctggccttccttactgtcatgtcttatgaccgctatgttgccatttgccaccccctccaatacagagccgtgatgacatcaagagggtgctatcagatggcagtcaccacctggctaagctgcttttcctacgcagccgtccacactggcaacatgtttcgggagcacgtttgcagatccaatgtgatccaccagtttttccgtgacatccctcatgtgttggccctggtttcctgtgaggttttctttgtagagtttttgaccctggccctgagctcatgcttggttctgggatgctttattctcatgatgaactcctatttccaaatcttctcaagggggctcaaaatccccacccgaaccgagtcgaacaaaaagccttcttcaccctgttccccccagcttattgtcatcatgctctttcttaccacaggggtatttgctgg

SEQ ID NO: 20965 - DNA, 642 bp, Homo sapiens
  misc_feature (1)...(642): n = A,T,C or G
cccgacgtcgcatgctcccggccgccatggcggccgcgggaattcgattgtacatgggtgtgtgaagatgctgatagagagtgatgaccgcaatgatgagcaggttccccaccagcgctgccagataaatcagcagaaacagcccggcgtgcagcacctgcagctcccagataccagaaaactccatcagcaggaattctgtcacttttgtgagattgtccatttggcagggaaatctgtgatccttccagcagaatcagcagtgtacaggagtatactatctcccgggttagcttgccatcggtagatgtaaaattctacaaaactgccacgtggtcaattcctcgtaatgtattatagtttcttgcaggtattcgtgacgtagccattgaaatgaagagatgcacacaagcagaccattcttaagttctgcaactagaaagacacactgttcttcttcatagcatttccagggcttcccacgacaggaagttccattagattcataacaagcagggcactctgcgttgctggacacgttnttcaagggagggtncagggcatcgntgnnccctccccgccgaaaatcgttgctccacggtcccacccgcgactaatctttgctccacggtgccacccgcg

SEQ ID NO: 20966 - DNA, 542 bp, Homo sapiens
atgcatccaacgcgttgggagctctcccatatggtcgacctgcaggcggccgcgaattcactagtgatttgtagcgtaaccgagtcctacgagaaacgacttaagctcccgggacctgcgtgctgccgagagaggaagcgaagggcaccatctttgtattttgtgtcatgacttctcaagagaaggcagaagagtatccttttgcagatatatttgatgaagatgaaactgaaaggaattttttgttgtccaaacctgtttgctttgttgtatttgggaagccaggtgctgggaaaacaacattagcccgttacataacacaggcatggaaatgtattcgtgttgaagtttgccaattttagaagaacagattgctgctgaaaccgaatcaggagttatgttgcaatcaatgctgatcagcggtcaagcattccagatgaacttgtcataaagccaatgttggagaagctcaactccccagaagtctgtcactaatcgaattcccgcggccgccatggcggccgggagcatgcgacgtcggg

SEQ ID NO: 20967 - DNA, 740 bp, Homo sapiens
atgcatccaacgcgttgggagctctcccatatggtcgacctgcaggcggccgcgaattcactagtgatttgtagcgtaaccgagtcctacgagaaatgacttaagctcccgggacctgcgtgctgccgagagaggaagcgaagggcaccatctttgtattttgtgtcatgacttctcaagagaagacaggagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagatgaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaaagaaagatgcgcc

SEQ ID NO: 20968 - DNA, 598 bp, Homo sapiens; identical to SEQ ID NO: 4690

SEQ ID NO: 20969 - DNA, 831 bp, Homo sapiens
agttttttttttttttttttggtacactcaaactttatttggttgcctggatggggccagagaggaggacaagaagggtgtcaaagggttagctcagtaggggtgattcagggtgcgctccatgatggtcagaagcgccagccacgtctccttggctgtggggatgatctgggaggctggcagcaggaagccatagcgcccagtgtcccggagctcgaaggtgaaggagtacttgatgccctggctgtaggtccagtcaatagtgcttccactggcttgataaattgccttgatgatgctgccatagttgaatttggtcccgtagagagaggccagggctgtcacagcagccttggaaagctgattccagctcatcctggtcaggggactggttttgttttgtgcccatagggatacatgaggagctgggagtagctgtggatggagatgaaggccttgatgttcccgtggtccttcacgaagtctacaatggacttgacctccacttcggaattggcaaacttgccgtggtaagtctccgagcaggggttactgctggctccggacaacccaaagccagcgtccagttcctgttggggtccacgccaatacagagggagcctgctgtgtgggaccgagtcttgcgccacatgcgattcgtgctgtgcgtgaaggcaaagccatcagggttggtgacgatctccaggaagatgtccaaggtgtcgagaatggcggtgaaagctgcatcctgcccatagtcttgagtgatcttctttgcaaaccagaccccactggcctgggtgacccactcccgggaatggatgcctgtgt

SEQ ID NO: 20970 - DNA, 576 bp, Homo sapiens
atgcatccaacgcgttgggagctctcccatatggtcgacctgcaggcggccgcgaattcactagtgatttcctgattcggtttcagcagcaatctgttcttctaaaattggcaaagcttcaacacgaatacatttccatgcctgtgttatgtaacgggctaatgttgttttcccaacacctggtttcccaaatacaacaaagcaaacaggtttggacaacaaaaaattcctttcagtttcatcttcatcaaatatatctgcaaaaggatactcttctgtcttctcttgagaagtcatgacacaaaatacacaatttaaaagatgtacaatcctgcttatttctccagtcttgcttttgtagaagctagacagagcacaacagatgagggtagacttctgcaaatttaacaagctggtagtcccagttgcaactgctgtgcagatgggatctttactagatagacacagtctcttgtattttttacgcagctgatgatctggcaatgtgtgcatccttttcaatccctggccgcagccggaccctcctcagggaagcaactgcctccagggactccg

SEQ ID NO: 20971 - DNA, 744 bp, Homo sapiens
  misc_feature (1)...(744): n = A,T,C or G
tagtgcttaagaaaagtcatggaggactaaagcctaagtccttttcacttttcctccatctgaaggtaggtgagtccatcctcttcatggttatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaggggggaaggctccactgcattctttggctaaggcgtgaatgcttgctcatctgtaagatctatactcgaggttttgttttccttttaaaattctttagggagagagggatggtttctgaggggttctgaaagtatgattcaatgtgcaacatacaggtagggtcttcagcataagctgaaatatatgcatgttaaaactttgacatctttttttttaaatttcccacttctttctaaacttacttctctttttggcccccccccattctacagaagttgaaggccaagggagaatggtaggcacagaagaaacatggcaaactgctttggtgctttcaaaccaaagtgttcccccccacccccaaatttgtcttaagcactgggccagtctgttggggggctttggttttctacaacccaaattcgggggtgtattnctttctttctttaaacattagagggacccaccccaaggggatgc

SEQ ID NO: 20972 - DNA, 500 bp, Homo sapiens
cgcggggaaggtttacatcttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcctttgatacatttattagaacacaatttgatgataatcctgatgccaggcttcccaattctggtgatctgtggagcattcatatggactttgacaccaaacggctggacccctgggaacgaatcatacctactttcaaatacaaccgagatgttccactttttgaaatgcttgtccccacaactgacacagtgcgctatggaatcactagtgaattcgcggccgcctgcaggtcgaccatatgggagagctcccaacgcgttggatgcat

SEQ ID NO: 20973 - DNA, 739 bp, Homo sapiens
tcttgctgcaaggatctgataaaggagttgagatttatgaaccattctttacccagggtgaaacaaagatcttaaaactaaagaatcttcgacctcaggactatgctaattatagctgcattgcttcagtgaggaatgtatgtaatattcctgataagatggtgtcgtttagactgtccaataaaacagcatcaccgtcaattaaactcttggtggatgatcctatagttgtaaatcctggagaggccataacattagtatgtgttacaacaggaggagagcctgcaccttctctcacctgggtcaggtcctttgggactctgcctgaaaagactgttttgaatggaggaactttgaccatacctgccatcacctcagatgatgctggtacttacagctgcattgccaataataatgtgggaaaccctgcaaaaaagtccaccaacatcattgtgagagcattaaaaaaaggacgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcaatcactagtgaattcgcggccgcctgcaggtcgacctatgggagagctcccaacgcgttggatgcatagcttgagtttttataggtccctaaataggttttgtaacccagttgt

SEQ ID NO: 20974 - DNA, 225 bp, Homo sapiens
cccgacgtcgcatgctcccggccgccatggcggccgcgggaattcgattggcaatttttctgaagaaaataaaaggaagcagtaggaatgacaatgtcaagttgataggatttgataatgggttaatgagaaaaagggatagttcaaaaattacgatattttacttacatgtaactacaaaaatgaaatagggcatattagaaatacagaagtttgaaccccccg

SEQ ID NO: 20975 - DNA, 349 bp, Homo sapiens
cccgacgtcgcatgctcccggccgccatggcggccgcgggaattcgattgagaagagacccaagaaaggtttcatcaaggatgttcttctttagctggtccttaataaatgggtaggatttcatgaatagagaggtactgagaatgtcaggggagaaggaagctgagaacaaagtttcgggtagataaagacacggtgtttgtagcagccggtctgtaataacaagcaattttaggaattagtgagagttacatcttaatccatttttactttagaacttatttttttgcatatatttttaattctatgtaaccatctggtaatgcctggcactctatgatttgtccca

SEQ ID NO: 20976 - DNA, 523 bp, Homo sapiens
actcaggttatacgaccaccctattttagtgacactataaaatactcaagctatgcatccaacgcgttgggagctctcccatatggtcgacctgcaggcggccgcgaattcactagtgattgagaagagacccaagaaaggtttcatcacaagaagggagtgtttcttgtgccataaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaaaaaaaaaaaaaaaaaaaaaaactcgagactagttcg

SEQ ID NO: 20977 - DNA, 394 bp, Homo sapiens
cttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaatcactagtgaattcgcggccgcctgcaggtcgaccatagggagagctcccaacgcgttggatgcat

SEQ ID NO: 20978 - DNA, 800 bp, Homo sapiens
ctgccgatctgggtttattgaaaggtcttttgggagttgcttgctcattaaatacaccaaatacaaaatctctcttaatacagtattctcttggtaatttagaagactttcccaaagtgagctcggagagatggaactgtcaaagcttttaggaggccacactctcaaaggttgtgcttcctctcataagcggctgctctgcagctttatgatttggggtgcccttctgtctaatctagtccaaagcatcaccctcctattgccccaccccatccccattcgcctcccaggtcagtgtgtggccaaagatatgacagcttccagaatcacagaaaatttgagatcagatttctccactgacttttacttttatgtgttcattcatttatttatttattagaggcaaagtgtcactctgttaccaaggctggagtgcaatggcataatcatagctcactgcagtctcaaactcctgggataaagtgatcctgccacctgaaccttccaagttgctgggactacatgctcatgtccctgggcccaaatcgttcttaaacttctatatgaaaaatggggggttgctttgtccccaggcgtgtttgaaccccgggccgaatggaacatgcaactcgcctcccaaatctgggattctgtggcagcagcatggctggcctgctcgtcggcgactggggaggctaagaggacgatcccaacctcaaccccgtgcgggctttttaagtggcgagcaaacgtttatctttttcagccaccgattcccatcgcgtcgggtctcgatatat

SEQ ID NO: 20979 - DNA, 1521 bp, Homo sapiens
cagatcacttgaggtcaggagttcgagaccagcctggccaacatggcgaaacctcatctctgctaaaaatataaaattagccagaagtggtggtgcgtgcctgtaatcccagctactcaggaggctgaggcaggagaatcgtttgaacctgggaggcggaagttgtagtgagccaagatcactccagcctgggtgaaagagggagactctgtctaaaaaaaaaaaagtcctgtctcatatgtccacactccactttcaatgctccatcactgtccttgctcttaggataaagacctaaatcctcagtctgctccataagcccctgcctcatcccacacccattcccctctcactcccactccctctattttctgttcctcagatgtacccccagtccctcccaagtcggtacctcgcaggtgctgttccctctgcctagaatgctgttcccctttctcctcacctccttaacccttgctgctgcctcactgggccagcttcttctaacatgtgctgtcatggcttcagggaccttccatcagagcacttgctgtggctacattttacacattttatttagacatatttataatatgtaattctggtctcagtgtgtattagtcagctttagctaagatatgcttagataacaacccagccccaaacctcaccaaccgacaacaataaggatttacttcctgctctggccacacatcatccctgactttattctgcatgtcattttccttccaggatcaaggctgaagtagcatctccactcgggacatgcatttcccatggcagagagaacacagcaatggcaggaccacgcgatggtccttctgttcacagtggccacaccttccattggtaaagcaagatccatggcctggccagagggtagtgtagaagcctcaacctcctgcagtgtgagacactgcaaattccaagcaaaatcccagtgggcaaaggtcttctgatctccttcctggaggcagccaataatcggggacagaggacagcctggcacatctcactcaacaactgtgtgctccttagggcaagattgagactgcgtttcctcatcatcgaatcctacaggatgtgtgaatgggtggcaggcaaaggaaagaaaatcatggaggatgaattccaagttttgtatccactgaggacaggggcccagcccaggtcgtcaggggtgaggaagggaacacacggggacagctacactaatttgtggtctcctggcagccgccatatagacctgaagaaaactggggttctggaaggaaaggggcagagagaaacagtgaagagatgaagtagccaccactgcaccagcacgttctgagctttttgctcaaagcatcccatagcacttgttatcccttgtctggctaaagtgtgcaagctccctttcctcccttgactctgggctttccttctatttttgtctgttaaaatatccaaaacttctgcgttgttggctgaccctattcttttaggaatgtattggat

SEQ ID NO: 20980 - DNA, 1187 bp, Homo sapiens
cgcgagcggttaatttttgtgtttttagtagagacgggctttcaccatgttgtccaggctagtcttgaactcctggcctcaagtgatcctcccactttggcctctgaaggtgctgggattacaggtgtgagccacttcccaggcccattcaaggctttttaaaagacgtgtctccaaggctgagtcttaaagatgtgcaagcagttaaaagaagaaggaggaagcctcctgggggcaggtgagaggaggctgacaccccagaatctgggccaggaactgagagacagattgggacaacggaacaaatctaccagggatgctcaataaaggaatgtagaagaatgttgggagggaagcattctcacctatttctgatcttaacaggcagcattgccagccatcactccatggatcctctcatctggaagtgctccacttcagaaatcttagattccaagatccactctcagaaaacaacctccagacatttctgccgtccacacagttgcttcttctccctctggtgcacggccacctgtgctatctgcagcctcaccggcattccctggcctcgccctctgcacttcatcctgacaggcatggagtctcctcctgtcaccccagagctatgtggtatcttgattaggtgactttgcccatgttgtcattcaacttaatatttattgatctatctctgtgagaatcacttggctggccctttcgtctggagtgtcagcctcctctcacctgcccccaggaggcttcctccttcttcttttaactgcttgcacatctttaagactcagccttggagacacgtcttttaaaaagccttgaatgggcctgggaagtggctcacacctgtaatcccagcaccttcagaggccaaggtgggaggatcacttgaggccaggagttcaagactagcctggacaacatggtgaaagcccgtctctactaaaaacacaaaaattaaccgggtatgatggcacacacctgtatcccagctactcaggagcctgaggcatgaaaatcacttgaacctggggaggctgcagtgagccaaaaatggacaccactgctctccagcctgggcaacatagcaagactctgtctcaaaaaaaaaaaaagatacttctctgaccactccttatcttcctttcccttacatagcatatcccccaaaa

SEQ ID NO: 20981 - DNA, 885 bp, Homo sapiens
  misc_feature (1)...(885): n = A,T,C or G
cgattctgggaactactcctgtgaggccgacaatggctggggatcccagcgcagtgaggtggtggcactcacggtcacagagcccccgaccaaagtccgtttgattaatggtcctcaccactgcaaaggaagagtggaagtggaacaggaaggtcactgaggtaccgtgtgtgatgacagctgggacatgaaggatgtggccgtggtgtgccaggagctgggctgttgagcagccaagcacacacctgctggcatgttgtattcaagagtggcagaagaggcccaacctgtgttcattcaggttgccctgtgccataggacagaagaggcactggctgaatgacttcaccacattctggggaacaacaaaaggagcacatcctgtatcactcaagaccaagccatggtcttctgtgtgcagtcctcaagcccacccaaagagccctagaagtctgcatctcataggcctctgttccttgtggacttcccaatgtggctgggcctttgctgcccgatggactttcagaaactctgtctgtttcctctggcctttggtggatggatttttctttagatttgttggttctnccatttttgctgcacattggaatcacctgagggagttttctgaagtcctgatattggaagttctacttccaaattctctaggagtctggggtgatgccgggacatcaagatattttccttcaaattaaccctcaggttattacagtattcagacaaactgaaaactacagccttagtcttacaggccccctgcattgattgctgcccctgtgaagaaatgtggccattttcattatggtcttcctctctgctactgatattcctattttctttggatacagaataaaaaccgatcgc

SEQ ID NO: 20982 - DNA, 1140 bp, Homo sapiens
  misc_feature (1)...(1140): n = A,T,C or G
cgcgggtttgtgcctggaactatgcgaacatttttccacttggccgcacaactctttcagttaggcattccctcagaactttcagcacatggtggggcactgtgctctgtacataatatccagcgcctgccgtcaggaagctcacggtgcagtggggagatggcccttggaagagaccacgagaggaggctatgccgaggcctgagcagaggagtggacgttctgtgctggatgcctctgctcggactttgcctccctctatggctgagcggactcattcaggcagtgtgctttggtgcagtggtaccatttccccagtgctatcctggccccagccacctcatctcccattggagtgatggcagcaactgccctctggcctccctgttgccattctgtcctttgatatacattgtccacacagcacagagtgaccttttaaaacatccatcagggttatatcactcccccacttgaaaaactgcccttggccttctgttaacagtaaaatacaatcctgactccatactgcagccttcaaggctcctggtgacccagcccactcctgtcacccccattcggcttgctgtctgcagccacatgggtcttctttctccccctcagacctgctcctcacttgggccttctccttgctgtttccccatcccttttatcttccaagggtaccttcttgactaccctttttagaataatatcctcatcacctcccaccactttatcccataatcctgttttattttctgtacagcttttatctctctgtacaagctatgcagaaaatatttattcattatatgtatctcacactagagtgtaaactccatgaggacagggaccttatttgttttgttaaatggctgcattcccttagcatagtgcttggcatgtaatagacactagaaaaaaaaaaagaaaaaaactcttggctaaatgaatatcgaaagagtgcccatctagtgtgtccctgggacccangtgctaccctactgtctgaagtcattagtgaaaaaaattatcccttttatacttagagctgtgtccaaggaatacggtattgttcctaaatatcatgcatgagcagaaagaatgaatagcagtaataaaaatggtaaactctta

SEQ ID NO: 20983 - DNA, 993 bp, Homo sapiens
tgatttgttagtgttatttggtcatattattgaactaatgtattattccattcaaagtccttctagatttaaaaatgtatgcaaaagcttaggattatatcatgtgtaactattatagataacatcctaaaccttcattttagatatataattgactgggtgtaatctcttttgtaatctgttttgacagatttcttaaattatgttagcataatcaaggaagatttaccttgaagcactttccaaattgatactttcaaacttattttaaagcagtagaaccttttctatgaactaaatcacatgcaaaactccaacctgtagtatacataaaatggacttacttattcctctcaccttctccagtgcctaggaatattcttctctgagccctaggattgattctatcacacagagcaacattaatctaaatggtttagctccctcttttttctctaaaaacaatcagctaataaaaaaaaatctgagggcctaaattattttaatggttgtttgaaatattcagttcagtttgtacctgttagcagtctttcagtttgggggagaattaaatactgtgctaagctggtgcttggatacatattacagcatcttgtgttttatttgacaaacagaattttggtgccataatattttgagaattagagaagattgtgatgcatatatataaacactatttttaaaaaatatctaaatatgtctcacatatttatataatcctcaaatatactgtaccattttagatattttttaaacagattaatttggagaagttttattcattacctaattctgtggcaaaaatggtgcctctgatgttgtgatgtagtattgtcagtgtgtacatatataaaacctgtgtaaacctctgtccttatgaaccataacaaatgtagctttttaaagtccattgtattgttttttctttcaataaaagagtataattaattggcaaaaaaaaaaaaaaaaaaa

SEQ ID NO: 20984 - DNA, 624 bp, Homo sapiens
caagagagcatcatagaccagtgggtcttgatgcaagattgcctttgactgtgtctctaaggacaggcggaatgcaagaaggtggacaggtggaggaagaatatttcaagcttctggacgtgaagtcacaatgaggcacacagtgatcacaagatccatttggctgatcacaggaagatatatttgaaatagaagttgaagcatatcagattggaccctgaaccaggaaactgaatttatcctgcagataatggggaagtgtattggtccattcttgcactgctgtaaagaactacctgagactcggaatttacaaagaaaagaggtttgggccaggtgcagtggctcacgcctgtaatctcaacactttgggaagctgaggcaggcacatcatcaggtcaggagttcaagaccagcctgatcaacatggtgaaacctcatctctactaaaaatacaaaattagccaggtgtggtgatacatgctggtaacctcagctactcgggaggctgaggctggagaatcacttgaacctgggaagcagaggttacagtgagcgagatcatgccatttcactccagcctgggcaacaagagcgaaactctgtctcaaaaaaaaaaaaaaa

SEQ ID NO: 20985 - DNA, 517 bp, Homo sapiens
acactcagctttgaatgctgataagtcactggcaagggagagagctctttgcaaggatccaggaccagggggcctgctgggcatcataccaccctagagtctgcctaggatgggatcctaggtgcctcagcttaaccttgacacagacaagatttattgaatctgtaacgctcgaaagcatttctaggacgcatatttcctgcatcctgggaggagcttttgctgacggatgcacagggaaagatcatgtttgacacagtgggtctctgcagcacatgggaggtggaatatcacccttacctcaaccaaagcaaactcctggagtactgtaagtccaaggacattgtcatgactgcatattctgccttggggtctgactcagacaaagactgggtgaaaaaaggaaacccagttctccaggaggatccaatactcaatgccattgctgaatcactagtgaattcgcggccgcctgcaggtcgaccatatgggagagctcccaacgcgttggatgcat

SEQ ID NO: 20986 - DNA, 952 bp, Homo sapiens
cggggagcttttgctgacggatgcacagggaaagatcatgtttgacacagtgggtctctgcagcacatgggagagttttactcctgttgcctaggctggagtacagtggcacgatctcggctcactgcaacctccgcctcccaggttcaagcatgtacctctgcctcccacatagctgggaatacaggtggaatatcacccttacctcaaccaaagcaaactcctggagtactgtaagtccaaggacattgtcatgactgcatattctgccttggggtctgactcagacaaagactgggtgaaaaaaggaaacccagttctccaggaggatccaatactcaatgccattgctgaaaagcccaggcgaactccagcccaggttgccttgtgctaccagctgcagcgtggggtggtggtcctggtgaagagcttcagtgagaagagaatcaaataatacttccaggtttttgacttctagctgacaccagaggacatgaaaaccacagatagcttgaacaagaatatacgcctttgtaaatgtctatcttttctcatcacccagattatccatttcttgatgaatataaagaaaagagtctgtggttattccagagtttattgatttgggttgaaatgaatagaaaatgtctcaatggatgggaagttttctagtttattccagattgattagcctgctcagtcacaagttggcctaagaccccggatcagaaaataaaagtatctaaacctagttttctcttgattcccgcccccaccccaaccccaaaaattgccaaataaagatggttttgaaataacccttaagaaaagataaaatgtttcgctccagatataagtaacatttttgacaacagttgaccttataatttttagtcatgcagttggccaaaagatgaagagctcttcttgtgcctaatgaagggagggtcac

SEQ ID NO: 20987 - DNA, 956 bp, Homo sapiens
acaaagaaaaaactcaattatgttagatttctaggtcaaacgaaaccctagaatcccttttctcattcattgtcctaatctgttgtgtttctgcacaaaatcagcacattatcaggtagttatctcacattgcattccctactatcagaaggcccgttgctaagagatgccttgtttctttgcctcttagagggaaaagaagaatattgctgctcaacgaattaggggatccagtgcagacagccttgtcactgctgatagccccccaccatccatgtcatcagttatgaagaataacccactctatggtgacctaagtttggaggaagctatggaagaaagaaaaaagaacccctcatggaccattgaggaatatgacaaacattccctgcacacaaacctctctggacatctgaaggaagatcctaatgacctgcggttttggttgggagacatgtacactccaggttttgacactttattgaagaaggaagagaaacaagagaagcattcaaaattctgtcgtatgggtctgattttacttgtcgttatctccatcttggttaccatagtgactatcattacttttttcacctgaggaaactgcaacaatcagagctactttaaatttcctaaaaatttttctgataaacatttgaaacccccccaccaaaataataaaaaacacatgtacatgcagtgtgaatggattgttgattgtattattaaatgtaattgtcctgaagaatgtgaatgtaaggggtggtatgctggctgctccactttgttctattaaagctttctaagagtggccgccctgaactttgggaagcagggattctgaggaccataatcacagaattaggactatatgcgacccaacttaaatatctttataggggagcaacaggatccaaaattggcgcagatttgttttattgcttaactatttaacg

SEQ ID NO: 20988 - DNA, 561 bp, Homo sapiens
gtatttctaaaaaactgactgaggaaacccaagaatatatattgaatcttttccaacgttatgttgatgaaggtttacatcttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcctttgatacatttattagaacacaatttgatgataatcctgatgccaggcttcccaattctggtgatctgtggagcattcatatggactttgacaccaaacggctggacccctgggaacgaatcatacctactttcaaatacaaccgagatgttccatttttgaaatgcttgtccccacaactgacacagtgcgctatggaatcactagtgaattcgcggccgcctgcaggtcgaccatatgggagagctcccaacgcgttggatgcat

SEQ ID NO: 20989 - DNA, 719 bp, Homo sapiens
  misc_feature (1)...(719): n = A,T,C or G
cccgacgtcgcatgctcccggccgccatggcggccgcgggaattcgatttgggacttatcgtagccatcgaggaatcaagacttcacanatggtttgataaccaggtgcaggatgctgatttgagcctctcccaattctctaataacctcactggaggttaaccaggcagggctcaatatacctcttcagcagtagcatagtttctgattgagtgtggcatcacctcctggttgaattcagtgtcgtagcaggaattcttagagctggccgacccaagatggggtggagagagcggcatgaaagagacagagagagagagacacgcctgaatggcagcagcatgccttaacggcaatggacagtacgcacaggaccagctttgcctcgagccgcaacgctgaacccccccctatctgattcacgcactaatcacttgtgtatatccgggtctactgaatgtttaccatttgggatagtctttaactcattgaatgcatatatttgagttttttttattattcctagtaatttagacgaattcattttcacacttgtcatctgttttattcgtttccacatcattgacacacacgactatcattcctttttatatttttgttatgctgtcgtttctatatcacgagctaattacgcttactgggcgccgttcctttatatttcctattttcatccctcctttttatctatctatcttccg

SEQ ID NO: 20990 - DNA, 464 bp, Homo sapiens
ctatgcatccaacgcgttgggagctctcccatatggtcgacctgcaggcggccgcgaattcactagtgattatgggacttatcgtagccatcaagtcgtggctggagcccgtgcggttcctcaggagtatgttcgccaacaacctggtgtatgacacctcggacagcgatgactatcacctcctaaaggacctagagggaggcatccaaacgctgatggggaggctggaagacggcagccgccggactgggcagatcctcaagcagacctacagcaagtttgacacaaactcacacaaccatgacgcactgctcaagaaccacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctcta

SEQ ID NO: 20991 - DNA, 1184 bp, Homo sapiens
cggggggggggaaaaaaaaaaggaataaaaagaaaaactattattagcgttcagggcatacaaaagcaggcagagggctggaggtggccctgtgccttgtttgctgacccctgtcataaacagaaattcttcatagactgtttatggataattgagaaaaggaagcgcagattctaaagtagtaagatcctactgattattttcaaggcttcccaccataacttcatgatcatttagcgtaccacagtacagcaggctgcacatcatcagagcctaacgaatccacatttctgcctctagcccaggccattccctgggtgccatacacacagatccaaccagctgcctggcaccacagttggagctctcctggacatctctagggtctaacatggaatcttgcatcccctcctccagcccctctgtttcacctcctgtcttctccatggccacacatgttgccaccatccacctacatcaagaagtcaccttgattcctcatgcatcactcattagcaagctcactgcatctccaggactcacgccaggcctgcactgcatccccgctacttctcctaggctggcggccccatctcttgtctcgatggctacgataagtcccatatccacctccttccctctccccgcacagctttctgctacagtagcagaggtggagcctccaccaaaatgcagatttttccaaaaatccttacagggacgatcatcaccctagaggttgaacccttggatacaacagaaaaatgtaaaggccaatatccaggataaggaacgaattcctcctgatcagcaaagacaagtgactggaagctggcaagtaactggaagatggacataactttctctgactacaacattcaaaaggaatttactctttttatgttgcgttgagacttcatggtagtgctaaaactaggaagacatcttacacgactcccaagaataagcataagagaaagaaggtgaagtgggcgccccgaaatactataaggtggatgaaaatggcagaattagtgcgcttcgctgggagcgcccttcaaatgaatgccgcgccggagctttatggcctgccactctgacacgcattattgtggctacagtggctgatttattgctttcacaaaccagaagacaagtccttgcgttttctctcactaaagaca

SEQ ID NO: 20992 - DNA, 1024 bp, Homo sapiens
  misc_feature (1)...(1024): n = A,T,C or G
tgagcgcgagggcggctactgagaagcccggcgacggaggaacgcaggtctgctgccagggattgaggagactgaagaatgctgaaggcaggctgacgggctcagctggtaggctccactatctcgccatgactgctgaaaatcccactcctggagacctggctccggcccccctcatcacttgcaaactctgcctgtgtgagcagtctctggacaagatgtccacactccaggaatgccagtgcatcttttgcncaggcttgcctgaancagtacatgcagctggcaatccgagaaggatgtgggcctcccatcacttgccctgacatggtgtgcctaaaccacgggaccctgcaggaagctgagattgcctgtttggtacctgtggaccagtttcaactttatcagaggttaaaatttgaaagagaagttcatctggacccctaccgaacatggcgtcctgttgcagactgtcagacagtgtgccctgttgcctcgagtgacccaggacagcctgtgctggtggagtgcccttcttgccacctgaaattctgctcgtgttgcaaggatgcttggcatgcagaggtctcctgtagagacagtcagcctattgtcctgccaacagagcaccgtgccctctttgggacagatgcagaagcccccattaagcagagcccagtttgccgggtttatatcgaacgcaatgaaggctgcgctcatatgatgtgcaaaaactgcaagcatacatttagctggtactgcctccagaacttggatagtgacattttcctcagacattatgacaaagggccatgcaggaataaacttgtccactcaagatctttattgatgtgtacccgacccaggtggtggggatgttttgtaggtttggtgatcatagtcttgtgttctttagccttgctacttctgggcctaccatttgtaatctgtattgtctgcaagtactgtctggcctagaatgaaaagccggacacttgtccaaccttaagggtcttttttgtct

SEQ ID NO: 20993 - DNA, 834 bp, Homo sapiens
  misc_feature (1)...(834): n = A,T,C or G
accacaaaacatgatacttaaacgagacctgcagccgcagtccagatcagacagggtcgaattgagatccaagtggttttagggtataccattgtcaaggaaataaactggccaaaatataagttatggtacttgtcaaagcgcaaaggtgatccgttaaaggccgaagccttcagtgtcaggttgggctcttaactctaaccgtggactgccgacagggccactgtatgcagagcctgggaggcagacatgactgacaggggagacaggagatctcggtagctcccgaccaccagaacgggggccccgggccggccggttccttgggggctggacacaggcccttcttgtcctcctcggggcagtccccactctggtgcttcttgacgtggcggctgaagacgaaagggtgtgtggtcttgaacaggcactcttcgcagctgaaggtctggcgtggggcgtgcttcagcttcttgtgcaggttgagattgtccttgcgcttgcagctgtagctgcactggtcacagtggaagggccgctccccggtgtggacgcgcacgtgctcgatgagcttgttggcggtttggacaggtagccgcactggtcgcacttgtagtggttgcccaggcggtgctcccgggtgtgcgtctccagctccagctggttggccttcaccgtctggcagatccggcacttgtactccatcttgtagtgggtcttgaggtggcactccatggcagcggggcggttggtggaataaatgcanaatgggcacctagagtaataacacaaaaatacaaatcaacaactaattatatccgtaatacttgtttg

SEQ ID NO: 20994 - DNA, 347 bp, Homo sapiens
tggttcctcttcatccttcttcctggaggacgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaaatcactagtgaattcgcggccgcctgcaggtcgaccatatgggagagctcccaacgcgttggatgcat

SEQ ID NO: 20995 - DNA, 810 bp, Homo sapiens
ttaggcaatgttgggacgaaacacggggagtcctccaggaagaaggatgaagaggaagttcagagcaagcaccggttaatccccctcggcagagaaatctatgaattctacaatgcacccatcgtgaagttctggttctacacactggcgtatatcggatacctgatgctcttcaaccatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgacggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagcttctggcgagcgccaggcaagccatccttttttccaatgaggagccatcatggaaactggccaagaacaacttctacatgccctattggatgatttatggggaggtgtttggggaccatatagaccgttggtttgtgaagcatggtattagggctgatcggatctcatatccgcctggacccacagccctttccagggcgttcaatcccatcctgtgggtggacccctggccgg

SEQ ID NO: 20996 - DNA, 671 bp, Homo sapiens
  misc_feature (1)...(671): n = A,T,C or G
caggaatgtcacggacctcatcgcacacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagagccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtggagatggaacgctggccgtccacccaggaatggatcgtaatctcctatattttcaccctgggaatagaaaagatgagagagattctgatgtcagagccagggaaatcactagtgaattcgcggccgcctgcaggtcgaccatatgggagagctcccaacgcgttggatgcatagcttgagtttttatagtgtcactaatagttggcgaacntag

SEQ ID NO: 20997 - DNA, 265 bp, Homo sapiens
cccgacgtcgcatgctcccggccgccatggcggccgcgggaattcgattaaagcacactgcctgaacgagtccgctcagccatagagggaggcaaagtccgagcagaggcatccagcacagaacgtccactcctccgctcaggcctcggcatagcctcctctcgtggtctcttccaaggtccatctccccactgcaccgtgagcttcctgacggcaggcgctggatattatgtacagagcacagtgccccaccatgtgctgaaaa

SEQ ID NO: 20998 - DNA, 776 bp, Homo sapiens
cctgggtttacgcctgggactatgtcgacatttttccacttggctgcacaactctttcagttaggcattccctcagaactttcagcacatggtggggcactgtgctctgtacataatatccagcgcctgccgtcaggaagctcacggtgcagtggggagatggaccttggaagagaccacgagaggaggctatgccgaggcctgagcagaggagtggacgttctgtgctggatgcctctgctcggactttgcctccctctatggctgagcggactcattcaggcagtgtgctttggtgcagtggtaccatttccccagtgctatcctggccccagccacctcatctcccattggagtgatggcagcaactgccctctggcctccctgttgccattctgtcctttgatatacattgtccacacagcacagagtgaccttttaaaacatccatcagggttatatcactcccccacttgaaaaactgcccttggccttctgttaacagtaaaatacaatcctgactccatactgcagccttcaaggctcctggtgacccagcccactcctgtcacccccatttggcttgctgtctgcagccacttgggtcttccttctccccctcagacctgctcctcacttgggcccttctacttgcctgttccccataccttttatttcccagggaaccttcttgactacccttttagaataatatcctaatcaccttccaccactttatcccataatcctgttttattttctgggcacctttatct

SEQ ID NO: 20999 - DNA, 565 bp, Homo sapiens
cacttaagtgtgctgcgtgtgtcaggagcagggactcagccctcctggagctgacgggctagtaaagaagctggacaagcaagtaaataagaacagagcctcccctaccccaaaggcaaccatttgcaactcttagcttattatttttatgtaatctttacaccatgtttattgtgctactttttgtttggctttagacattatctgtagacttcctgctaaggaacataagaattcttctctttcttatgtcctccttcagttaggcattccctcagaactttcagcacatggtggggcactgtgctctgtacataatatccagcgcctgccgtcaggaagctcacggtgcagtggggagatggaccttggaagagaccacgagtggaggctatgccgaggcctgagcagaggagtggacgttctgtgctggatgcctctgctcggactttgcctccctctatggctgagcggactcattcaggcagtgtgctttaatcactagtgaattcgcggccgcctgcaggtcgaccatatgggagagctcccaacgcgttggatgcat

SEQ ID NO: 21000 - DNA, 392 bp, Homo sapiens
actatctagaggaagtgtcggcgccgccactgtccggccacagcctaacgctcttcgctgtcgtttgtggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctaggtaagaatcccactaatcactagtgaattcgcggccgcctgcaggtcgaccatatgggagagctcccaacgcgttggatgcat

SEQ ID NO: 21001 - DNA, 326 bp, Homo sapiens
aagtagcctcattctaggtgcaagaaggatggaaaattcactcagggtacatccaatgaggacatggatgacgaaaatgcaacattgctgacagagtttgttctcacaggacttacatatcaatcggagtggaaaatacccctgttcctggcattcttggtaatatatctcatcaccatcatggcaaatcttggtctgattgctgtcatctggaaagactcacaccttcacattccaatggacatattccttgggagaatcactagtgaattcgcggccgcctgcaggtcgaccatatgggagagctcccaacgcgttggatgcat

SEQ ID NO: 21002 - DNA, 942 bp, Homo sapiens
gctattccatcaacgcgttgggagctctcccatatggtcgacctgcaggcggccgcgaattcactactgattagcgcgtgaatacgatcgggggggtgggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggactatgaaagcctggagaaggccaaccatgaagaagtcttagcagctggcaaacaagctgcacagaaattggaacaatttgtctccattcttatggccggcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttccgccttatctaaatcaccagagaccaaacaaggactaatccagtacctcttggattttatttaaagtacaagatgttgtcagaataaagagagagatgaaatagaaaaataaaaaaaaaaaaaaaaaaaaaaaa

SEQ ID NO: 21003 - DNA, 1281 bp, Homo sapiens
atgttttatacatccattgggagacagctctccttgggccttttatatttctgcatatctagattattccagatgatcttttcaagggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactag

SEQ ID NO: 21004 - DNA, 2073 bp, Homo sapiens
  misc_feature (1)...(2073): n = A,T,C or G
atggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcccctcaggcagaagccgacgccaaccccgaaacccagcagtgcacgcgagctagcggtgacgaccaccccgagcaactggcgacccccggggccctgggaccagctacgcctgccgccctggctcgtgccgctgcactacgatctggagctgtggccgcagctgaggcccgacgagcttccggccgggtctttgcccttcactggccgcgtgaacatcacggtgcgctgcacggtggccacctctcgactgctgctgcatagcacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcagggccctgttagcgtcccagctggaaccaacatttgccaggtatgttttcccttgttttgatgagccagctctgaaggcaacttttaatattacaatgattcattcccagctggaaccaacatttgccaggtatgttttcccttgttttgatgagccagctctgaaggcaacttttaatattacaatgattcatcatccaagttatgtggccctttccaacaattctctaggtcagtctgaaaaagaagatgtgaatggaagcaaatggactgttacaaccttttccactacgccccacatgccaacttacttagtcgcatttgttatatgtgactatgaccacatacgcatctgggcccggaaagatgcaattgcaaatggaagtgcagactttgctttgaacatcacaggtcccatcttctcttttctggaggatttgtttaatatcagttactctcttccaaaaacaggtgagttagatataattgccttgcctagttttgacaaccatgcaatggaaaactggggactaatgatatttgatgaatcaggattgttgttggaaccaaaagatcaactgacagaaaaaaagactctgatctcctatgttgtctcccacgagattggacaccaggcatgtggtaaacaaaagtggtttggaaacttggttaccatgaattggtggaacaatatctggctcaacgagggttttgcatcttattttgagtttgaagtaattaactactttaatnnnggtgattttttaaaacaggccatagatgaccagagtacagttattttgccagcaacaataaaaaacataatggacagttggacacaccagagtggttttccagtgatcactttaaatgtgtctactggcgtcatgaaacaggagccattttatcttgaaaacattaaaaatcggtcagattctgaccatgactgggtgattttgaatttgaatatgactggatattatagagttaattatgataaattaggttggaagaaactaaatcaacaacttgaaaaggatcctaagctgcgtgttggttgggccttgaagactgccttcagctgtcaaaagaacttttcgcaaaatgggtggatcatccagaaaatgccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaanngtatggaacacaatcattgattaatctaatatatacaatagggagaaccgtaactacagatttacagattgtggag

SEQ ID NO: 21005 - DNA, 495 bp, Homo sapiens
atggtcaaccccaccgtgttcctcgacatcgctgtccacggtgagcccttgggtggtatccccttcgagctgtttgcagacaagatcccaaagacaccagaaaactttcatgctctaagcactggagaaaaaggatttggttataagggttcctgctttcacagaattattcccggggttatgtgtcagcgtggtgacttcacaagtcataatggcactggtggcaagtccatccaaggggagaaatttgatgacaagaacttcatcctaaagcacgcaggtcctggcatcttgtccatggcaaatactggacccaacacaaacagtttccagtgtttcatctgcactgccaaggctgagtggttggatggcaagcatgtggtctttggcaaggtgaaagaaggcataaatattgtcgaggccatggagcgctttgggtccaggaatggcaagaccagcaagaagatcaccatttctgactgtggaaaactctaa

SEQ ID NO: 21006 - DNA, 5907 bp, Homo sapiens
  misc_feature (1)...(5907): n = A,T,C or G
atggattttttaaaaatagaaccagggcctccagtcttcctagccggggaaagagtcggatctgctgggattcttctgtcttggaatacaccacctaatccaaatggaaggattatatcttacattgtcaaatataaggaagtttgtccgtggatgcaaacagtatatacacaagtcagatcaaagccagacagtctggaagttcttcttactaatcttaatcctggaacaacatatgaaattaaggagaatagtgaatcttttttatggagtacagccagcccttctccaacccttggtagagttacacctccatcgcgtaccacacattcatcaagcacgttgacacagaatgagatcagctctgtgtggaaagagcctatcagttttgtagtgacacacttgagaccttatacaacatatctttttgaagtttcagctgctacaactgaagcaggttatattgatagtacgattgtcagaacaccagaatcagtgcctgaaggaccaccacaaaactgcgtaacaggcaacatcacaggaaagtccttttcaattttatgggacccaccaactatagtaacagggaaatttagttatagagttgaattatatggaccatcaggtcgcattttggataacagcacaaaagacctcaagtttgcattcactaacctaacaccatttacaatgtatgatgtctatattgcggctgaaaccagtgcagggactgggcccaagtcaaatatttcagtattcactccaccagatgttccaggggcagtgtttgatttacaacttgcagaggtagaatccacgcaagtaagaattacttggaagaaaccacgacaaccaaatggaattattaaccaataccgagtgaaagtgctagttccagagacaggaataattttggaaaatactttgctcactggaaataatgagtatataaatgaccccatggctccagaaattgtgaacatagtacagccaatggtaggattatatgagggttcagcagagatgtcgtctgaccttcactcacttgctacatttatatataacagccatccagataaaaactttcctgcaaggaatagagctgaagaccagacttcaccagttgngacattaaacagtttgtctcttgtccttatagggttaaagaaatacacaaaatacaaaatgagagtggcagcctcaacccacgttggagaaagttctttgtctgaagaaaatgacatctttgtgagaacttcagaagatgaaccggaatcatcacctcaagatgtcgaagtaattgatgttaccgcagatgaaataaggttgaagtggtcaccacccgaaaagcccaatgggatcattattgcttatgaagtgctatataaaaatatagatactttatatatgaagaacacatcaacaacagacataatattaaggaacttaagacctcacaccctctataacatttctgtaaggtcttacaccagatttggtcatggcaatcaggtatcttctttactctctgtaaggacttcggagactgtgcctgatagtgcaccagaaaatatcacttacaaaaatatttcttctggagagattgagctatcattccttcccccaagtagtcccaatggaatcatacaaaaatatacaatttatctcaagagaagtaatggaaatgaggaaagaactataaatacaacctctttaacccaaaacattactcctgattctccccctcaagacttctctgtaaaacagttgtctggtgtcacggtgaagttgtcatggcaaccacccctggagccaaatggaattatcctttattacacagtttatgtctggaatagatcatcattaaaaactattaatgtcactgaaacatcattggagttatcagatttggattataatgttgaatacagtgcttatgtaacagctagcaccagatttggtgatgggaaaacaagaagcaatatcattagctttcaaacaccagagggagcaccaagcgatcctcccaaagatgtttattatgcaaacctcagttcttcatcaataattcttttctggacacctccttcaaaacctaatgggattatacaatattactctgtttattacagaaatacttcaggtacttttatgcagaattttacactccatgaagtaaccaatgactttgacaatatgactgtatccacaattatagataaactgacaatattcagctactatacattttggttaacagcaagtacttcagttggaaatgggaataaaagcagtgacatcattgaagtatacacagatcaagacatacctgaagggtttgttggaaacctgacttacgaatccatttcgtcaactgcaataaatgtaagctgggtcccaccggctcaaccaaacggtctagtcttctactatgtttcactgatcttacagcagactcctcgccatgtgagaccacctcttgttacatatgagagaagcatatattttgataatctggaaaaatacactgattatatattaaaaattactccatcaacagaaaagggattctctgatacctatactgcccagctatacatcaagactgaagaagatgtcccagaaacttcaccaataatcaacacttttaaaaacctttcctctacctcagttctcttatcatgggatcccccagtaaagccaaatggtgcaataataagttatgatttaactttacaaggaccaaatgaaaattattctttcattacttctgataattacataatattggaagagctttcaccatttacattatatagcttttttgctgccgcaagaactagaaaaggacttggtccttccagtattcttttcttttacacagatgagtcagtgccgttagcacctccacaaaatttgactttaatcaactgtacttcagactttgtatggctgaaatggagcccaagtcctcttccaggtggtattgttaaagtatatagttttaaaattcatgaacatgaaactgacactatatattataagaatatatcaggatttaaaactgaagccaaacttgttggactggaaccagtcagcacctactctatccgtgtatctgcgttcaccaaagttggaaatggcaatcaatttagtaatgtagtaaaattcacaacccaagaatcagttccagatgtcgtgcagaatatgcagtgcatggcaactagctggcagtcagttttagtgaaatgggatccacccaaaaaggcaaatggaataataacgcagtatatggtaacagttgaaaggaattctacaaaagtttctccccaagatcacatgtacactttcataaagcttcttgccaatacctcatatgtctttaaagtaagagcttcaacctcagctggtgaaggtgatgaaagcacatgccatgtcagcacactacctgaaacagntgttcccacaaatattgctttttctgatgttcagtcaactagtgcaacattgacatggataagacctgacactatccttggctactttcaaaattacaaaattaccactcaacttcgtgctcaaaaatgcaaagaatgggaatccgaagaatgtgttgaatatcaaaaaattcaatacctctatgaagctcacttaactgaagagacagtatatggattaaagaaatttagatggtatagattccaagtggctgccagcaccaatgctggctatggcaatgcttcaaactggatttctacaaaaactctgcctggccctccagatggtcctcctgaaaatgttcatgtagtagcaacatcaccttttagcatcagcataagctggagtgaacctgctgtcattactggaccaacatgttatctgattgatgtcaaatcggtagataatgatgaatttaatatatccttcatcaagtcaaatgaagaaaataaaaccatagaaattaaagatttagaaatattcacaaggtattctgtagtgatcactgcatttactgggaacattagtgctgcatatgtagaagggaagtcaagtgctgaaatgattgttactactttagaatcagccccaaaggacccacctaacaacatgacatttcagaagataccagatgaagttacaaaatttcaattaacgttccttcctccttctcaacctaatggaaatatccaagtatatcaagctctggtttaccgagaagatgatcctactgctgtccagattcacaacctcagtattatacagaaaaccaacacattcgtcattgcaatgctagaaggactaaaaggtggacatacatacaatatcagtgtttacgcagtcaatagtgctggtgcaggtccaaaggttccgatgagaataaccatggatatcaaagctccagcacgaccaaaaaccaaaccaacccctatttatgatgccacaggaaaactgcttgtgacttcaacaacaattacaatcagaatgccaatatgttactacagtgatgatcatggaccaataaaaaatgtacaagtgcttgtgacagaaacaggagctcagcatgatggaaatgtaacaaagtggtatgatgcatattttaataaagcaaggccatattttacaaatgaaggctttcctaaccctccatgtacagaaggaaagacaaagtttagtggcaatgaagaaatctacatcataggtgctgataatgcatgcatgattcctggcaatgaagacaaaatttgcaatggaccactgaaaccaaaaaagcaatacttgggaaggactttcagaaagaaccgtagagatcattctttccgtcactttgtgtatcctttcaataattctccttggaacagctatttttgcatttgcaagnnaattcgacagaagcagaaagaaggtggcacatactctcctcaggatgcagaaattattgacactaaattgaagctggatcagctcatcacagtggcagacctggaactgaaggacgagagattaacgcggccaataagcaagaaatccttcctgcaacatgttgaagagctttgcacaaacaacaacctaaagtttcaagaagaattttcggaattaccaaaatttcttcaggatctttcttcaactgatgctgatctgccttggaatagagcaaaaaaccgcttcccaaacataaaaccatnnggttatttatgtccaaatgaatttattgctactcaaggtccactaccaggaacagttggagatttttggagaatggtgtgggaaaccagagcaaaaacattagtaatgctaacacagtgttttgaaaaaggacggatcagatgccatcagtattggccagaggacaacaagccagttactgtctttggagatatagtgattacaaagctaatggaggatgttcaaatagattggactatcagggatctgaaaattgaaaggcatggggattgcatgactgttcgacagtgtaactttactgcctggccagagcatggggttcctgagaacagcgcccctctaattcactttgtgaagttggttcgagcaagcagggcacatgacaccacacctatgattgttcactgcagtgctggagttggaagaactggagtttttattgctctggaccatttaacacaacatataaatgaccatgattttgtggatatatatggactagtagctgaactgagaagtgaaagaatgtgcatggtgcagaatctggcacagtatatctttttacaccagtgcattctggatctcttatcaaataagggaagtaatcagcccatctgttttgttaactattcagcacttcagaagatggactctttggacgccatggaaggtaaacagaaacaacagtatatgcccagcttactagtttaccacctacggtaa

SEQ ID NO: 21007 - DNA, 498 bp, Homo sapiens
atggtcaaccccaccgtgttcttccacatctctgtcgacggtgagtccttgggccgcatctcttttgagctgtttgcagacaagtttccaaagacagcagaaaacttttgtgctctgaatactggagagaaaggatttggttacaagggttgctgctttcacagaattattccagggtttatgtgtcatggtggtgacttcacacaccataatggcactggtggcaagtcaatctacggggagaaagttgatgatgacaacttcatcctgaagcatacaggtcctggcatattgtccatggcaaatgctggacccaacacaaatggttcccagtttttcatctgcactgccaagtctgagtggttggatagcaagcatgtggtcattggcaaggtgaaagaaggcatgaatattgtggaggccatggagcactttgggtccaggaatggcaagaccagcaagaaggtcaccattcctgactttggacaactcgaataa

SEQ ID NO: 21008 - DNA, 2721 bp, Homo sapiens
  misc_feature (1)...(2721): n = A,T,C or G
atggcattcttaattatactaattacctgctttgtgattattcttgctacttcacagccttgccagacccctgatgactttgtggctgccacttctccgggacatatcataattggaggtttgtttgctattcatgaaaaaatgttgtcctcagaagactctcccagacgaccacaaatccaggagtgtgttggnnctttgaaatatcagtttttcttcaaactcttgccnatgatacacagcattgagatgatcaacaattcaacactcttacctggagtcaaactggggtatgaaatctatgacacttgtacagaagtcacagtggcaatggcagccactctgaggtttctttctaaattcaactgctccagagaaactgtggagtttaagtgtgactattccagctacatgccaagagttaaggctgtcataggttctgggtactcagaaataactatggctgtctccaggatgttgaatttacagctcatgccacagcaggtgggttatgaatcaactgcagaaatcctgagtgacaaaattcgctttccttcatttttacggactgtgcccagtgacttccatcaaattaaagcaatggctcacctgattcagaaatctggttggaactggattggcatcataaccacagatgatgactatggacgattggctcttaacacttttataattcaggctgaagcaaataacgtgtgcatagccttcaaagaggttcttccagcctttctttcagataataccattgaagtcagaatcaatcggacactgaagaaaatcattttagaagcccaggttaatgtcattgtggtatttctgaggcaattccatgtttttgatctcttcaataaagccattgaaatgaatataaataagatgtggattgctagtgataattggtcaactgccaccaagattaccaccattcctaatgttaaaaagattggcaaagttgtagggtttgcctttagaagagggaatatatcctctttccattcctttcttcaaaatctgcacttgcttcccagtgacagtcacaaactcttacatgaatatgccatgcatttatctgcctgcgcatatgtcaaggacactgatttgagtcaatgcatattcaatcattctcaaaggactttggcctacaaggctaacaaggctatagaaaggaacttcgtcatgagaaatgacttcctctgggactatgctgagccaggactcattcatagtattcagcttgcagtgtttgcccttggttatgccattcgggatctgtgtcaagctcgtgactgtcagaaccccaacgcctttcaaccatgggagttacttggtgtgctaaaaaatgtgacattcactgatggatggaattcatttcattttgatgctcacggggatttaaatactggatatgatgttgtgctctggaaggagatcaatggacacatgactgtcactaagatggcagaatatgacctacagaatgatgtcttcatcatcccagatcaggaaacaaaaaattctaaatgctccaaggaatgcagtcctgggcaaatgaagaaaactacaagaagtcaacacatctgttgctatgaatgtcagaactgtcctgaaaatcattacactaatcagacatgggcccctgttaggagcactatgtgctttgaaaaggaagtggaatatctcaactggaatgactccttggccatcctactcctgattctctccctactgggaatcatatttgttctggttgttggcataatatttacaagaaacctgaacacacctgttgtgaaatcatccgggggattaagagtctgctatgtgatccttctctgtcatttcctcaattttgccagcacgagctttttcattggagaaccacaagacttcacatgtaaaaccaggcagacaatgtttggagtgagctttactctttgcatctcctgcattttgacgaagtctctgaaaattttgctagccttcagctttgatcccaaattacagaaatttctgaagtgcctctatagaccgatccttattatcttcacttgcacgggcatccaggttgtcatttgcacactctggctaatctttgcagcacctactgtagaggtgaatgtctccttgcccagagtcatcatcctggagtgtgaggagggatccatacttgcatttggcaccatgctgggctacattgccatcctggccttcatttgcttcatatttgctttcaaaggcaaatatgagaattacaatgaagccaaattcattacatttggcatgctcatttacttcatagcttggatcacattcatccctatctatgctaccacatttggcaaatatgtaccagctgtggagattattgtcatattaatatctaactatggaatcctgtattgcacattcatccccaaatgctatgttattatttgtaagcaagagattaacacaaagtctgcctttctcaagatgatctacagttattcttcccatagtgtgagcagcattgccctgagtcctgcttcactggactccatgagcggcaatgtcacaatgaccaatcccagctctagtggcaagtctgcaacctggcagaaaagcaaagatcttcaggcacaagcatttgcacacatatgcagggaaaatgccacaagtgtatctaaaactttgcctcgaaaaagaatgtcaagtatatga

SEQ ID NO: 21009 - DNA, 966 bp, Homo sapiens
atgtctggggacaacagctccagcctgaccccaggattctttatcttgaatggcgttcctgggctggaagccacacacatctggatctccctgccattctgctttatgtacatcattgctgtcgtggggaactgtgggctcatctgcctcatcagccatgaggaggccctgcaccggcccatgtactacttcctggccctgctctccttcactgatgtcaccttgtgcaccaccatggtacctaatatgctgtgcatattctggttcaacctcaaggagattgactttaacgcctgcctggcccagatgttttttgtccatatgctgacagggatggagtctggggtgctcatgctcatggccctggaccgctatgtggccatctgctaccccttacgctatgccaccatccttaccaaccctgtcatcgccaaggctggtcttgccaccttcttgaggaatgtgatgctcatcatcccattcactctcctcaccaagcgcctgccctattgccgggggaacttcatcccccacacctactgtgaccatatgtctgtggccaaggtatcctgtggcaatttcaaggtcaatgctatttatggtctgatggttgctctcctgattggtgtgtttgatatctgctgtatctctgtatcttacactatgattttgcaggctgttatgagcctgtcatcagcagatgctcgtcacaaagccttcagcacctgcacatctcacatgtgttccattgtgatcacctatgttgctgcttttttcacttttttcactcatcgttttgtaggacacaatatcccaaaccacatacacatcatcgtggccaacctttatctgctactgcctcctaccatgaacccaattgtttatggagtcaagaccaagcagattcaggaaggtgtaattaaatttttacttggagacaaggttagttttacctatgacaaatga

SEQ ID NO: 21010 - DNA, 5280 bp, Homo sapiens
  misc_feature (1)...(5280): n = A,T,C or G
atggattgggagagccgctgctgctgcccaggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgactccagtcgtgtccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaggccattgtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatggagaatatgttgatgagcatggccactgccagacctgtgaggcctcatgtgccaagtgccagggaccaacccaggaagactgcactacctgccccatgacanngatttttgatgatggccgctgtgtttcgaactgcccctcatggaaatttgaatttgagaaccaatgccatccatgccaccacacctgccagagatgccaaggaagtggccctacccactgcacctcctgtggagcagacaactatggccgagagcacttcctgtaccagggagagtgtggagatagctgcccagagggccactatgccactgaggggaacacctgcctgccctgcccagacaactgtgagctttgccacagcgtgcatgtctgcacaagatgcatgaagggctacttcatagcgcccaccaaccacacatgccagaagttagagtgtggacaaggtgaagtccaagacccagactatgaagaatgtgtcccttgtgaagaaggatgtctgggatgcagctttgatcaccattgttataaaacctgtcctgagaagacctacagtgaggcagtggaatgcaaggcgtgtgatagtaactgtagcagctgtgaccagaatgggtgttactggtgtgaagagggcttctttctcttaggtggcagttgtgtgaggaaatgtggtcctggattctatggtgaccaagaaatgggagaatgtgagtcctgccaccgagcatgcgaaacctgcacaggccctggtcatgacgagtgcagcagctgccaggaaggactgcagctgctgcgtgggatgtgcgtgcatgccaccaagacccaggaggagggcaaattctggaatgaagctgtgtccactgcaaacctatctgtggtgaagagcctgctgcaggagcgacgaaggtggaaagttcaaatcaaaagagatattttgagaaaactccagccttgtcattcttcttgtaaaacctgcaatggatctgcaactctgtgcacttcatgtgcatatcttctggctcaggcctgtgtttcctcctgtccccaaggcacatggccttccgtaaggagtgggagctgcgagaactgtacggaggcctgtgccatctgctctggagccgatctttgcaaaaaatgccagatgcagccgggccaccctctcttcctccatgaaggcaggtgctactccaagtgcccggagggctcttatgcagaagacgacatatgtgaacgctgtagctctccttgcagaacatgtgaaggaaacgccaccaactgccattcttgtgaaggaggccacgtcctgcaccacggagtgtgccaggaaaactgccccgagaggcacgtggctgtggagggggtatgcaagcattgcccagagatgtgtcaggactgcatccatgagaaaacatgcaaagagtgcacgcctgagttcttcctgcacgatgatatgtgccaccagtcctgtccccgtggcttctatgcagactcgcgccactgtgtcccctgccataaagactgtctggagtgcagtggccccaaagccgacgactgcgagctctgtcttgagagttcctgggtcctctatgatggactgtgcttggaggagtgtccagcaggaacctattatgaaaaggagactaaggagtgcagannctcttgcaggacatgtgaagggagacacagcaggcagtgccactcctgccgaccgggctggttccagctaggaaaagagtgcctgctccagtgcagggaagggtattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgaaaaggagcgttgaattgtttatcctgtgtgtggagttaccacctcatgggagggatctgcacctcggactgtcttgtgggggaatacagacagggagagaagtttaactgtgaaaaatgccacgagagctgcatggaatgcaagggaccaggggccaagaactgcaccttgtgccctgccaacctggtgctgcacatggacgacagccactgcctccactgctgcaacacctctgatccccccagtgcccaggagtgctgtgactgccaggacaccacggacgaatgcatccttcgaacaagcaaggttaggcctgcaactgagcatttcaagacagctctgttcatcacctcctccatgatgctggtgcttctgctcggggcagctgtggtagtgtggaagaaatctcgtggccgagtccagccagcagcaaaggccggctatgaaaaactggccgaccccaacaagtcttactcctcctataagagcagctatagagagagcaccagctttgaagaggatcaggtgattgagtacagggatcgggactatgatgaggatgatgatgatgacatcgtctacatgggccaggatggcacagtctaccggaaatttaaatatgggctgctggatgacgatgacatagatgagctggaatatgatgacgagagttactcctactaccagtaa

SEQ ID NO: 21011 - DNA, 975 bp, Homo sapiens
agatatgacatcaaagctcttattgggacaggcagtttcagcagggttgtcagggtagagcagaagaccaccaagaaaccttttgcaataaaagtgatggaaaccagagagagggaaggtagagaagcgtgcgtgtctgagctgagcgtcctgcggcgggttagccatcgttacattgtccagctcatggagatctttgagactgaggatcaagtttacatggtaatggagctggctaccggaggggagctctttgatcgactcattgctcagggatcctttacagagcgggatgccgtcaggatcctccagatggttgctgatgggattaggtatttgcatgcgctgcagataactcataggaatctaaagcctgaaaacctcttatactatcatccaggtgaagagtcgaaaattttaattacagattttggtttggcatactccgggaaaaaaagtggtgactggacaatgaagacactctgtgggaccccagagtacatagctcctgaggttttgctaaggaagccttataccagtgcagtggacatgtgggctcttggtgtgatcacatatgctttacttagcggattcctgccttttgatgatgaaagccagacaaggctttacaggaagattctgaaaggcaaatataattatacaggagagccttggccaagcatttcccacttggcgaaggactttatagacaaactactgattttggaggctggtcatcgcatgtcagctggccaggccctggaccatccctgggtgatcaccatggctgcagggtcttccatgaagaatctccagagggccatatcccgaaacctcatgcagagggcctctccccactctcagagtcctggatctgcacagtcttctaagtcacattattctcacaaatccaggcatatgtggagcaagagaaacttaaggatagtagaatcgccactgtctgcgcttttgtaa

SEQ ID NO: 21012 - DNA, 1107 bp, Homo sapiens
  misc_feature (1)...(1107): n = A,T,C or G
atggacagcgtgcccctcatctgtgactacggctctggcttcagcaaggtgggatttgcaggaatggaaagcccaatgggcatgttccccactgtcctcgggaaacttcggcacgataatgtattggtggggatggaagaggaagactggttcattggagaggaggttcagaaaaaacgagggaaactcaacctgcaataccccatttctcgggcaataacaaccaactgggacaacatggagaagatttggcaccactccttctaccaggtgctccacgtcgccccagagcagtaccccatgttggtgacggagccgtctttgaacccaacacccagcaaagagaaagtcacacaggtgctgtttgagattttcaacatacctgccctgtatttagctaaccgaggagtcctttctctgtacgcctctggccagaccttcggcatgactgttgaatctggagaaggaatgacacacttcgtgcccatcgctgatggctgtcctttgcatcagtcaaccttccaggtggacatagcgggccaggacctaacctcgtacctcctgcaactgttgaaagacaatgtgcaattattggtgggcacaggggatcgagagtacatccgggacatgaaggagaaatgctgctatgtggctttggactttgacaaggaaaagatgaaaactgattcaccttcatgccaacagaaatatcagctgcctgatggccaagagatcaccgttgggcaggagagcttcttctgccccgaggtgctcttctannggaaaaacacccctggcatccacacgaaggccatccagagcatcacttcctgcaaccccgacctccagaaggttctctttggccacatgctactgtccggagggacgggctcctgccccggcttgcgattccggatgcagagagaaatatctgagctggtgtcccctacagtttatgtgaaggtggccacctgtccgtattctgtctatggagcttgggtaggtggctccatcttgtgctcactctccacgttcaaggatatgtgggtcaccagcaaggagtacaaggagatgggctcttccatcatcagtagaaaaagcttctga

SEQ ID NO: 21013 - DNA, 2589 bp, Homo sapiens
  misc_feature (1)...(2589): n = A,T,C or G
ctgcgcctggcgggcgggcggagccgctgtgagggccgggtagagctgcggcaccagggcgtgtggggcacggtgtgcgacgaccactggaacatcaggaacgcccgtgtggtgtgccgcctcctgggttgcggccgtgctctgggcgccccgggccgcggccgctttggccagggcaccgggcccatcctgctggacgacgtgcgctgcaccggccacgagaacgcgctggagcgctgcacccactcgggctgggcccggcacaactgccagcaccgcgaggacgcgggcgtggtgtgcgcaggtatcgcgtcctctgcccaccctgccgacgacctctggaatctggccaaggccactgtcgtgtgccgccagctacagtgtggacgggctgtggcagccccaacaggggctcacttcggggcaggctctgggaaaatcctgctggatgacgtgcagtgtgtggggagcgagagccacctggggcagtgcgtgcatgggggccgggccaggcacaactgtgggcacctggaggatgccagtgtcatctgttcannnccactccccagtgtccctacttcttgtgcctccccaggagcctggatggaggtgaggctgctgaacggcacaggaaggtgctcaggccgtgtggaagttctcgtccagggcacgtgggggaccgtgtgtgatgatctctgggacctggctgaggccactgtcgtgtgccgccagctgcagtgtggccaggctgtggcagcccccacaggggcccactttcgggcaggctctgggaagatcttactggatgacatgcagtgtgtgggcagtgagagccatctgggtcaatgcatgcgtggggaccaggccaggcacaactgtgggcacctggaggatgccagtgtcatctgcacaatggaggtgaggctgctgaatggcacagggaggtgcttaggccgcgtggaggttctcatccagggcacgtgggggacggtgtgtgaccacttctggaacctggccgaggccgccgttgtgtgccgccagctgcaatgtggccaggccatggcagcccacttcggggcaagctctgggaaagtcctgctggatgacatgcagtgtgtgggcagcaagagccacctggggcggtgcgtgcacaggggctgggccaggcacaactgtgggcacctggaggatgccagtgtcatctgtgcaggtgagggtctggttgtcaatcttcatctgcagctggtgggtggctctggccggtgctcaggacgcgtggagattctccaccagggcgcctggggcaccgtgtgtgatgacctgtgggacctgaacgaagctgaggttgtgtgccggcagcttgggtgtggtcgagccatgtctgcccttggaaaggcccactttggccccggctcaggagacatcttcctggacaacctccagtgcgctggtgtggagcgctacctgggccagtgcacccactcgggctggtcagagcacaacctgaggctgatgggcggctcaggccggtgcttggggcgcgtggagattctccaccagggtgcctggggcaccgtgtgcgacgacctgtgggacctgaatgaagccaaggttgtgtgccggcagttggggtgtgggcaggctgtttctggccctggcgaggcccactttggcccaggctcaggagacatcttcctggacaacctccagtgcactcgggtagagcactacctgggccagtgtacccacttgggctggtcagagcacaactgtggccaccacgaggatgccagtgtcatctgctcagaagatggaccagagttgcggctggtgggtggctctggccagtgctcaggacatggggaggtcctacacaagggctcctggggcactgtgtgtgatgacctgtgggatctgaatgaagctgaggttgtgtgccagcagctcgggtgtggtaaggccattgctgctcctggaaaggcccactttggcccaggttctggagacatccttctagacaacattcagtgttcaggaagtgagaaccaccttggccagtggcccagctccggctggtcagaccacaaccgtggccaccatgaggatgccaatgttgtctgctcaggtggcctctccctgggactgcggctggtgaacgggtccagcagatgtgagggccgagtcgaggtctaccatgccaatgcctggggcaccgtgtgtgatgacagctggtctatagaggatgcccacgtggtctgcaggcagctgggctgtggcctggccgtgtctgccctcccaggagccagcttcagccctggatcaggcagcatcctccttgatgacgtcaactgcacgggaagggagtcctccctggggcagtgccctcacagaggttggtacacccacaactgtgggcaccatgaagatgctggcgtcatctgctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaa

SEQ ID NO: 21014 - DNA, 2610 bp, Homo sapiens
  misc_feature (1)...(2610): n = A,T,C or G
gctcagaaatcctggatagaaagagcattttataaaagagaatgtgtccacatcatacccagcaccaaagacccccatagntatgtgcgagtatcttttgatacaaaacctgatctcctcttacacctgatgaccaaggaatggcagttggagctgcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcgggctgataaatgaatctttgagggaccagctgttggtgactatacagaagactttcacatacactcgaacccaagctcagcatctgttcatcatcctcatggagtgcatgaagaagaaggaattggtaggagccaatgcctcggccccagaccaactgagcttagctttagcctggaacagagtcgacatcgctcgcagccagatctttatttacggggtgggatctctggagcaagccatgttggatgccttagttctggacagagtggattttgtgaaattactcatagagaatggagtaagcatgcaccgttttctcaccatctccagactagaggaattgtacaatacgaacctgcccccagactacagaatcagcctgattgacatcggcctggtgatcgagtacctgatgggcggggcttatcgctgcaactacacgcgcaagcgcttccggaccctttaccacaacctcttcggccccaagaggnnggcgaggaagaaagacaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgatccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagcttgggggtcgccaggcaagccatcctttttcccaatgaggagccatcatggaaactggccaagaacatcttctacatgccctattggatgatttatggggaagtgtttgcggaccagatagac

SEQ ID NO: 21015 - DNA, 1644 bp, Homo sapiens
atgtctggaaataagtttcaagctatttcactgggacagggacaaggaccgattgcagcaaaaatgattaaagcagcaattgaagaaggaacttgggtgtgcctacagaattgccatcttgcagtgtcctggatgcccatgttggaaaaaatatgtgaagattttacctctgaaacctgtaactcatcctttaggctttggctgacaagctatccatcttcaaaattcccagtaacaattctacagaatggagtaaaaatgactaatgaacctcccacgggtcttcggctgaatctccttcaatcatatctcactgatccagtttctgatcctgagtttttcaagggatgccgtggaaaggaactggcctgggagaagttactgtttggagtttgtttttttcatgcccttgtgcaagagagaaagaaatttggtcctcttggttggaatattccatatggatttaatgaatctgacttgcgcatcagtatccgacaactgcagttatttatcaatgaatatgatacaattccatttgaagctatatcttacctgactggggagtgtaattatggaggaagagtgacagacgattgggacagacgtcttctattaaccatgctggctgacttttataatctgtacatagttgaaaaccctcattataagttttctcccagtggaaactattttgcacctcctaaaggcacttatgaggactacattgaattcattaagcttccatttactcaacaccctgagatatttggattacatgaaaacgttgacatctccaaggatcttcaacaaacaaaaaccctctttgagtccttgctcctcacccagggaggctccaaacagacaggagcctcaggaagtactgatcagattctgttagaaattaccaaagatatcctcaacaagctccctagtgatttcgacattgaaatggcactacggaagtatcctgtgagatatgaagaaagcatgaatactgtgttagtacaagaaatggaaagatttaacaatttaattataactatacgtaacactctacgggaccttgaaaaagctattaagggtgtggttgtgatggattctgcattggaggcactctccagtagcttacttgttggaaaggttccagaaatatgggccaaacgttcatacccaagccttaagcccctgggaagttacatcacagatttcctagcccggttgaactttttacaggcctttttaactggagctatgcagaattatgccagaaaatataccacccctattgatttgctaggatatgaatttgaggttatcccatctgatacatctgacacatcaccagaagatggtgtttatatccacggactgtatctcgatggcgcacgctgggaccgagaacttgctgaacaatatcccaaacttctgtttgacctgatgcccatcatatggataaaaccaagtaaatattctctctcggatgcctatgtctgtcccctctacaagacaagtgaacgtaaaggaactctttccactacgggacattctactaactttgtcattgcaatgttgttaaaaacagaccaacctactcggcactggatcaagcgcggggttgctttgctttgtcagttggatgactaa

SEQ ID NO: 21016 - DNA, 480 bp, Homo sapiens
atggtcaaccccaccaggttcttagacatcatcgtggatggtgagctcttgggacgtgtctcctttgagctgtttgcagacaagattccaaagacagcagaaaatttttgtgctctaatcattggagagaaaggatttggttataaaggttcctactttcacagaattgttcctgggtttatgtgtcagggtggtgacttcacacagcataatggcactggtggcaagtccatctacgggaagaaatttgatgatgagaacttcgtcctaaattatacaggtcctggcatcttgtccgtggagaatgtgctggacccaacacaaatggttcccagtttttcatctgcactgccatgtctgagtggttggatggcatgcaggtggtctttggcaagggaaggaaggcgtgagtattgtggaagccatggagtgctttgggtccacaaatggcaagaccagcaagaagatcaccattgctga

SEQ ID NO: 21017 - DNA, 522 bp, Homo sapiens
atggttaaccccaccgtgttcttcgacattgctgtcaacagcgagcccttgggccatgtctccttcaagctatttgcagacaaggttccaaagacagcagaaaactttcgtgctctgagcactggagagaaaggatttggttataagggttcctgctttcacagaattattccagggtttatgtgtcagggtggtgacttcacacaccataatggcactagcagcaagtccatctacggggagaaatttgatgatgagaacttcatcctaaagcatacaggtcctggcatcttgtccatggcaaatgctggacccaacacaaacagttcccagtttttcatctgcactgccaagactgagtggttggatggcaagcatgtggtctttggcaaggcgaaagaaggcatgaatattgtggaggccatagagcactttgggtccaggaatggcaagaccagcaagaagatcaccactgctgactgtggacaactcttaataagtttgacttgtgttttatcttag

SEQ ID NO: 21018 - DNA, 1179 bp, Homo sapiens
  misc_feature (1)...(1179): n = A,T,C or G
cggctccagccgacgctgttgctggcgacactgagcgcggcctttggctcagccttccagtacggctacaacctctctgtggtcaacacgccgnnncaggtcttcaagtcattttacaacgaaacctactttgagcgacacgaacattcannnatgctgcttctatggtcttgcaccgtctccatgtttcctctgggcggcctgttggggtcattgctcgtgggcctgctggttgatagctgcggcaggnnnaaaggggacctgctgatcaacaacatctttgccatcatccccgccatcctgatgggagtcagcaaagtggccaaggcttttgagctgatcgtcttttcccgagtggtgctgggagtctgtgcaggtnnngctctgaggaggctgagaggccacacggacatggaggccgagctggaggacatgcgtgcggaggcccgggccgagcgcgccgagggccacctgtctgtgctgcacctctgtgccctgcggtccctgcgctggcagctcctctccatcatcgtgctcatggccggccagcagctgtcgggcatcaatgcgnnnatcaactactatgcggacaccatctacacatctgcgggcgtggaggccgctcactcccaatatgtaacggtgggctctggcgtcgtcaacatagtgatgaccatcacctcggtgnnncttgtggagcggctgggacggcggcacctcctgctggccggctacggcatctgcggctctgcctgcctggtgctgacggtggtgctcctattccagnnnaacagggtccccgagctgtcctacctcggcatcatctgtgtctttgcctacatcgcgggacattccattgggcccannngtcctgtcccctcggtggtgaggaccgagatcttcctgcagtcctcccggcgggcagctttcatggtggacggggcagtgcactggctcaccaacttcatcataggcttcctgttcccatccatccaggtgagtgagggccccnnnttcatcatctttgccggaatctgcctcctcactgcgatttacatctacgtggttattccggagaccaagggcaaaacatttgtggagataaaccgcatttttgccaagagaaacagggtgaagcttccagaggagaaagaagaaaccattgatgctgggcctccc

SEQ ID NO: 21019 - DNA, 918 bp, Homo sapiens
atgcagaggagcaatcatacagtgactgagtttatactgctgggcttcaccacagacccaggaatgcagctgggcctcttcgtggtgttcctgggcgtgtactctctcactgtggtaggaaatagcaccctcatcgtgttgatctgtaatgactcctgcctccacacacccatgtattttttcactggaaatctgtcgtttctggatctctggtattcttctgtctacaccccaaagatcctagtgacctgcatctctgaagacaaaagcatctcctttgctggctgcctgtgtcagttcttcttctctgcagggctggcctatagtgagtgctacctgctggctgccgtggcttatgaccgctacgtggccatctccaagcccctgctttatgcccaggccatgtccataaagctgtgtgcattgctggtagcagtctcatattgtggtggctttattaactcttcaatcatcaccaagaaaacgttttcctttaacttctgccgtgaaaacatcattgatgactttttctgtgatttgcttcccttggtggagctggcctgtggcgagaagggcggctataaaattatgatgtacttcctgctggcctccaatgtcatctgccccgcagtgctcatcctggcctcctacctctttatcatcaccagtgtcttgaggatctcctcctccaagggctacctcaaagccttctccacatgctcctcccacctgacctctgtcactttatactatggctccattctctacatctacgctctccccagatctagctattcttttgatatggacaaaatagtttctacattttacactgtggtattccccatgttgaatctcatgatctacagcctaaggaataaggatgtgaaagaggctctgaaaaaacttctcccataa

SEQ ID NO: 21020 - DNA, 807 bp, Homo sapiens
atggatgacgaaaatgcaacattgctgacagagtttgttctcacaggacttacatatcaatcagagtggaaaatacccctgttcctggcattcttggtaatatatctcatcaccatcatggcaaatcttggtctgattgctgtcatctggaaagactcacaccttcacattccaatgtacttattccttgggagtttagcctttgtggatgcttggttatcatcctcagtgacccctaagatgctgatcagctttttagctaagagtatgattatttctgtctctgaatgcaagatacaatttttttcctttggaatcagtggaaccacagaatgttttctcttggcaacaatggcatatgatcgctatgtagccatatgcaaacctttactttatccagtcattatgaccaatggactgtgtatctggctattagtcttgtcatttataggtggctttcttcatgccttaattcatgaaggtattttattcagattaaccttctgtaattccaacataatacatcacttttactgtgacattatcccattgttaaagatttcctgtactgacccttctattaattttttaatgctttttattttgtctggttcaatacaggtattcactattttgactgttcttgtctcttatacatttgtcctctttacaatcttaaaaaaaaaagtctgccaaagacataaggaaagccttttccacctgtggagcccatctcttatctgtttctttatactatggcccccttctcttcatgtatgtgcaccctgcatctccacaagcagatga

SEQ ID NO: 21021 - DNA, 2790 bp, Homo sapiens
atgggggcccggagcggagctcggggcgcgctgctgctggcactgctgctctgctgggacccgaggctgagccaagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggcctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctacctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaagggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctga

SEQ ID NO: 21022 - DNA, 1363 bp, Homo sapiens
tgccaaaaaggatattttccctgtgggaatcttaccaagtgcttaccccgagcttttcactgtgatggcaaggatgactgtgggaacggggcggacgaagagaactgtggtgaggtatcattgctgcaaagtgacactttttttccctttgactttagttatttcaaaaactttcgatactgctcctatgctccccatgtccgaatatgtatgcccttgacggacggcatttcttcatttgaggacctcttggctaacaatatcctcagaatatttgtctgggttatagctttcattacctgctttggaaatctttttgtcattggcatgagatctttcattaaagctgaaaatacaactcacgctatgtccatcaaaatcctttgttgtaagtatgtttccagtataagtagattaaggatatcttctgtgagttgtgcactagacatatatatgtatttattggctgattgcctgatgggtgtttacttgttctttgttggcattttcgatataaaataccgagggcagtatcagaagtatgccttgctgtggatggagagcgtgcagtgccgcctcatggggttcctggccatgctgtccaccgaagtctctgttctgctactgacctacttgactttggagaagttcctggtcattgtcttccccttcagtaacattcgacctggaaaacggcagacctcagtcatcctcatttgcatctggatggcgggatttttaatagctgtaattccattttggaataaggattattttggaaacttttatgggaaaaatggagtatgtttcccactttattatgaccaaacagaagatattggaagcaaagggtattctcttggaattttcctaggtgtgaacttgctggcttttctcatcattgtgttttcctatattactatgttctgttccattcaaaaaaccgccttgcagaccacagaagtaaggaattgttttggaagagaggtggctgttgcaaatcgtttcttttttatagtgttctctgatgccatctgctggattcctgtatttgtagttaaaatcctttccctcccagacacaatgacttcctggatagtgatttttttccttccagttaacagtgctttgaatccaatcctctatactctcacaaccaacttttttaaggacaagttgaaacagctgctgcacaaacatcagaggaaatcaattttcaaaattaaaaaaaaaagtttatctacatccattgtgtggatagaggactcctcttccctgaaacttggggttttgaacaaaataacacttggagacagtataatgaaaccagtttcctagcaatcattttggatcactggacttt

SEQ ID NO: 21023 - DNA, 1136 bp, Homo sapiens
atgccttctcctgagattcaacttggatttaagctcagagaggatctgcaagagcaaatgaataaaaataagatgatgcctgttcttagcgaggatacaatattacagtctcaagatgaaactgaacgaaatcaagctctgttacagactaggaaaaactgttcaatgttcattgggtcgtttcgccagtctggactttcattgaaccaccaaaatattgaagggccagaggctgaaagtcctgaagttttgccacacatagaaaagactctgcaagacccaaatccatctggattgcaaactttggctcatcaaaatatcacttcttgtgagccactaagtaataagagaaattcaaattcagtgacaaatagctctgatcaggaaactgcgtgtgtgttgaggagatcatccagactagaaaaactgaaagtaagcagagatgcagagtactcagatcacatgtataagatgccagaaaagattttaccaaaaatccttggctgtgaggacctaacaaataataactcttcagctcaraatttcagaatgcaggrtccggctttaatgattgatggtaaagagaagaatatgcattcagcaaggttcaagaatggaaaacagatcaggaaaaatgaacaattttcaggaaaaaaagaaaaaatgaaggtgaacaaaatatctcttcatagcattaaccggagaaacatttttggagagaacttagtatataaggctgctctacacgatgatgctgatcttgttcatcattgtataaaaaaaggaggaaatgttaatcagccaagttatgctggttggacagcacttcatgaagctagtgtaggaggattttatcggacagcaagtgaactattaaaaggtggagcagatgtaaatatcaaaggattataccagattactcccctacatgatgcagtgatgaatggacattataagctcaaaggagtagcattgacccactagacatagaggatgtgtaccaacacaagaaaccaaagttcagttctaaaagtcacatttggcatgtttataatgaaaattccaacagacagaagctggaacatgtaaaagtcaataaaggaagcaaagcgagtttatttataaataaagaaaga

SEQ ID NO: 21024 - DNA, 7735 bp, Homo sapiens
  misc_feature (1)...(7735): n = A,T,C or G
tgttccatggatccaatggaaggcgagtgtcaggatcacaccctgaagtggcattacaacaaggaggaacgggtttgccagcagttctggtgtggcagctgtggcttacagggaaccgccccccctggccacgccctggagtggacgctggagaatgtgctcctggcagcccctcggccgcggaaggcacaagtcctcttcgccatcgtggccagcgagacaagtagctgggacagggagaagctatggactctgtccctggaggccaaatgcaagggcattaccctctttgtgctggccttgggtccgggtgtggggacccatgagctagccgagctagccgagctggtcagtgctccctctgagcagcactgcacttccttcctagacaaatgcagaccagacccagaatgcccggctggcacgccggggccccaggaggtggacgtggacttggtatttgtggtggacagctcctatggagtggatgccgacgtgtaccgcgggtctttgagtctagcggacgccgcgctagaagacctggaggtggctgagcagccgggcgcgtcccaccgtggggcgcgtgtggccctggtgacgcacacgacacccaacttctggccgggtgtgggttgcctccctgtgctcgagggcttccacttgaccacctatggcaaccggaagcagatgcagagacatgtgcgcgaggcttcagccgccccttaaaatattgcagagaggacttgctgctgtacattctgcaaatgtccaggaattccaggacctcatgggacccgaggagattgctttatggacatagtggttgggtttgacatctccactcatgtgcaggggcagcctttgttccagggccacccccagctggaatcctacctcccaggcatcttagaagacatcagctctatcaagggggtgagctgtggggctggcacagaggcacaggtgagcttggcgtttaaggtgaacagtgaccaaggattccctgccaagttccaaatctatcagaaagcagtgtttgacagcttgctgcaagtcaacgtcagtgggccaactcatctgaacgcacagttcttgcggtctctttgggacacatttaaggataaatctgcatcccggggccaggtatccatatttcaggaagctgacgtgattttcctttgcgatggctctgacagggtatctaattcagattttgtaaccatgacaactttcttgtcagacttaatcgataattttgacattcagtctcaaagaatgaaaattggtatggctcaatttggaagcaactaccagagtattattgagttgaaaaactctctgactaaaacccagtggaagactcaaattcagaatgtctccaagagcggtggatttccaagaattgactttgcccttaaaaaagtgagcaatatgtttaatctacatgctggtgggagaagaaatgctggtgtcccccaaactttggttgttatcacatctggagatcctcgctatgatgtggcagatgcagtaaaaaccctgaaggaccttggaatttgtgtcctggttttgggcataggagatgtttataaggaacatctcctgccaataacaggcaattctgaaaaaataatcacttttcaagactttgataaattaaagaatgtggatgtgaaaaaaagaatcatccgtgaaaggattacactactagacgttgtgtttgtgctggatcattcaggtagcataaaaaaacaatatcaagatcacatgattaacctaactatccatttggtgaagaaagcagatgttggcagggaccgagttcagtttggagccctcaaatactctgaccaacctaacatccttttctaccttaatacatactcgaacagatcagcaataattgagaatctgcggaagcgcagggacactggagggaacacctacactgccaaggctctcaagcacgcaaatgccctgtttacagaggaacatggcagccgcatcaagcaaaatgtgaagcagatgctgattgtcatcaccgatggggaatcccatgaccatgatcagctcaatgacacagcattggaactgagaaacaaaggcatcaccatctttgcagtgggtgtaggaaaggccaaccaaaaggaacttgagggtatggcagggaataaaaacaatactatctatgtagataattttgacaaactgaaagatgttttcacacttgttcaagacatgtttctggtggacagttcttggagtataggaaatgaaaattttaggaaaacgaaaatcntcatgaaaaacctgttaactaaaattcaaattggtgcagacaaaacccagattggtgttgttcagttcagtgataaaactaaggaagagttccagcttaatagatattttacacagcaagaaatttctgatgcaatagatagaatgtctctcatcaatgaaggcactttaactggaaaggcactaaattttgtaggtcaatacttcacccactccaagggggcccgtttgggggccaaaaaatttctcatcctcatcacagatggagtagcgcaggatgatgtgagagatcctgctagaattcttcggggcaaagatgtgaccatcttctctgtaggagtatacaatgccaatagatctcagctagaagagatcagtggggatagcagcctagtttttcatgttgagaacttcgatcatctaaaggcactagaaaggaaacttattgtggatacaaaagaggctgatatccacttcctcattgatggctcaagcagcatccaggagaaacagtttgagcaaatcaagagatttatgttggaagtgacagaaatgtttagcattggcccagacaaagtccgagttggagttgtgcagtattcagatgacacagaagtggaattttatatcactgactattctaatgatattgacttaagaaaggctatttttaacattaagcaactaactggtggaacttatactgggaaagctctggattacatactgcaaataataaaaaatggaatgaaggatagaatgagcaaggttccctgttacctcattgtgttgactgatgggatgtccacagacagagtcgtggaacctgctaagagactaagggctgagcaaatcactgttcatgcagttggcattggggcagctaataaaatagaactgcaagaaattgctgggaaagaagaaagggttagctttgggcagaactttgatgctttgaaaagcataaaaaatgaagtcgttcgtgaaatctgcgctgaaaaaggtaagcaacacaaaaaaggctttattctccaccccatatcctgtcagaaagattcactcgctgacctcgtgttcctggtggatgagtcacttgggaccggaggaaatttaaggcatcttcagaccttccttgagaacattaccagctccatggatgtgaaggaaaattgcatgcgacttggactgatgagttacagcaatagtgccaagactatttcttttcttaaatcaagcacaacccaatctgaatttcagcagcaaatcaagaatctttctatccaagttgggaaatccaatacaggggctgccattgatcagatgagaagagacggcttctcagagtcatatggcagcagaagagcacaaggagtgcctcagattgcagttctggtcacccacagaccatcagatgatgaggtgcatgatgctgcgctgaaccttcgactggaggatgtaaacgtgtttgccttgagcatccaaggggctaacaatacccagttagaagaaatagtgtcttatcctccagaacagacaatttcagatgtcgtgtttctggtggacagctccgatcacctgggacctaagtcattcccattcgtgaaaacgttcatcaacaaaatgatcaacagtctccccatagaggccaacaaataccgtgtagccctggcccagtacagcgacgagtttcacagtgaattccatctgagcaccttcaaaggcagaagccccatgctgaaccacctcaagaagaactttcagttcattggcgggtccctgcagataggaaaggctcttcaggaggctcataggacctacttctctgcacccataaatgggagagacaggaaacagtttcccccaattttggtggtcctggcttcggctgagtctgaggatgaagtggaagaggcttcgaaagccctgcagaaagacggggtgaaaattatctccgtgggggtgcagaaagcttctgaggaaaatctgaaggccatggccacatcccatttccatttcaaccttcggacaatcagagacctcagcacattttcccaaaacatgacacagatcatcaaggatgttattttgatagggccaggccctgtgtatgcagatgtcgtgtttctggtggacagctccgatcacctgggacctaagtcattcccattcgtgaaaacgttcatcaacaaaatgatcaacagtctccccatagaggccaacaaataccgtgtagccctggcccagtacagcgacgagtttcacagtgaattccatctgagcaccttcaaaggcagaagccccatgctgaaccacctcaagaagaactttcagttcattggcgggtccctgcagataggaaaggctcttcaggaggctcataggacctacttctctgcacccataaatgggagagacaggaaacagtttcccccaattttggtggtcctggcttcggctgagtctgaggatgaagtggaagaggcttcgaaagccctgcagaaagacggggtgaaaattatctccgtgggggtgcagaaagcttctgaggaaaatctgaaggccatggccacatcccatttccatttcaaccttcggacaatcagagacctcagcacattttcccaaaacatgacacagatcatcaaggatgtaacnaaagctgacatcatgtttctggtggacagttctggaagtataggacctgaaaacttcagcaaaatgaaaacatttatgaaaaacctggtgagcaagtctcagattggaccagatcgggtgcaaattggtgtagtccagttcagcgacatcaataaggaagagtttcagctcaacagattcatgtcccaaagcgacatttcaaatgcaatagaccaaatggctcacattggacaaaccaccctgactggtagtgccctgagctttgtgtctcagtacttcagccccaccaagggcgcccggcccaacatcagaaagtttctcatcctcatcacggatggtgaagctcaggacatagtaaaggaaccagcagtagtgcttcggcaagaaggtgtaatcatctattctgtgggagtgtttggctccaatgtcacccagcttgaggagatcagtgggaggcccgagatggttttttatgttgagaattttgacattctgcagcgcattgaagatgatcttgatttccatgaaatgaagacgttcctgtcagaggtggtagggatgttcaacattgctccccataaggtgcgggttggggccgttcagtatgctgacagctgggacttggaatttgagatcaataaatactccaacaagcaggatttgggaaaggccattgagaatatcaggcagatgggtgggaatacaaacacaggcgcagcactgaatttcacactgagtctgttgcaaaaagcaaagaagcagcgaggaaacaaagttccatgccaccttgttgtcctgacaaatggcatgtccaaggatagcatcttggagcctgcaaacagactgagagaagagcacatccgagtttatgctatcgggatcaaggaggccaaccaaacacagctgagagaaattgcaggagaggaaaagagagtgtattacgtgcatgactttgatgcattgaaagacataagaaaccaagttgttcaagaaatctgtactgatgttgtgttcctattggatatgtcaatcaatggaagtgaggagaactntgactatcttaaaggattcttggaagaaagtgtatctgcccttgacataaaggaaaattgcatgagggttggccttgtggcctatagcaatgagacaaaagtgataaattcactgagcatgggcataaataagtcagaggttctccagcatatacagaacctttctccccgaactgggaaggcctatactggagctgccatcaaaaagctcaggaaggaagtttttagtgcacggaatggcagtcggaagaatcagggggtgccccagattgccgtgctggtgacccaccgagattcagaagacaacgtgacaaaagcagctgttaacctccgacgggagggtgtgaccatcttcaccctgggcatagagggcgccagcgacacccagttggaaaagatagcatcccaccctgctgagcagtatgtctccaaactgaagaccttcgctgacctggctgctcacaaccagacatttctgaagaagctgcggaaccaaataacacacacagtctctgaaggaaaaccggaatgcccagtgcacccaaccgagttggtgtttgccctggaccactcccgggatgtcactgagcaggaatttgagcggatgaaggagatgatggctttcctggtgagagacattaaggtccgggagaacagctgccccgtgggagcgcacatcgccatcctctcctataactcccacgccaggcaccttgtgcgcttctcagacgcctacaagaagagtcaacttctcagagaaattgaaactattccttatgagagatcctctgccagcagggagattggcagagcaatgcggtttatttccaggaatgtcttcaagcggacgcttccgggggcacacacgagaaaaatcgccacatttttcagcagcggtcagtccgcggatgcccactccatcaccacggctgccatggagttcggcgcgcttgaaatcattcccgtggtgatcactttcagcaacgtgccctcggtcaggcgcgcatttgcggtnattgacgacactggcacatttcaagtaatagtggttcccaatgtgtgcaagccagatgcttcttgtgaccaagccagaccaccccctgtgcagtcttacatggatgctgctttccttctggatgcctcccggaacatgggaagtgctgaatttgaagacataagagccttccttggagcactattagatcactttgaaatcaccccagagccggagacttctgtcactggagaccgggtggccctattgagccatgctccccccgacttcctacccaacactcagaagagtccagttagagctgagttcaatcttaccacctacagaagtaagcgcctcatgaagaggcatgtgcacgagtcagttaaacaactaaatggagatgcttttattggtcatgccttacagtggactctggacaatgtatttttaagtacacccaatctgagaagaaacaaagtcatatttgtgatatctgctggggaaaccagccacttagatggggaaatcttaaagaaggaatccttgcgagccaaatgtcagggatatgccttatttgtgttttcccttggccctatttgggatgacaaggaactggaggatctcgccagccaccctttggatcaccacctggtccagcttggccgaattcataaacctgaccacagttatggtgtgaagtttgtgaagtcctttataaactcaatcaggcgta

SEQ ID NO: 21025 - DNA, 1071 bp, Homo sapiens
ttgcagtctttctactttggggagatcagcactgggacaccaccccaaaatttcctagtctctttgatacgggttcctccaatctgtagcctgccctccatctactgccagagccaagtctgccacaacaggttcaatcccagcctgtcctccaccttcagaaacgatggacaaacctatggactatcctatgggagtggcagcctgagtgtgttcctgggctatgacactgtgactgtaagtaatgttttcatagcctctgaggttcataacatcgttgtcaataaccaggagtttggcctgagtgagaatgagcccagcgaccccttttactattcagactttgacgggatcctgggaatggcctacccaaacatggcagaggggaattcccctacagtaatgcaggggatgctgcagcagagccagcttactcagcccgtcttcagcttctacttcaccctttattctggtcagatcatctggacccctgtcagcccgtaactgtactggcagattgccatcgaggagtttgccatcggtaaccaggccactggcttgtgctctgagggttgccaggccattgtggataccgagaccttcctgctggcagttcctcagcagtacatgcagtttgtggtcaactgcagctacatacagagcatgcccaccatcaccttcatcatcggcggggcccagtttcctctgcctccctctgaatatgtcttcaatgtctctacagtacagctagttatgtcttcatgtcctttgtctcttcagaacaatggctactgcaggcttggaactgaggccacctgcctgccctcccgcagtgggcagcccctctggattctgggggatgtcttcctcaaggaatattgctctgtctatgacatggccaacaacagggtgggctttgccttctctgcctagactagccagcgactgctgtctctacccctctctgcaggactctgggattgttctgatgtttctgtgggtccatggcagcatttttaatgatcctgactccctctgctcactagagtcttactttctgcaactaataaa

SEQ ID NO: 21026 - DNA, 939 bp, Homo sapiens
atgtccagaagaaactatactgaactgacagaatttgttctcttgggtctaacaagccgtccagagctgcgagttgctttcttggcactgttcctttttgtctacatagccactgtggtaggaaacttggggatgattattttaatcaaagttgattctcgacttcacactcccatgtacttttttctctccagtttgtccattctagatctgtgtttctccacaaatttcactcccaaaatgctagaaaatttcttatcagagaagaagaccatttcctatgcaggttgtttgatgcagtgctatgttgtcattgctgtggtccttgcagagcactgcatgttggcagtcatggcatatgaccgctatatggccatctgtaatccattgctctacagtagcaaaatgtcccaaggtgtttgtgtccacctggtcattgtcccttatgtctatggctttcttctcagtgtgatggaaaccttaaggacctacaacctctccttctgtggaacaaatgaaatcaaccatttctactgtgctgatcctcctcttatcaaactggcatgctctgacacgtacagcaaggagctgtccatgtacatagtagccggctacagcaacgtccagtctcttctaatcattctcacatcctacatgttcatccttgtcgctatcctcagaagccattctgcagagggaaggaaaaaagctttttccacatgtggttcccacctgacagttgtcacaatcttctatggaaccctcttctgcatgcatttgagacgtcccacagacgagtccgtggagcaggggaaaatggtggctgtgttttacaccacagtgatactcatgctgaactccatgatctatggcctcaggaacaaggatgtgaaagaggcgttgaaaaaagcaataggaaaacaaacattgggaaaataa

SEQ ID NO: 21027 - DNA, 600 bp, Homo sapiens
  misc_feature (1)...(600): n = A,T,C or G
ctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtgnnnaaaacacctgaagcagccccaatggatcttaattctcctgttcttaaggcactggggtcagcttgcatagagattaagtggatgccacctgaaaaaccaaatggaatcatcatcaactactttatttacnnnatcaattctacaacagtggaattatattggagtctgccagaaaagcccaatggcctcgtttctcaatatcaattgagtcgtaatggaaacttgcttnnntgggttaagggtctaggaaattttacatagaatgggaggtgacatttgtgcagagatgtgaatgaagcaagagtgtgagccacccaaggagcagcagcagtaatggccctgtggttagagcttgtctgatgggctcagggaggaaggaggctccgagga

SEQ ID NO: 21028 - DNA, 1539 bp, Homo sapiens
gagttccggtgccagtgtgccagcttttcaggtccacgctgtgagatcaatgtcaatgagtgcagttccagcccttgcctgcatggatattgctatgacgttgatggcttttcctgcttatgcaatccaggctatgttgggataagatgtgaacaggacattgatgactgcatcctgaatgcctgtgagcacaattctacctgcaaagacagctaccagtgtgtgtgcctatctgattgggaaggaaatttttgtgaacaagaatccaatgagtgtaaaatgaatccttgcaagaacaattccacctgtactgacctttacaaaagctatcggtgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaaggtaagagcgcagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggtaaatccatatctgtcccatgtgcagcaacatatttctgtctgcaagcaaatagaaacctcatatttatactccaaaacctgaaaacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggagactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcaggtgtcttcctggattttctggtcaattttgtgaaattaatataaatgaatgctcttcatcaccatgtctacatggtgcagactgtgaagatcacatcaatggatatgtttgcaaatgccaacca

SEQ ID NO: 21029 - DNA, 363 bp, Homo sapiens
atttttcagacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcaggtacttgtttgggaccactcttacaaagttggttgtgctgttactccatgttcaaaaattggacatattatacatgcagcaattttcatatgcaactatgcgccaggg

SEQ ID NO: 21030 - DNA, 924 bp, Homo sapiens
atgctcaatttcaccgatgtgacagagttcattcttttggggctaacgagccgtcgagaatggcaagttctcttcttcatcatctttcttgtggtctacatcatcaccatggtgggcaatatcggcatgatggtgttaatcaaggtcagtcctcagcttaacaaccccatgtactttttcctcagtcacttgtcatttgttgatgtgtggttttcttccaatgtcacccctaaaatgttggaaaacctgttttcagataaaaaaacaattacttatgctggttgtttagtacagtgtttcttcttcattgctcttgtccatgtggaaatttttattcttgctgcgatggcctttgatagatacatggcaattgggaatcctctgctttatggcagtaaaatgtcaagggttgtctgtattcgactgattactttcccttacatttatggttttctgacgagtctggcagcaacattatggacttacggcttgtacttctgtggaaaaattgagatcaaccatttctactgtgcagatccacctctcatcaaaatggcctgtgccgggacctttgtaaaagaatatacaatgatcatacttgccggcattaacttcacatattccctgactgtaattatcatctcttacttattcatcctcattgccattctgcgaatgcgctcagcagaaggaaggcagaaggccttttccacatgtgggtcccatctgacagctgtcattatattctatggtactctgatcttcatgtatctcagacgtcccacagaggagtctgtggagcaggggaagatggtggctgtgttctataccacagtgatccccatgttgaatcccatgatctacagtctgaggaacaaggatgtgaaaaaggccatgatgaaagtgatcagcagatcatgttaa

SEQ ID NO: 21031 - DNA, 1401 bp, Homo sapiens
  misc_feature (1)...(1401): n = A,T,C or G
ttggacctgtgcttcagttatagaggctacgactgtagaaacaatctgttctacacacaagctggagaagtagtctaccacattgctgcagttgctgtcgtgtataatcggcagcagcactcccagaggctgtacctggggcacgatgacgacattctcagcctgaccatccatccagtgaaggactatgtggctactgggcaggtatctatctcctgtaaactagggaagtatgtgggccattctgcacatgtcacaaatgtccgctggtcccatgactttcagtgggtgttgagcacaggaggggctgatcactcagttttccagtggaggtttattaagcctttaacaagtaaagaagaaattaaagggattccttgggcctcctggacatgcgtgaaaggccctgaagtgagtggaatttggcccaaatacactgaggttactgacatcaactcagtggatgcgaattacaacagctcagtgctggtgtctggagatgattttggactggttaaattgtttaaatttccttgtgatcgaaaagaagtcattcatgaaatgaaattttctccagatggttcttaccttgcagtgggatccaatgatggcccagtagatgtctatgctgttgcccanaggtataagaaaattggagaatgcagcaagtcccttagtttcatcacgcatattgactggtccttggatagtaaatacttacaaactaatgacggtgcaggagaacgattgttctacctgtggagcctggctgatcatgccttgatcgcccgctgtaacatggaagaggcggttcgcagtgtagctttcagccccgacggatctcagctggccctgggcatgaaggacggctctttcattgttctcgaccgccttctagcagggacccaggacagtgagatatttgaagtgattgtgcgagagcgagacaagccgatgttgatcctacagggccactgcgagggtgagctctgggctctggccctgcaccccaagaagcctctggctgtgacaggcagcgatgaccgctctgtcggaatctttagcatgtatgcttgtgaagaaggctttgccactggtgggcgagatgggtgtatacgactgtgggacactgatttcaaaccaataaccaaaattgatctcagggagacagaacaaggatacaaaggtaatatatgtgttaagcttacctgtaactctttttggacactgtgtggaaatgccctgactgcaaaaagagggatatttggcaaaacaggggatcttcagaccatcctttgccttgcatgtgccaaagaagacatcacctactctggtgctttaaatggtgacatctatgtctggaaagggctcaatttagtccgcaccattcaaggagcacat

SEQ ID NO: 21032 - DNA, 969 bp, Homo sapiens
atggatccaaccatctcaaccttggacacagaactgacaccaatcaacggaactgaggagactctttgctacaagcagaccttgagcctcacggtgctgacgtgcatcgtttcccttgtcgggctgacaggaaacgcagttgtgctctggctcctgggctgccgcatgcgcaggaacgccttctccatctacatcctcaacttggccgcagcagacttcctcttcctcagcggccgccttatatattccctgttaagcttcatcagtatcccccataccatctctaaaatcctctatcctgtgatgatgttttcctactttgcaggcctgagctttctgagtgccgtgagcaccgagcgctgcctgtccgtcctgtggcccatctggtaccgctgccaccgccccacacacctgtcagcggtggtgtgtgtcctgctctgggccctgtccctgctgcggagcatcctggagtggatgttatgtggcttcctgttcagtggtgctgattctgcttggtgtcaaacatcagatttcatcacagtcgcgtggctgatttttttatgtgtggttctctgtgggtccagcctggtcctgctgatcaggattctctgtggatcccggaagataccgctgaccaggctgtacgtgaccatcctgctcacagtactggtcttcctcctctgtggcctgccctttggcattcagtttttcctatttttatggatccacgtggacagggaagtcttattttgtcatgttcatctagtttctattttcctgtccgctcttaacagcagtgccaaccccatcatttacttcttcgtgggctcctttaggcagcgtcaaaataggcagaacctgaagctggttctccagagggctctgcaggacgcgtctgaggtggatgaaggtggagggcagcttcctgaggaaatcctggagctgtcgggaagcagattggagcagtga

SEQ ID NO: 21033 - DNA, 609 bp, Homo sapiens
atgtcctataacggaggagccatcatggccatgaaggggaagaaccgtgtggccatcgctgcagacaggcacttcgggatccaggcccagatggtgaccacggacttccaggagatctttcccatgggtggttggttgtacatcggtctggccgggcttgccactgacgtccagagagttgcccagtgcctcaagttccagctgaacctatatgagttgaaggaaggtcagcagatcaaaccttataccttcacgagcatggtggccaacttcttgtatgagaaacattttggcccctactacactgatccagtcattgctggtttggacctgaagacctttaagcccttcagttgctctctagacctcatcggcttccccatggtgactgatgactttgtggtcaatggcagctatgccgaacaaatgtacggaatgtgtgagtccctctgggaacccaacatggatccagaacacccgtttgaaaccatctccccagccatgctgaatgctgtggactggggtgcagggtcaggcatgggagtcatcatccacatcaccaagaaggacaaaatcaccaccaggacactgaaggcccaaatggactaa

SEQ ID NO: 21034 - DNA, 918 bp, Homo sapiens
atgcagaggagcaatcacacagtgactgagtttatactgctgggcttcaccacagacccagggatgcagctgggcctcttcgtggtgttcctgggcgtgtactctctcactgtggtaggaaatagcaccctcatcgtgttgatctgtaatgactcccacctccacacacccatgtattttgtcgttggaaatctgtcgtttctggatctctggtattcttctgtctacaccccaaagatcctagtgatctgcatctctgaagacaaaagcatctcctttgctggctgcctgtgtcagttcttcttctctgcagggctggcctatagtgagtgctgcttactggctgccatggcttatgaccgctacgtggccatctccaagcccctgctttatgcccaggccatgtccataaagctgtgtgcattgctggtagcagtctcatattgtggtggctttattaactcttcaatcatcaccaagaaaacgttttcctttaacttctgccgtgaaaacatcattgatgactttttctgtgatttgcttcccttggtggagctggcctgtggcgagaagggcggctataaaattatgatgtacttcctgctggcctccaatgtcatctgccccgcagtgctcatcctggcctcctacctctttatcatcaccagtgtcttgaggatctcctcctccaagggctacctcaaagccttctccacatgctcctcccacctgacctctgtcactttatactatggctccattctctacatctacgctctccccagatctagctattcttttgatatggacaaaatagtttctacattttacactgtggtattccccatgttgaatctcatgatctacagcctaaggaataaggatgtgaaagaggctctgaaaaaacttctcccataa

SEQ ID NO: 21035 - DNA, 951 bp, Homo sapiens
atggctcctgaaaatttcaccagagtcactgagtttattcttacaggtgtctctagctgtccagagctccagattcccctcttcctggtctttctggtgctctatgggctgaccatggcagggaacctgggcatcatcaccctcaccagtgttgactctcgacttcaaacccccatgtactttttcctgcaacatctggctctcattaatcttggtaactctactgtcattgcccctaaaatgctgattaactttttagtaaagaagaaaactacctcattctatgaatgtgccacccaactgggagggttcttgttctttattgtatcggaggtaatcatgctggctttgatggcctatgaccgctatgtggctatttgtaaccctctgctgtacatggtggtggtgtctcggcggctctgcctcctgctggtctccctcacatacctctatggcttttctacagctattgtggtttcatcttatgtattctctgtgtcttattgctcttctaatataatcaatcatttttactgtgataatgttcctctgttagcattatcttgctctgatacttacttaccagaaacagttgtctttatatctgcagcaacaaatgtggttggttccttgattatagttctagtatcttatttcaatattgttttgtctattttaaaaatatgttcatcagaaggaaggaaaaaagccttttctacctgtgcttcacatatgatggcagtcacaattttttatgggacattgctattcatgtatgtgcagccccgaagtaaccattcactggatactgatgataagatggcttctgtgttttacacgttggtaattcctatgctgaatcccttgatctacagcctgaggaataaggatgtgaagactgctctacagagattcatgacaaatctgtgctattcctttaaaacaatgtaa

SEQ ID NO: 21036 - DNA, 540 bp, Homo sapiens
  misc_feature (1)...(540): n = A,T,C or G
ctagggctgtgcctggctgctcctgagaaaactggaagatggtgtgccatgtcagatcacgaggccacgaagtgcaccagtttccgagacaatatgaaaaaagtgtttccagcagatggtccccttgtcacctgcgtggagagagcgtcttcccttgagtacattaaagccatcgcaaatgaagcagatgctgtgaccattgatggaggtttagtgtttgaggcaggcctggacccctacagccttaagcccatcatggtagaaatctgtgggtcaaaagatngaagagagcaccaacttccagctgagccagctccaaggcaagaagtcctgccacatgggcctgggctggtctgctggatagaacatccccatcaggacactgnngcagcggccaagttcttctccagcagctgcgtcccctgtgaggacatgaagaatttccccnntcgcctgtgtcaactgtgtgcagggaaagggacagacaagtgtgcctgctcctcccaagactcgtactttggctacgcgggaggccttaag

SEQ ID NO: 21037 - DNA, 531 bp, Homo sapiens
  misc_feature (1)...(531): n = A,T,C or G
atgggcaacaagcagacagtcttcacacacgagcagctggaagcgtatcagnngctcttctatcgctaccaggacctggccccacagctcgtgcccctcgactataccacctgccccgatgtgaaggtgccctacgagctcattggcagcatgcccgagctgaaggacaaccccttccgccagaggattgcccaggtattctctgaggatggggatggccacatgaccctggacaactttttggacatgttttccgtgatgagtgaaatggctccccgcgacctcaaggcttactatgcttttaaaatttatgattttaacaacgacgactacatttgtgcgtgggacctggagcagacggtgaccaaacagacgcggggggggctgagtgccgaggaggtgagcctggtatgtgagaaggtgctggatgaggctgatggagaccatgatgggcggctgtccctggaagatttccagaacatgatcctccgggcaccagacttcctcagcaccttccacatccgaatctga

SEQ ID NO: 21038 - DNA, 945 bp, Homo sapiens
atggagaacaacacagaggtgactgaattcatccttgtggggttaactgatgacccagaactgcagatcccactcttcatagtcttccttttcatctacctcatcactctggttgggaacctggggatgattgaattgattctactggactcctgtctccacacccccatgtacttcttcctcagtaacctctccctggtggactttggttattcctcagctgtcactcccaaggtgatggtggggtttctcacaggagacaaattcatattatataatgcttgtgccacacaattcttcttctttgtagcctttatcactgcagaaagtttcctcctggcatcaatggcctatgaccgctatgcagcattgtgtaaacccctgcattacaccaccaccatgacaacaaatgtatgtgcttgcctggccataggctcctacatctgtggtttcctgaatgcatccattcatactgggaacactttcaggctctccttctgtagatccaatgtagttgaacactttttctgtgatgctcctcctctcttgactctctcatgttcagacaactacatcagtgagatggttattttttttgtggtgggattcaatgacctcttttctatcctggtaatcttgatctcctacttatttatatttatcaccatcatgaagatgcgctcacctgaaggacgccagaaggccttttctacttgtgcttcccaccttactgcagtttccatcttttatgggacaggaatctttatgtacttacgacctaactccagccatttcatgggcacagacaaaatggcatctgtgttctatgccatagtcattcccatgttgaatccactggtctacagcctgaggaacaaagaggttaagagtgcctttaaaaagactgtagggaaggcaaaggcctctataggattcatattttaa

SEQ ID NO: 21039 - DNA, 918 bp, Homo sapiens
atgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctgcccttctgcaaatttgtgagtgccatgctgcacatccacatgtacctcacgttcctattctatgtggtgatcctggtcaccagatacctcatcttcttcaagtgcaaagacaaagtggaattctacagaaaactgcatgctgtggctgccagtgctggcatgtggacgctggtgattgtcattgtggtacccctggttgtctcccggtatggaatccatgaggaatacaatgaggagcactgttttaaatttcacaaagagcttgcttacacatatgtgaaaatcatcaactatatgatagtcatttttgtcatagccgttgctgtgattctgttggtcttccaggtcttcatcattatgttgatggtgcagaagctacgccactctttactatcccaccaggagttctgggctcagctgaaaaacctattttttataggggtcatccttgtttgtttccttccctaccagttctttaggatctattacttgaatgttgtgacgcattccaatgcctgtaacagcaaggttgcattttataacgaaatcttcttgagtgtaacagcaattagctgctatgatttgcttctctttgtctttgggggaagccattggtttaagcaaaagataattggcttatggaattgtgttttgtgccgttag

SEQ ID NO: 21040 - DNA, 878 bp, Homo sapiens
  misc_feature (1)...(878): n = A,T,C or G
atggccgacaaggtcctgaaggagaagagaaagcagtttatccgttcagtgggcgaaggtacaataaatggcttactgggtgaattattggagacaagggtgctgagccaggaagagatagagatagtaaaatgtgaaaatgctacagttatggataaggcccgagctttgcttgactctgttattcggaaaggggctccagcatgccaaatttgcatcacatacatttgtgaagaagacagtcacctggcagggacgctgggactctcagcagctgcacacatcatgcttgctctcattatctttaacaaagagtttgacagtctttctaaaagagtgggagctgaggttgatgtcataggcatgatgatgctgctacaaaatctggggtacaaggtggatgagaaaagaaatctcactgcttcggaaatgactacagagttggaggtattttctctgcaccaagagcacaaggcctctggntctcatggtattcgggaaggcatttgtgggaagaaatactctgagcaagtcccagatgtattacaactcaatggaatctttaaaacgttgaatagcaagaactgcccaagtttgaaggacaaacccaaggtgataatcatccaggcctgccataaccatggtgtggtgttggtaaaagattcagtaccggcctctgaaaatatatctttaccaactccgggagattttgaggatgatgctattaatcaagtacacatagagaaggattttattgctttctgctcttccacattagngttcaactttcatttgagcagccagatgataaagcacagatgcccagcactgaaagagttacttcgacaagacgtttctatctcttcccagtacattaa

SEQ ID NO: 21041 - DNA, 483 bp, Homo sapiens
atggtcatcccgactgtgcccttcaacatcaccatcaacagcaagcccttaggacacatctcctttcagctatttgcagacaaatttccaaagacaggagaaaactttcacactctgaacaataaagacaaaggatttggttcctgctttcacagaattattccggagtttatatgccagggtgatgacttcacaccccataatggcattggtggcaagtccatctacggggataaatttgatgataagaactttattgtgaagcatacaggtcttggcatcttgtccatggcaaatgctgcacccaaaacaaatgagtcccagtttttcatctgcactgccatggccaaatggtgggatggcaagcatgtgatctttggcagggtgaaagagggcatgaatattgtggaagccatggaatgctttgggtccaggaatggcaagacaagcaagatcgccattgccaactgcagacaactctga

SEQ ID NO: 21042 - DNA, 975 bp, Homo sapiens
atgtctcaggatcaggagagtccacgatgcacacatgatcagcaccttcagaccttcagtgagacccagagcctggaggttgcacaggtctccaaggctctggagaagaccctcctctcctcctcccatcctctagtgcctggcaaactgaaggaagctcctgctgctaaggcagagagtcctcttgaggttcctcagagtttctgctcctcttccattgccgtcacaaccacctcatcaagtgaatctgatgaggcttccagcaatcaagaagaggaagatagtccaagctcctcagaggatacatcagaccccaggaatgtgcccgcagatgctctcgaccagaaagtggcttttttggtgaatttcatgctgcacaagtgtcagatgaaaaagccaataacaaaggcagatatgttgaagattatcatcaaagatgatgagagccacttctctgagatcctcctgagagcttctgagcacctagagatgatatttggccttgatgtggtggaggtggaccccaccacccattgctatggcctcttcatcaaactgggcctcacctatgatgggatgctgagtggtgaaaagggtgtgcccaagactggcctcctgataattgtcctgggtgtgatcttcatgaagggcaaccgtgccactgaagaggaagtctgggaagtgctgaatttgacgggagtatattctgggaagaagcacttcatctttggagagcccagaatgctcatcaccaaagattttgtgaaggagaagtacctggagtaccagcaggtggccaacagtgatcctgcacgatatgaattcctgtggggcccaagagccaaagctgaaaccagcaagatgaaagtcctggagtttgtggccaaagttcatgggtcttacccacattctttcccatctcagtatgcggaagctctgaaagaggaagaagagagagctagagccagaatttga

SEQ ID NO: 21043 - DNA, 939 bp, Homo sapiens
atgcccaattcaaccaccgtgatggaatttctcctcatgaggttttctgatgtgtggacactacagattttacattctgcatccttctttatgttgtatttggtaactctaatgggaaacatcctcattgtgaccgtcaccacctgtgacagcagccttcacatgcccatgtacttcttcctcaggaatctgtctatcttggatgcctgctacatttctgttacagtccctacctcatgtgtcaattccctactggacagcaccaccatttctaaggcgggatgtgtagctcaggtcttcctcgtggttttttttgtatatgtggagcttctgtttctcaccattatggctcatgaccgctatgtggctgtctgccagccacttcactaccctgtgatcgtgaactctcgaatctgcatccagatgacactggcctccctactcagtggtcttgtctatgcaggcatgcacactggcagcacattccagctgcccttctgtcggtccaacgttattcatcaattcttctgtgacatcccctctctgctgaagctctcttgctctgacaccttcagcaatgaggtcatgattgttgtctctgctctgggggtaggtggcggctgtttcatctttatcatcaggtcttacattcacatcttttcgaccgtgctcgggtttccaagaggagcagacagaacaaaggccttttccacctgcatccctcacatcctggtggtgtcagtcttcctcagttcatgctcttctgtgtacctcaggccacctgcgatacctgcagccacccaggatctgatcctttctggtttttattccataatgcctcccctctttaaccctattatttacagtcttagaaataagcaaataaaggtggccatcaagaaaatcatgaagagaattttttattcagaaaatgtgtaa

SEQ ID NO: 21044 - DNA, 2008 bp, Homo sapiens
  misc_feature (1)...(2008): n = A,T,C or G
atggagagcggcaccagcagccctcagcctccacagttagatcccctggatgcgtttccccagaagggcttggagcctggggacatcgcggtgctagttctgtacttcctctttgtcctggctgttggactatgggtaagccaggccacttccacagtgaagaccaaaagagacacagtgaaaggctacttcctggctggaggggacatggtgtggtggccagtaagtggtctttggttcgtgggtgcatccttgtttgccagcaatgttggaagtggacatttcattggcctggcagggtcaggtgctgctacgggcatttctgtatcagcttatgaacttaatgggcttgttttctgtgctgatgtggcctggatcttcctacccatctacattgctggtcaggtgagtcaggtcaccacgatgccagaatacctacggaagcgcttcggtggcatcagaatccccatcatcctggctgtactctacctatttatctacatcttcaccaagatctcggtagtagacatgtatgcaggtgccatcttcatccagcagtctttgcacctggatctgtacctggccatagttgggctactggccatcactgctgtatacacggttgctggtggtggcctggctgctgtgatctacacggatgccctgcagacgctgatcatgcttataggagcgctcaccttgatgggctacagtanntttgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtacnncaggtgattgtccagcggactctggctgccaagaacctgtcccatgccaaaggaggtgctctgatggctgcatacctgaaggtgctgcccctcttcataatggtgttccctgggatggtcagccgcatcctcttcccaggtgaggggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcaggagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaaggtagctctggatggccagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtagtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagnngacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttag

SEQ ID NO: 21045 - DNA, 2652 bp, Homo sapiens
  misc_feature (1)...(2652): n = A,T,C or G
natctgggaaattttagtggccggacaagaagtgcagtctctgtgagggaaggccagggtgtcgttctgatgtgctctcctccgccacattcanagacagggcacctctacatatctaaggtggagccgtctgatgtgggaaattacacatgtgtggtgacaagtatggtgacaaatgcccgagtgctgggctctccaactcctttggtgctacgttctgatggtgtgatgggtgaatatgaacctaaaatagaagttcagtttccagaaactcttccagcagctaaaggttcgactgtgaaattggaatgttttgcccttggaaatcccatacctcagattaattggaaagaaggatgggctgccatttccagcaaaattaaattaaggaagttcagtggtgtgcttgaaatccccaacttccaacaggaagatgcaggttcctatgaatgcattgctgagaattcacgaggaaaaaatgttgccagagggcgtctcacttactatgcaaagccccattgggttcaactcataaaggatgtggaaatagccgtggaggacagtctttattgggaatgcagggcaagcggcaagcccaagccttcctaccgatggctgaaaaatggagcagccctggtgctagaggagagaacacagatagaaaatggtgcccttacaatatcaaacctaagtgtgactgattctggcatgttccaatgcatagcagaaaacaaacatggccttgtttattccagtgctgagctcaaagttgttgcttctgctccagatttttcaaagaatccaatgaagaagttggttcaggtgcaggtgggcagcctggtcagcttggattgtaaacccagagcctccccaagggcactctcttcctggaagaagggggatgtgagcgtgcaggagcatgaaagaatttctttgttaaacgatggaggactcaaaatagccaatgtgactaaagctgatgctggaacttacacctgcatggcagaaaaccagtttgggaaagcaaatggcacaacacatttggttgttacggaaccaacaagaataactttggcaccatctaacatggatgtttctgttggtgaaagcgtcatattgccctgccaggtacaacatgacccgctgttagacatcatctttacctggtatttcaatggggcccttgcagattttaagaaagatggatctcactttgagaaagttggtgggagttcatctggtgatttaatgatcagaaacattcagctgaaacacagtgggaaatatgtttgtatggtgcaaacgggggtggacagtgtttcatctgctgctgacctcatagtaagaggttcacctggaccaccagaaaatgtgaaggtagatgaaattacagacacaacagcccaactctcttggaaagaaggtaaagacaaccatagcccagttatatcctattctatccaggctcggacacctttctccgtgggttggcaaaccgtcacaacagtgcctgaggtcatcgatgggaagacgcacacagccactgtagttgagttaaacccatgggtggaatatgaatttcgggttgtagccagtaacaaaattggaggtggagaaccaagtttaccctcagaaaaagtaagaactgaagaggcaccagaagtgcctccttctgaagtcaatggaggaggcggaagccggtctgaacttgtgataacctgggatccagtccctgaagaactacagaatggtgaaggttttgggtatgttgttgctttccgccctcttggggttaccacctggatccagacagtggtgacatcccctgacaccccaagatatgtctttaggaatgaaagcatcgtgccatattcaccatatgaagttaaagtgggtgtttataataacaaaggtgaaggaccatttagcccagtgacaacagtgttctctgcagaagaagagcctacagtggccccatctcaagtctctgcaaatagcctatcttcctcagaaattgaggtttcatggaacaccattccttggaagttgagcaatggacatttactgggctatgaggtgcggtactggaatgggggtggaaaggaggaatcatccagtaagatgaaagtggcaggaaatgagacatcagccagactacggggcctgaagagcaacctggcctattacacggctgtccgggcttacaacagtgccggcgctgggccttttagcgccacagttaatgtaaccaccaagaaaacgcccagtcagccaccaggaaatgttgtttggaatgccacagacactaaagtgttacttaattgggagcaagttaaagccatggagaatgagtcagaagtaacaggatataaagtattctataggactagcagtcaaaataacgtacaagtactgaacacaaataaaacttcagctgaacttgtgctgcccattaaagaggactacattattgaagtcaaggccacaacagatggaggggatgggaccagtagtgaacagatcaggattccacgaataaccagtttgacaggtatggatgcaagaggatccacttcagccatctcgaatgtccaccctatgtcaagttatatgcctatagtactgttcttaattgtatatgtcctgtggtga

SEQ ID NO: 21046 - DNA, 1183 bp, Homo sapiens
  misc_feature (1)...(1183): n = A,T,C or G
catgtgagtcaggatctggaagcctcgtcatgttcttcaacacaaggaaaatttaaccgagagcagttttacaaatttatcattttccctggcaagtggattaaagtctgnnnaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaaggcaagaccacatctaattcttaccaagggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgaaccgtggagcatgcaacacatcccggcactgttttcggccttctgtggcctcttggtcgccctttcttaccatctgagccgtcagagcagtgacccatctgtactcatattctgcccatttttatcgcagccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaaggcaa

SEQ ID NO: 21047 - DNA, 832 bp, Homo sapiens
  misc_feature (1)...(832): n = A,T,C or G
ttccctgagtcacataggattccactgcaggcagtctgattttgagctggaggggtgaggggtggaagctgggctgcagagatcgcagggctggatggaaagagatgcatggtagacctgcaaggccctgggacccggagctgagctctgaggcttcagtctcctgaggtgcagggtccaggctggctgaggcctccagcaagaagggcccagacaaatggcttggccaggccagcatcttcctggacacctggtgccgctgtgagggggccctcatctcccaagagtgggtgctcacaggcgccaactgctttgacnnnctgcagaatgtgatgacctggggtccctgctcggagcctggcctcccgggagtctacacacctgtgaatcccttcatttcctggatccaagataatgtctccaacgtctcctttgacacctctgccaacagatgctgttggggctggcccaggacaagacagaggcagtgagggttgttagcctctggagtcctgggtttgaatcctgacttagctacttacctgcctttgccatctgaatctgtttcctcctctgtaaaatggagatgtcttcaattattcatttatcaacaagttagtagttaccaagtgcttactctgtgacaggccactaagatacaagactgtatcttgacagattcgtggattttggctagcaactcccctgagcgctggctgattggggtgccaggcgccgcccgctgcgggcctcagtttccccagcttcgaactaaagagcgatggcttggatgtaaggattcttgaggtccctcccaagtttgtttaataaa

SEQ ID NO: 21048 - DNA, 357 bp, Homo sapiens
tttcgaatatttctaaaatcagagtttagtgaagaaaatgttgagttctggcttgcctgtgaagactttaagaaaacgaaaaatgcagacaaaattgcttccaaagccaagatgatttattctgaattcattgaagctgatgcacctaaagagattaacattgacttcggtaccagagacctcatctcaaagaatattgctgaaccaacactcaaatgctttgatgaggctcagaaattaatctattgtctcatggccaaggattctttccctcgatttctgaagtcagagatttataaaaaactggtaaatagccaacaggttccaaatcataaaaaatggctcccttttttgtga

SEQ ID NO: 21049 - DNA, 256 bp, Homo sapiens
agtctctggtactcaggctggagtgcggtggtgtgatcttggctcactgtaaactcaagctcctgaactcaagcaattctcctgccttggcctcccaaagtgctgggattgcaggtgtgaactgccacacctggctccccgactattcttgtatcagaaatgtaactcacccactcaccaccagcccacactctgggttctcctatcactccactgcctgctcctcggctgatcacaatggaagaagagatcatgg

SEQ ID NO: 21050 - DNA, 256 bp, Homo sapiens
atcaggccagcatctggttttatttaattccatataaatgaaagtacatatgaatgctattatttgaatagttatttgggcatagacaaaataatgacaattgttcttattttggacaaaaagatgttttaaagtaatacagcatatatattattttgttaaatacatttgggcacttcttaaaatgatgggtgaatttaggaataaattatttttctgcaaactattcccaaaagaaacaaatgtggaacagtat

SEQ ID NO: 21051 - DNA, 224 bp, Homo sapiens
caggaacacagactggaaagatacacacaaaattcaggatggtaaaagaagaaagatcgggacagagacctgcttggagatttctcatactcatccttagatctgctttgagaacaagaacaggagcccagatcagatttgggcatagatttgctccttgagctagatttcctgccttttgaacgagaacgtgatcgacctttgctccgcaacctgatcaggag

SEQ ID NO: 21052 - DNA, 256 bp, Homo sapiens
aacacagaactggaaagatacacacaaaattcaggatggtaaaagaagaaaggagattcctcttgcaaaagaagccaagtataaacatggaagaacaactgcctaagcaagtagaaaagtgttccataatagtgcgcaatgaatgaagagttctggattaatctctggaactcaacctgcaccctgatctttattttgaatgggatctagaacgggatcttgaagtagctctttttggcggaggggacacagaatg

SEQ ID NO: 21053 - DNA, 135 bp, Homo sapiens
ctgaggaacactgacgagaagaccttatgaaccaggaatattttgtactcgatgtggcagacgtgacaaatgcacagattttctatgcagtaagataaagaaaataaacatgaaaaaaatgcaaaaaaaaaaaaa

SEQ ID NO: 21054 - DNA, 256 bp, Homo sapiens
agcttgtttgggacactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacggattttctatgcagtaagataaagaaaataaacatgaaaaaaatgcataatggattggacaagaaaaataagcgattg

SEQ ID NO: 21055 - DNA, 152 bp, Homo sapiens
tagaggaacactgacgagaagaccttatgaaccaggaatattttgtactcgatgtggcagacgtgacaaatgcacagattttctatgcagtaagataaagaaaataaacatgaaaaaaatgcataatggattggacaaaaaaaaaaaaaaaa

SEQ ID NO: 21056 - DNA, 256 bp, Homo sapiens
ctgatagaacatccctggggcaggaggcaggtgcattttgaactcttcctaaagtggactcctttgctttgcacttctcgagctttcgggcccgccaagagccttcatcaccacttagaacattgccatcttcctagtgcctccgatttctgaggcgagaggactgaggctgaaaactgcccggctgcaggtcaccctcaaggccaaaggtagctcctgcacctgtgccagctcctgcaaatgcaaagagtacaaa

SEQ ID NO: 21057 - DNA, 256 bp, Homo sapiens
caggagatgttggcacacctgataccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgcc

SEQ ID NO: 21058 - DNA, 256 bp, Homo sapiens
atgtcattcatatccttatttttcccccgggacgagttatatttaccggactgtctgcagcatcaagatatgggcttcagagcacgtttttagcacccgtgggaaactgttacaacagctgcaatgcagaaatatccaagccctgtgaacccgagcgtggtgtgggttgacgtgttaaacagacgtatagatccctccagagagttgcacagacttctccacacagtgggaactgcaaaactcttactggtgcagc

SEQ ID NO: 21059 - DNA, 256 bp, Homo sapiens
aatgtaacctggaatagtttagctattccagacacacactgctcaccagagctagaagaaggctaccagtgcccacctggatttaaatgcatggaccttgaagatctgggacttagcaggcgagagctgggctacagtggctttaatgagataggaactagtatattcaccgtctacgaggccgcctcacaggaaggctgggtgttcctcatgtacagagcaattgacagctttccccgttggcgttcctacttct

SEQ ID NO: 21060 - DNA, 256 bp, Homo sapiens
agataagtggcctgtgcagatccagagatctgccagaaggaacaagcaccaccagcagctcccttgtctcttaccctctctccatcctctggatccctgtggtccaggccagccagggcggccagctcttcatctatatccagtccatcagctcctacctgcagccgcctgtggcggtggtcttcgtcatgggatgtttctggaagaggaccaatgaaaagggtgccttctggggcctgatctcgggcctgctcct

SEQ ID NO: 21061 - DNA, 256 bp, Homo sapiens
aggtgccttgacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgct

SEQ ID NO: 21062 - protein, 400 aa, Homo sapiens
MFYTSIGRQLSLGLLYFCISRLFQMIFSRDQVLRVLAKDEKQLSLLGDLEGLKPQKVDFWRGPARPSLPVDMRVPFSELKDIKAYLESHGLAYSIMIKDIQVLLDEERQAMAKSRRLERSTNSFSYSSYHTLEEIYSWIDNFVMEHSDIVSKIQIGNSFENQSILVLKFSTGGSRHPAIWIDTGIHSREWITHATGIWTANKIVSDYGKDRVLTDILNAMDIFIELVTNPDGFAFTHSMNRLWRKNKSIRPGIFCIGVDLNRNWKSGFGGNGSNSNPCSETYHGPSPQSEPEVAAIVNFITAHGNFKALISIHSYSQMLMYPYGRLLEPVSNQRELYDLAKDAVEALYKVHGIEYIFGSISTTLYVASGITVDWAYDSGIKYAFSFELRDTGQYGFLLPA

SEQ ID NO: 21063 - protein, 400 aa, Homo sapiens; identical to SEQ ID NO: 21062

SEQ ID NO: 21064 - protein, 691 aa, Homo sapiens
  VARIANT (1)...(691): Xaa = Any Amino Acid
MGPPSSSGFYVSRAVALLLAGLVAALLLALAVLAALYGHCERVPPSELPGLRDLEAESSPPLRQKPTPTPKPSSARELAVTTTPSNWRPPGPWDQLRLPPWLVPLHYDLELWPQLRPDELPAGSLPFTGRVNITVRCTVATSRLLLHSTEYMVLELSEPLKPGSSYELQLSFSGLVKEDLREGLFLNVYTDQGERRALLASQLEPTFARYVFPCFDEPALKATFNITMIHSQLEPTFARYVFPCFDEPALKATFNITMIHHPSYVALSNNSLGQSEKEDVNGSKWTVTTFSTTPHMPTYLVAFVICDYDHIRIWARKDAIANGSADFALNITGPIFSFLEDLFNISYSLPKTGELDIIALPSFDNHAMENWGLMIFDESGLLLEPKDQLTEKKTLISYVVSHEIGHQACGKQKWFGNLVTMNWWNNIWLNEGFASYFEFEVINYFNXGDFLKQAIDDQSTVILPATIKNIMDSWTHQSGFPVITLNVSTGVMKQEPFYLENIKNRSDSDHDWVILNLNMTGYYRVNYDKLGWKKLNQQLEKDPKLRVGWALKTAFSCQKNFSQNGWIIQKMPIKDVVLCYGIALGSDKEWDILLNTYTNTTNKEEKIQLAYAMSCSKDPWILNRYMEYAISTSPFTSNETNIIEVVASSEVGRYVAKDFLVNNWQXYGTQSLINLIYTIGRTVTTDLQIVE

SEQ ID NO: 21065 - protein, 160 aa, Homo sapiens
MVNPTVFLDIAVHGEPLGGIPFELFADKIPKTPENFHALSTGEKGFGYKGSCFHRIIPGVMCQRGDFTSHNGTGGKSIQGEKFDDKNFILKHAGPGILSMANTGPNTNSFQCFICTAKAEWLDGKHVVFGKVKEGINIVEAMERFGSRNGKTSKKITISD

SEQ ID NO: 21066 - protein, 1920 aa, Homo sapiens
  VARIANT (1)...(1920): Xaa = Any Amino Acid
MDFLKIEPGPPVFLAGERVGSAGILLSWNTPPNPNGRIISYIVKYKEVCPWMQTVYTQVRSKPDSLEVLLTNLNPGTTYEIKENSESFLWSTASPSPTLGRVTPPSRTTHSSSTLTQNEISSVWKEPISFVVTHLRPYTTYLFEVSAATTEAGYIDSTIVRTPESVPEGPPQNCVTGNITGKSFSILWDPPTIVTGKFSYRVELYGPSGRILDNSTKDLKFAFTNLTPFTMYDVYIAAETSAGTGPKSNISVFTPPDVPGAVFDLQLAEVESTQVRITWKKPRQPNGIINQYRVKVLVPETGIILENTLLTGNNEYINDPMAPEIVNIVQPMVGLYEGSAEMSSDLHSLATFIYNSHPDKNFPARNRAEDQTSPVXTLNSLSLVLIGLKKYTKYKMRVAASTHVGESSLSEENDIFVRTSEDEPESSPQDVEVIDVTADEIRLKWSPPEKPNGIIIAYEVLYKNIDTLYMKNTSTTDIILRNLRPHTLYNISVRSYTRFGHGNQVSSLLSVRTSETVPDSAPENITYKNISSGEIELSFLPPSSPNGIIQKYTIYLKRSNGNEERTINTTSLTQNITPDSPPQDFSVKQLSGVTVKLSWQPPLEPNGIILYYTVYVWNRSSLKTINVTETSLELSDLDYNVEYSAYVTASTRFGDGKTRSNIISFQTPEGAPSDPPKDVYYANLSSSSIILFWTPPSKPNGIIQYYSVYYRNTSGTFMQNFTLHEVTNDFDNMTVSTIIDKLTIFSYYTFWLTASTSVGNGNKSSDIIEVYTDQDIPEGFVGNLTYESISSTAINVSWVPPAQPNGLVFYYVSLILQQTPRHVRPPLVTYERSIYFDNLEKYTDYILKITPSTEKGFSDTYTAQLYIKTEEDVPETSPIINTFKNLSSTSVLLSWDPPVKPNGAIISYDLTLQGPNENYSFITSDNYIILEELSPFTLYSFFAAARTRKGLGPSSILFFYTDESVPLAPPQNLTLINCTSDFVWLKWSPSPLPGGIVKVYSFKIHEHETDTIYYKNISGFKTEAKLVGLEPVSTYSIRVSAFTKVGNGNQFSNVVKFTTQESVPDVVQNMQCMATSWQSVLVKWDPPKKANGIITQYMVTVERNSTKVSPQDHMYTFIKLLANTSYVFKVRASTSAGEGDESTCHVSTLPETXVPTNIAFSDVQSTSATLTWIRPDTILGYFQNYKITTQLRAQKCKEWESEECVEYQKIQYLYEAHLTEETVYGLKKFRWYRFQVAASTNAGYGNASNWISTKTLPGPPDGPPENVHVVATSPFSISISWSEPAVITGPTCYLIDVKSVDNDEFNISFIKSNEENKTIEIKDLEIFTRYSVVITAFTGNISAAYVEGKSSAEMIVTTLESAPKDPPNNMTFQKIPDEVTKFQLTFLPPSQPNGNIQVYQALVYREDDPTAVQIHNLSIIQKTNTFVIAMLEGLKGGHTYNISVYAVNSAGAGPKVPMRITMDIKAPARPKTKPTPIYDATGKLLVTSTTITIRMPICYYSDDHGPIKNVQVLVTETGAQHDGNVTKWYDAYFNKARPYFTNEGFPNPPCTEGKTKFSGNEEIYIIGADNACMIPGNEDKICNGPLKPKKQYLGRTFRKNRRDHSFRHFVYPFNNSPWNSYFCICKXIRQKQKEGGTYSPQDAEIIDTKLKLDQLITVADLELKDERLTRPISKKSFLQHVEELCTNNNLKFQEEFSELPKFLQDLSSTDADLPWNRAKNRFPNIKPXGYLCPNEFIATQGPLPGTVGDFWRMVWETRAKTLVMLTQCFEKGRIRCHQYWPEDNKPVTVFGDIVITKLMEDVQIDWTIRDLKIERHGDCMTVRQCNFTAWPEHGVPENSAPLIHFVKLVRASRAHDTTPMIVHCSAGVGRTGVFIALDHLTQHINDHDFVDIYGLVAELRSERMCMVQNLAQYIFLHQCI

SEQ ID NO: 21067 - protein, 160 aa, Homo sapiens
MVNPTVFFHISVDGESLGRISFELFADKFPKTAENFCALNTGEKGFGYKGCCFHRIIPGFMCHGGDFTHHNGTGGKSIYGEKVDDDNFILKHTGPGILSMANAGPNTNGSQFFICTAKSEWLDSKHVVIGKVKEGMNIVEAMEHFGSRNGKTSKKVTIPD

SEQ ID NO: 21068 - protein, 880 aa, Homo sapiens
  VARIANT (1)...(880): Xaa = Any Amino Acid
MAFLIILITCFVIILATSQPCQTPDDFVAATSPGHIIIGGLFAIHEKMLSSEDSPRRPQIQECVGXLKYQFFFKLLPMIHSIEMINNSTLLPGVKLGYEIYDTCTEVTVAMAATLRFLSKFNCSRETVEFKCDYSSYMPRVKAVIGSGYSEITMAVSRMLNLQLMPQQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAIEMNINKMWIASDNWSTATKITTIPNVKKIGKVVGFAFRRGNISSFHSFLQNLHLLPSDSHKLLHEYAMHLSACAYVKDTDLSQCIFNHSQRTLAYKANKAIERNFVMRNDFLWDYAEPGLIHSIQLAVFALGYAIRDLCQARDCQNPNAFQPWELLGVLKNVTFTDGWNSFHFDAHGDLNTGYDVVLWKEINGHMTVTKMAEYDLQNDVFIIPDQETKNSKCSKECSPGQMKKTTRSQHICCYECQNCPENHYTNQTWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQA

SEQ ID NO: 21069 - protein, 320 aa, Homo sapiens
MSGDNSSSLTPGFFILNGVPGLEATHIWISLPFCFMYIIAVVGNCGLICLISHEEALHRPMYYFLALLSFTDVTLCTTMVPNMLCIFWFNLKEIDFNACLAQMFFVHMLTGMESGVLMLMALDRYVAICYPLRYATILTNPVIAKAGLATFLRNVMLIIPFTLLTKRLPYCRGNFIPHTYCDHMSVAKVSCGNFKVNAIYGLMVALLIGVFDICCISVSYTMILQAVMSLSSADARHKAFSTCTSHMCSIVITYVAAFFTFFTHRFVGHNIPNHIHIIVANLYLLLPPTMNPIVYGVKTKQIQEGVIKFLLGDKVSFTYD

SEQ ID NO: 21070 - protein, 1600 aa, Homo sapiens
  VARIANT (1)...(1600): Xaa = Any Amino Acid
MDWESRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDSSRVQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAIVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTXIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSFDHHCYKTCPEKTYSEAVECKACDSNCSSCDQNGCYWCEEGFFLLGGSCVRKCGPGFYGDQEMGECESCHRACETCTGPGHDECSSCQEGLQLLRGMCVHATKTQEEGKFWNEAVSTANLSVVKSLLQERRRWKVQIKRDILRKLQPCHSSCKTCNGSATLCTSCAYLLAQACVSSCPQGTWPSVRSGSCENCTEACAICSGADLCKKCQMQPGHPLFLHEGRCYSKCPEGSYAEDDICERCSSPCRTCEGNATNCHSCEGGHVLHHGVCQENCPERHVAVEGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRXSCRTCEGRHSRQCHSCRPGWFQLGKECLLQCREGYYADNSTGRCERCNRSCKGCQGPRPTDCLSCDRFFFLLRSKGECHRSCPDHYYVEQSTCLHCCNTSDPPSAQECCDCQDTTDECILRTSKVRPATEHFKTALFITSSMMLVLLLGAAVVVWKKSRGRVQPAAKAGYEK

SEQ ID NO: 21071 - protein, 320 aa, Homo sapiens
RYDIKALIGTGSFSRVVRVEQKTTKKPFAIKVMETREREGREACVSELSVLRRVSHRYIVQLMEIFETEDQVYMVMELATGGELFDRLIAQGSFTERDAVRILQMVADGIRYLHALQITHRNLKPENLLYYHPGEESKILITDFGLAYSGKKSGDWTMKTLCGTPEYIAPEVLLRKPYTSAVDMWALGVITYALLSGFLPFDDESQTRLYRKILKGKYNYTGEPWPSISHLAKDFIDKLLILEAGHRMSAGQALDHPWVITMAAGSSMKNLQRAISRNLMQRASPHSQSPGSAQSSKSHYSHKSRHMWSKRNLRIVESPL

SEQ ID NO: 21072 - protein, 320 aa, Homo sapiens
  VARIANT (1)...(320): Xaa = Any Amino Acid
MDSVPLICDYGSGFSKVGFAGMESPMGMFPTVLGKLRHDNVLVGMEEEDWFIGEEVQKKRGKLNLQYPISRAITTNWDNMEKIWHHSFYQVLHVAPEQYPMLVTEPSLNPTPSKEKVTQVLFEIFNIPALYLANRGVLSLYASGQTFGMTVESGEGMTHFVPIADGCPLHQSTFQVDIAGQDLTSYLLQLLKDNVQLLVGTGDREYIRDMKEKCCYVALDFDKEKMKTDSPSCQQKYQLPDGQEITVGQESFFCPEVLFXXKNTPGIHTKAIQSITSCNPDLQKVLFGHMLLSGGTGSCPGLRFRMQREISELVSPTVYV

SEQ ID NO: 21073 - protein, 863 aa, Homo sapiens
  VARIANT (1)...(863): Xaa = Any Amino Acid
LRLAGGRSRCEGRVELRHQGVWGTVCDDHWNIRNARVVCRLLGCGRALGAPGRGRFGQGTGPILLDDVRCTGHENALERCTHSGWARHNCQHREDAGVVCAGIASSAHPADDLWNLAKATVVCRQLQCGRAVAAPTGAHFGAGSGKILLDDVQCVGSESHLGQCVHGGRARHNCGHLEDASVICSXPLPSVPTSCASPGAWMEVRLLNGTGRCSGRVEVLVQGTWGTVCDDLWDLAEATVVCRQLQCGQAVAAPTGAHFRAGSGKILLDDMQCVGSESHLGQCMRGDQARHNCGHLEDASVICTMEVRLLNGTGRCLGRVEVLIQGTWGTVCDHFWNLAEAAVVCRQLQCGQAMAAHFGASSGKVLLDDMQCVGSKSHLGRCVHRGWARHNCGHLEDASVICAGEGLVVNLHLQLVGGSGRCSGRVEILHQGAWGTVCDDLWDLNEAEVVCRQLGCGRAMSALGKAHFGPGSGDIFLDNLQCAGVERYLGQCTHSGWSEHNLRLMGGSGRCLGRVEILHQGAWGTVCDDLWDLNEAKVVCRQLGCGQAVSGPGEAHFGPGSGDIFLDNLQCTRVEHYLGQCTHLGWSEHNCGHHEDASVICSEDGPELRLVGGSGQCSGHGEVLHKGSWGTVCDDLWDLNEAEVVCQQLGCGKAIAAPGKAHFGPGSGDILLDNIQCSGSENHLGQWPSSGWSDHNRGHHEDANVVCSGGLSLGLRLVNGSSRCEGRVEVYHANAWGTVCDDSWSIEDAHVVCRQLGCGLAVSALPGASFSPGSGSILLDDVNCTGRESSLGQCPHRGWYTHNCGHHEDAGVICSVYLQCKVLICDSSDHQSRCNQGCVSRSKRDISSYKWKTDSIIGPIRLK

SEQ ID NO: 21074 - protein, 870 aa, Homo sapiens
  VARIANT (1)...(870): Xaa = Any Amino Acid
AQKSWIERAFYKRECVHIIPSTKDPHXYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELVGANASAPDQLSLALAWNRVDIARSQIFIYGVGSLEQAMLDALVLDRVDFVKLLIENGVSMHRFLTISRLEELYNTNLPPDYRISLIDIGLVIEYLMGGAYRCNYTRKRFRTLYHNLFGPKRXARKKDTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSLGVARQAILFPNEEPSWKLAKNIFYMPYWMIYGEVFADQID

SEQ ID NO: 21075 - protein, 480 aa, Homo sapiens
MSGNKFQAISLGQGQGPIAAKMIKAAIEEGTWVCLQNCHLAVSWMPMLEKICEDFTSETCNSSFRLWLTSYPSSKFPVTILQNGVKMTNEPPTGLRLNLLQSYLTDPVSDPEFFKGCRGKELAWEKLLFGVCFFHALVQERKKFGPLGWNIPYGFNESDLRISIRQLQLFINEYDTIPFEAISYLTGECNYGGRVTDDWDRRLLLTMLADFYNLYIVENPHYKFSPSGNYFAPPKGTYEDYIEFIKLPFTQHPEIFGLHENVDISKDLQQTKTLFESLLLTQGGSKQTGASGSTDQILLEITKDILNKLPSDFDIEMALRKYPVRYEESMNTVLVQEMERFNNLIITIRNTLRDLEKAIKGVVVMDSALEALSSSLLVGKVPEIWAKRSYPSLKPLGSYITDFLARLNFLQAFLTGAMQNYARKYTTPIDLLGYEFEVIPSDTSDTSPEDGVYIHGLYLDGARWDRELAEQYPKLLFDLM

SEQ ID NO: 21076 - protein, 80 aa, Homo sapiens
MVNPTRFLDIIVDGELLGRVSFELFADKIPKTAENFCALIIGEKGFGYKGSYFHRIVPGFMCQGGDFTQHNGTGGKSIYG

SEQ ID NO: 21077 - protein, 160 aa, Homo sapiens
MVNPTVFFDIAVNSEPLGHVSFKLFADKVPKTAENFRALSTGEKGFGYKGSCFHRIIPGFMCQGGDFTHHNGTSSKSIYGEKFDDENFILKHTGPGILSMANAGPNTNSSQFFICTAKTEWLDGKHVVFGKAKEGMNIVEAIEHFGSRNGKTSKKITTAD

SEQ ID NO: 21078 - protein, 384 aa, Homo sapiens
RLQPTLLLATLSAAFGSAFQYGYNLSVVNTPQVFKSFYNETYFERHEHSMLLLWSCTVSMFPLGGLLGSLLVGLLVDSCGRKGDLLINNIFAIIPAILMGVSKVAKAFELIVFSRVVLGVCAGALRRLRGHTDMEAELEDMRAEARAERAEGHLSVLHLCALRSLRWQLLSIIVLMAGQQLSGINAINYYADTIYTSAGVEAAHSQYVTVGSGVVNIVMTITSVLVERLGRRHLLLAGYGICGSACLVLTVVLLFQNRVPELSYLGIICVFAYIAGHSIGPSPVPSVVRTEIFLQSSRRAAFMVDGAVHWLTNFIIGFLFPSIQVSEGPFIIFAGICLLTAIYIYVVIPETKGKTFVEINRIFAKRNRVKLPEEKEETIDAGPP

SEQ ID NO: 21079 - protein, 240 aa, Homo sapiens
MQRSNHTVTEFILLGFTTDPGMQLGLFVVFLGVYSLTVVGNSTLIVLICNDSCLHTPMYFFTGNLSFLDLWYSSVYTPKILVTCISEDKSISFAGCLCQFFFSAGLAYSECYLLAAVAYDRYVAISKPLLYAQAMSIKLCALLVAVSYCGGFINSSIITKKTFSFNFCRENIIDDFFCDLLPLVELACGEKGGYKIMMYFLLASNVICPAVLILASYLFIITSVLRISSSKGYLKAFSTC

SEQ ID NO: 21080 - protein, 240 aa, Homo sapiens
MDDENATLLTEFVLTGLTYQSEWKIPLFLAFLVIYLITIMANLGLIAVIWKDSHLHIPMYLFLGSLAFVDAWLSSSVTPKMLISFLAKSMIISVSECKIQFFSFGISGTTECFLLATMAYDRYVAICKPLLYPVIMTNGLCIWLLVLSFIGGFLHALIHEGILFRLTFCNSNIIHHFYCDIIPLLKISCTDPSINFLMLFILSGSIQVFTILTVLVSYTFVLFTILKKKVCQRHKESLFH

SEQ ID NO: 21081 - protein, 880 aa, Homo sapiens
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQRDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYF

SEQ ID NO: 21082 - protein, 400 aa, Homo sapiens
  VARIANT (1)...(400): Xaa = Any Amino Acid
CQKGYFPCGNLTKCLPRAFHCDGKDDCGNGADEENCGEXVSLLQSDTFFPFDFSYFKNFRYCSYAPHVRICMPLTDGISSFEDLLANNILRIFVWVIAFITCFGNLFVIGMRSFIKAENTTHAMSIKILCCKYVSSISRLRISSVSCALDIYMYLLADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLPDTMTSWIVIFFLPVNSALNPILYTLTTNFFKDKLKQLLHK

SEQ ID NO: 21083 - protein, 320 aa, Homo sapiens
  VARIANT (1)...(320): Xaa = Any Amino Acid
MPSPEIQLGFKLREDLQEQMNKNKMMPVLSEDTILQSQDETERNQALLQTRKNCSMFIGSFRQSGLSLNHQNIEGPEAESPEVLPHIEKTLQDPNPSGLQTLAHQNITSCEPLSNKRNSNSVTNSSDQETACVLRRSSRLEKLKVSRDAEYSDHMYKMPEKILPKILGCEDLTNNNSSAQNFRMQXPALMIDGKEKNMHSARFKNGKQIRKNEQFSGKKEKMKVNKISLHSINRRNIFGENLVYKAALHDDADLVHHCIKKGGNVNQPSYAGWTALHEASVGGFYRTASELLKGGADVNIKGLYQITPLHDAVMNGHYKL

SEQ ID NO: 21084 - protein, 2498 aa, Homo sapiens
  VARIANT (1)...(2498): Xaa = Any Amino Acid
CSMDPMEGECQDHTLKWHYNKEERVCQQFWCGSCGLQGTAPPGHALEWTLENVLLAAPRPRKAQVLFAIVASETSSWDREKLWTLSLEAKCKGITLFVLALGPGVGTHELAELAELVSAPSEQHCTSFLDKCRPDPECPAGTPGPQEVDVDLVFVVDSSYGVDADVYRGSLSLADAALEDLEVAEQPGASHRGARVALVTHTTPNFWPGVGCLPVLEGFHLTTYGNRKQMQRHVREASAAQVSLAFKVNSDQGFPAKFQIYQKAVFDSLLQVNVSGPTHLNAQFLRSLWDTFKDKSASRGQVSIFQEADVIFLCDGSDRVSNSDFVTMTTFLSDLIDNFDIQSQRMKIGMAQFGSNYQSIIELKNSLTKTQWKTQIQNVSKSGGFPRIDFALKKVSNMFNLHAGGRRNAGVPQTLVVITSGDPRYDVADAVKTLKDLGICVLVLGIGDVYKEHLLPITGNSEKIITFQDFDKLKNVDVKKRIIRERITLLDVVFVLDHSGSIKKQYQDHMINLTIHLVKKADVGRDRVQFGALKYSDQPNILFYLNTYSNRSAIIENLRKRRDTGGNTYTAKALKHANALFTEEHGSRIKQNVKQMLIVITDGESHDHDQLNDTALELRNKGITIFAVGVGKANQKELEGMAGNKNNTIYVDNFDKLKDVFTLVQDMFLVDSSWSIGNENFRKTKIXMKNLLTKIQIGADKTQIGVVQFSDKTKEEFQLNRYFTQQEISDAIDRMSLINEGTLTGKALNFVGQYFTHSKGARLGAKKFLILITDGVAQDDVRDPARILRGKDVTIFSVGVYNANRSQLEEISGDSSLVFHVENFDHLKALERKLIVDTKEADIHFLIDGSSSIQEKQFEQIKRFMLEVTEMFSIGPDKVRVGVVQYSDDTEVEFYITDYSNDIDLRKAIFNIKQLTGGTYTGKALDYILQIIKNGMKDRMSKVPCYLIVLTDGMSTDRVVEPAKRLRAEQITVHAVGIGAANKIELQEIAGKEERVSFGQNFDALKSIKNEVVREICAEKGKQHKKGFILHPISCQKDSLADLVFLVDESLGTGGNLRHLQTFLENITSSMDVKENCMRLGLMSYSNSAKTISFLKSSTTQSEFQQQIKNLSIQVGKSNTGAAIDQMRRDGFSESYGSRRAQGVPQIAVLVTHRPSDDEVHDAALNLRLEDVNVFALSIQGANNTQLEEIVSYPPEQTISDVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVILIGPGPVYADVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVTKADIMFLVDSSGSIGPENFSKMKTFMKNLVSKSQIGPDRVQIGVVQFSDINKEEFQLNRFMSQSDISNAIDQMAHIGQTTLTGSALSFVSQYFSPTKGARPNIRKFLILITDGEAQDIVKEPAVVLRQEGVIIYSVGVFGSNVTQLEEISGRPEMVFYVENFDILQRIEDDLDFHEMKTFLSEVVGMFNIAPHKVRVGAVQYADSWDLEFEINKYSNKQDLGKAIENIRQMGGNTNTGAALNFTLSLLQKAKKQRGNKVPCHLVVLTNGMSKDSILEPANRLREEHIRVYAIGIKEANQTQLREIAGEEKRVYYVHDFDALKDIRNQVVQEICTDVVFLLDMSINGSEENXDYLKGFLEESVSALDIKENCMRVGLVAYSNETKVINSLSMGINKSEVLQHIQNLSPRTGKAYTGAAIKKLRKEVFSARNGSRKNQGVPQIAVLVTHRDSEDNVTKAAVNLRREGVTIFTLGIEGASDTQLEKIASHPAEQYVSKLKTFADLAAHNQTFLKKLRNQITHTVSEGKPECPVHPTELVFALDHSRDVTEQEFERMKEMMAFLVRDIKVRENSCPVGAHIAILSYNSHARHLVRFSDAYKKSQLLREIETIPYERSSASREIGRAMRFISRNVFKRTLPGAHTRKIATFFSSGQSADAHSITTAAMEFGALEIIPVVITFSNVPSVRRAFAVIDDTGTFQVIVVPNVCKPDASCDQARPPPVQSYMDAAFLLDASRNMGSAEFEDIRAFLGALLDHFEITPEPETSVTGDRVALLSHAPPDFLPNTQKSPVRAEFNLTTYRSKRLMKRHVHESVKQLNGDAFIGHALQWTLDNVFLSTPNLRRNKVIFVISAGETSHLDGEILKKESLRAKCQGYALFVFSLGPIWDDKELEDLASHPLDHHLVQLGRIHKPDHSYGVKFVKSFINSIRR

SEQ ID NO: 21085 - protein, 160 aa, Homo sapiens
LQSFYFGEISTGTPPQNFLVSLIRVPPICSLPSIYCQSQVCHNRFNPSLSSTFRNDGQTYGLSYGSGSLSVFLGYDTVTVSNVFIASEVHNIVVNNQEFGLSENEPSDPFYYSDFDGILGMAYPNMAEGNSPTVMQGMLQQSQLTQPVFSFYFTLYSGQI

SEQ ID NO: 21086 - protein, 240 aa, Homo sapiens
MSRRNYTELTEFVLLGLTSRPELRVAFLALFLFVYIATVVGNLGMIILIKVDSRLHTPMYFFLSSLSILDLCFSTNFTPKMLENFLSEKKTISYAGCLMQCYVVIAVVLAEHCMLAVMAYDRYMAICNPLLYSSKMSQGVCVHLVIVPYVYGFLLSVMETLRTYNLSFCGTNEINHFYCADPPLIKLACSDTYSKELSMYIVAGYSNVQSLLIILTSYMFILVAILRSHSAEGRKKAFST

SEQ ID NO: 21087 - protein, 80 aa, Homo sapiens
LRPFTLYEYRVRACNSKGSVESLWSLTQTLEAPPQDFPAPWAQATSAHSVLLNWTKPESPNGIISHYRVKTPEAAPMDLN

SEQ ID NO: 21088 - protein, 513 aa, Homo sapiens
EFRCQCASFSGPRCEINVNECSSSPCLHGYCYDVDGFSCLCNPGYVGIRCEQDIDDCILNACEHNSTCKDSYQCVCLSDWEGNFCEQESNECKMNPCKNNSTCTDLYKSYRCECTSGWTGQNCSEEINECDSDPCMNGGLCHESTIPGQFVCLCPPLYTGQFCHQRYNLCDLLHNPCRNNSTCLALVDANQHCICREGKSAEFEGKNCEIDVKDCLFLSCQDYGDCEDMVNNFRCICRPGFSGSLCEIEINECSSEPCKNNGTCVDLTNRFFCNCEPEYHGPFCELDVNKCKISPCLDEENCVYRTDGYNCLCAPGYTGKSISVPCAATYFCLQANRNLIFILQNLKTGINCEINLDECLSEPCLHDGVCIDGINHYTCDCKSGFFGTHCETNANDCLSNPCLHGDCTSIPCMNEGFCQKSAHGFTCICPRGYTGAYCEKSIDNCAEPELNSVICLNGGICVDGPGHTFDCRCLPGFSGQFCEININECSSSPCLHGADCEDHINGYVCKCQP

SEQ ID NO: 21089 - protein, 121 aa, Homo sapiens
IFQTWDVALSRTARAWGKKCLFTHNIYLQDVQMVHPKFYGIGENMWVGPENEFTASIAIRSWHAEKKMYNFENGSCSGDCSNYIQVLVWDHSYKVGCAVTPCSKIGHIIHAAIFICNYAPG

SEQ ID NO: 21090 - protein, 240 aa, Homo sapiens
MLNFTDVTEFILLGLTSRREWQVLFFIIFLVVYIITMVGNIGMMVLIKVSPQLNNPMYFFLSHLSFVDVWFSSNVTPKMLENLFSDKKTITYAGCLVQCFFFIALVHVEIFILAAMAFDRYMAIGNPLLYGSKMSRVVCIRLITFPYIYGFLTSLAATLWTYGLYFCGKIEINHFYCADPPLIKMACAGTFVKEYTMIILAGINFTYSLTVIIISYLFILIAILRMRSAEGRQKAFSTCG

SEQ ID NO: 21091 - protein, 467 aa, Homo sapiens
  VARIANT (1)...(467): Xaa = Any Amino Acid
LDLCFSYRGYDCRNNLFYTQAGEVVYHIAAVAVVYNRQQHSQRLYLGHDDDILSLTIHPVKDYVATGQVSISCKLGKYVGHSAHVTNVRWSHDFQWVLSTGGADHSVFQWRFIKPLTSKEEIKGIPWASWTCVKGPEVSGIWPKYTEVTDINSVDANYNSSVLVSGDDFGLVKLFKFPCDRKEVIHEMKFSPDGSYLAVGSNDGPVDVYAVAXRYKKIGECSKSLSFITHIDWSLDSKYLQTNDGAGERLFYLWSLADHALIARCNMEEAVRSVAFSPDGSQLALGMKDGSFIVLDRLLAGTQDSEIFEVIVRERDKPMLILQGHCEGELWALALHPKKPLAVTGSDDRSVGIFSMYACEEGFATGGRDGCIRLWDTDFKPITKIDLRETEQGYKGNICVKLTCNSFWTLCGNALTAKRGIFGKTGDLQTILCLACAKEDITYSGALNGDIYVWKGLNLVRTIQGAH

SEQ ID NO: 21092 - protein, 320 aa, Homo sapiens
MDPTISTLDTELTPINGTEETLCYKQTLSLTVLTCIVSLVGLTGNAVVLWLLGCRMRRNAFSIYILNLAAADFLFLSGRLIYSLLSFISIPHTISKILYPVMMFSYFAGLSFLSAVSTERCLSVLWPIWYRCHRPTHLSAVVCVLLWALSLLRSILEWMLCGFLFSGADSAWCQTSDFITVAWLIFLCVVLCGSSLVLLIRILCGSRKIPLTRLYVTILLTVLVFLLCGLPFGIQFFLFLWIHVDREVLFCHVHLVSIFLSALNSSANPIIYFFVGSFRQRQNRQNLKLVLQRALQDASEVDEGGGQLPEEILELSGSRL

SEQ ID NO: 21093 - protein, 160 aa, Homo sapiens
MSYNGGAIMAMKGKNRVAIAADRHFGIQAQMVTTDFQEIFPMGGWLYIGLAGLATDVQRVAQCLKFQLNLYELKEGQQIKPYTFTSMVANFLYEKHFGPYYTDPVIAGLDLKTFKPFSCSLDLIGFPMVTDDFVVNGSYAEQMYGMCESLWEPNMDPEHP

SEQ ID NO: 21094 - protein, 240 aa, Homo sapiens
MQRSNHTVTEFILLGFTTDPGMQLGLFVVFLGVYSLTVVGNSTLIVLICNDSHLHTPMYFVVGNLSFLDLWYSSVYTPKILVICISEDKSISFAGCLCQFFFSAGLAYSECCLLAAMAYDRYVAISKPLLYAQAMSIKLCALLVAVSYCGGFINSSIITKKTFSFNFCRENIIDDFFCDLLPLVELACGEKGGYKIMMYFLLASNVICPAVLILASYLFIITSVLRISSSKGYLKAFSTC

SEQ ID NO: 21095 - protein, 240 aa, Homo sapiens
MAPENFTRVTEFILTGVSSCPELQIPLFLVFLVLYGLTMAGNLGIITLTSVDSRLQTPMYFFLQHLALINLGNSTVIAPKMLINFLVKKKTTSFYECATQLGGFLFFIVSEVIMLALMAYDRYVAICNPLLYMVVVSRRLCLLLVSLTYLYGFSTAIVVSSYVFSVSYCSSNIINHFYCDNVPLLALSCSDTYLPETVVFISAATNVVGSLIIVLVSYFNIVLSILKICSSEGRKKAFST

SEQ ID NO: 21096 - protein, 180 aa, Homo sapiens
  VARIANT (1)...(180): Xaa = Any Amino Acid
LGLCLAAPEKTGRWCAMSDHEATKCTSFRDNMKKVFPADGPLVTCVERASSLEYIKAIANEADAVTIDGGLVFEAGLDPYSLKPIMVEICGSKDXREHQLPAEPAPRQEVLPHGPGLVCWIEHPHQDTXAAAKFFSSSCVPCEDMKNFPXRLCQLCAGKGTDKCACSSQDSYFGYAGGLK

SEQ ID NO: 21097 - protein, 160 aa, Homo sapiens
  VARIANT (1)...(160): Xaa = Any Amino Acid
MGNKQTVFTHEQLEAYQXLFYRYQDLAPQLVPLDYTTCPDVKVPYELIGSMPELKDNPFRQRIAQVFSEDGDGHMTLDNFLDMFSVMSEMAPRDLKAYYAFKIYDFNNDDYICAWDLEQTVTKQTRGGLSAEEVSLVCEKVLDEADGDHDGRLSLEDFQN

SEQ ID NO: 21098 - protein, 240 aa, Homo sapiens
MENNTEVTEFILVGLTDDPELQIPLFIVFLFIYLITLVGNLGMIELILLDSCLHTPMYFFLSNLSLVDFGYSSAVTPKVMVGFLTGDKFILYNACATQFFFFVAFITAESFLLASMAYDRYAALCKPLHYTTTMTTNVCACLAIGSYICGFLNASIHTGNTFRLSFCRSNVVEHFFCDAPPLLTLSCSDNYISEMVIFFVVGFNDLFSILVILISYLFIFITIMKMRSPEGRQKAFSTCA

SEQ ID NO: 21099 - protein, 240 aa, Homo sapiens
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFLFYVVILVTRYLIFFKCKDKVEFYRKLHAVAASAGMWTLVIVIVVPLVVSRYGIHEEYNEEHCFKFHKELAYTYVKIINYMIVIFVIAVAVILLVFQVFIIMLMVQKLRHSLLSHQEFWAQLKNLFFIGVILVCFLP

SEQ ID NO: 21100 - protein, 292 aa, Homo sapiens
  VARIANT (1)...(292): Xaa = Any Amino Acid
MADKVLKEKRKQFIRSVGEGTINGLLGELLETRVLSQEEIEIVKCENATVMDKARALLDSVIRKGAPACQICITYICEEDSHLAGTLGLSAAAHIMLALIIFNKEFDSLSKRVGAEVDVIGMMMLLQNLGYKVDEKRNLTASEMTTELEVFSLHQEHKASGSHGIREGICGKKYSEQVPDVLQLNGIFKTLNSKNCPSLKDKPKVIIIQACHNHGVVLVKDSVPASENISLPTPGDFEDDAINQVHIEKDFIAFCSSTLXFNFHLSSQMIKHRCPALKELLRQDVSISSQYI

SEQ ID NO: 21101 - protein, 160 aa, Homo sapiens [sequence omitted]

SEQ ID NO: 21102 - protein, 320 aa, Homo sapiens
MSQDQESPRCTHDQHLQTFSETQSLEVAQVSKALEKTLLSSSHPLVPGKLKEAPAAKAESPLEVPQSFCSSSIAVTTTSSSESDEASSNQEEEDSPSSSEDTSDPRNVPADALDQKVAFLVNFMLHKCQMKKPITKADMLKIIIKDDESHFSEILLRASEHLEMIFGLDVVEVDPTTHCYGLFIKLGLTYDGMLSGEKGVPKTGLLIIVLGVIFMKGNRATEEEVWEVLNLTGVYSGKKHFIFGEPRMLITKDFVKEKYLEYQQVANSDPARYEFLWGPRAKAETSKMKVLEFVAKVHGSYPHSFPSQYAEALKEEEERA

SEQ ID NO: 21103 - protein, 240 aa, Homo sapiens
MPNSTTVMEFLLMRFSDVWTLQILHSASFFMLYLVTLMGNILIVTVTTCDSSLHMPMYFFLRNLSILDACYISVTVPTSCVNSLLDSTTISKAGCVAQVFLVVFFVYVELLFLTIMAHDRYVAVCQPLHYPVIVNSRICIQMTLASLLSGLVYAGMHTGSTFQLPFCRSNVIHQFFCDIPSLLKLSCSDTFSNEVMIVVSALGVGGGCFIFIIRSYIHIFSTVLGFPRGADRTKAFSTCI

SEQ ID NO: 21104 - protein, 669 aa, Homo sapiens
  VARIANT (1)...(669): Xaa = Any Amino Acid
MESGTSSPQPPQLDPLDAFPQKGLEPGDIAVLVLYFLFVLAVGLWVSQATSTVKTKRDTVKGYFLAGGDMVWWPVSGLWFVGASLFASNVGSGHFIGLAGSGAATGISVSAYELNGLVFCADVAWIFLPIYIAGQVSQVTTMPEYLRKRFGGIRIPIILAVLYLFIYIFTKISVVDMYAGAIFIQQSLHLDLYLAIVGLLAITAVYTVAGGGLAAVIYTDALQTLIMLIGALTLMGYSXFAAVGGMEGLKEKYFLALASNRSENSSCGLPREDAFHIFRDPLTSDLPWPGVLFGMSIPSLWYWCTDQVXQVIVQRTLAAKNLSHAKGGALMAAYLKVLPLFIMVFPGMVSRILFPGEGLRGLMMAVMVAALMSSLTSIFNSASTIFTMDLWNHLRPRASEKELMIVGRRVFVLLLVLVSILWIPVVQASQGGQLFIYIQSISSYLQPPVAVVFIMGCFWKRTNEKVALDGQGAFWGLISGLLLGLVRLVLDFIYVQPRCDQPDERPVLVKSIHYLYFSMILSTVTLITVSTVSWFTEPPSKEMVVSHLTWFTRHDPVVQKEQAPPAAPLSLTLSQNGMPEASSSSSVQFEMVQENTSKTHXXHDPKAVQSGEGHPVALWNTGEGQGRAPGQSRSHHSFPGRKPLGEDPPGRQPHFLRELRHLYLGLFCL

SEQ ID NO: 21105 - protein, 880 aa, Homo sapiens
  VARIANT (1)...(880): Xaa = Any Amino Acid
XLGNFSGRTRSAVSVREGQGVVLMCSPPPHSXTGHLYISKVEPSDVGNYTCVVTSMVTNARVLGSPTPLVLRSDGVMGEYEPKIEVQFPETLPAAKGSTVKLECFALGNPIPQINWKEGWAAISSKIKLRKFSGVLEIPNFQQEDAGSYECIAENSRGKNVARGRLTYYAKPHWVQLIKDVEIAVEDSLYWECRASGKPKPSYRWLKNGAALVLEERTQIENGALTISNLSVTDSGMFQCIAENKHGLVYSSAELKVVASAPDFSKNPMKKLVQVQVGSLVSLDCKPRASPRALSSWKKGDVSVQEHERISLLNDGGLKIANVTKADAGTYTCMAENQFGKANGTTHLVVTEPTRITLAPSNMDVSVGESVILPCQVQHDPLLDIIFTWYFNGALADFKKDGSHFEKVGGSSSGDLMIRNIQLKHSGKYVCMVQTGVDSVSSAADLIVRGSPGPPENVKVDEITDTTAQLSWKEGKDNHSPVISYSIQARTPFSVGWQTVTTVPEVIDGKTHTATVVELNPWVEYEFRVVASNKIGGGEPSLPSEKVRTEEAPEVPPSEVNGGGGSRSELVITWDPVPEELQNGEGFGYVVAFRPLGVTTWIQTVVTSPDTPRYVFRNESIVPYSPYEVKVGVYNNKGEGPFSPVTTVFSAEEEPTVAPSQVSANSLSSSEIEVSWNTIPWKLSNGHLLGYEVRYWNGGGKEESSSKMKVAGNETSARLRGLKSNLAYYTAVRAYNSAGAGPFSATVNVTTKKTPSQPPGNVVWNATDTKVLLNWEQVKAMENESEVTGYKVFYRTSSQNNVQVLNTNKTSAELVLPIKEDYIIEVKATTDGGDGTSSEQIRIPRITSLTGMDARGSTSAISNVHPMSSYMPIVLFLIVY

SEQ ID NO: 21106 - protein, 394 aa, Homo sapiens
  VARIANT (1)...(394): Xaa = Any Amino Acid
HVSQDLEASSCSSTQGKFNREQFYKFIIFPGKWIKVXXTEDIKENVLAILLIVLVSLLGFLTLSQGFCKDMWVLLFCLVMASCQYSLLKARPHLILTKGHNQIITYSRPIYFCVLCGLILLLDTGAKARHPPSYVVYGLKLFSPVFLQSARDYLIVFLYCFPAISLLGLFPQINTFCTYLLEQIDMLFFGGSEPWSMQHIPALFSAFCGLLVALSYHLSRQSSDPSVLIFCPFLSQPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKA

SEQ ID NO: 21107 - protein, 80 aa, Homo sapiens
FRIFLKSEFSEENVEFWLACEDFKKTKNADKIASKAKMIYSEFIEADAPKEINIDFGTRDLISKNIAEPTLKCFDEAQKL
